US010766935B2

(12) United States Patent
Brog et al.

(10) Patent No.: US 10,766,935 B2
(45) Date of Patent: Sep. 8, 2020

(54) PLANT TRAITS CONFERRED BY ISOLATED POLYNUCLEOTIDES AND POLYPEPTIDES

(71) Applicant: Evogene Ltd., Rehovot (IL)

(72) Inventors: Yaacov Micha Brog, Kibbutz Gal On (IL); Yael Galon Wolfenson, Rehovot (IL); Shlomo Zev Goren, Bet-Shemesh (IL); Dror Hilman, Rehovot (IL); Hagai Karchi, Moshav Sitriya (IL); Michal Lieberman-Lazarovich, Rehovot (IL); Ronit Rimon Knopf, Modiin (IL); Ruth Van-Oss Pinhasi, Kibbutz Shoval (IL)

(73) Assignee: Evogene Ltd., Rehovot (IL)

( * ) Notice: Subject to any disclaimer, the term of this patent is extended or adjusted under 35 U.S.C. 154(b) by 0 days.

(21) Appl. No.: 16/066,325

(22) PCT Filed: Dec. 22, 2016

(86) PCT No.: PCT/IL2016/051371
§ 371 (c)(1),
(2) Date: Jun. 27, 2018

(87) PCT Pub. No.: WO2017/115353
PCT Pub. Date: Jul. 6, 2017

(65) Prior Publication Data
US 2019/0085038 A1    Mar. 21, 2019

Related U.S. Application Data

(60) Provisional application No. 62/355,451, filed on Jun. 28, 2016, provisional application No. 62/271,523, filed on Dec. 28, 2015.

(51) Int. Cl.
C12N 15/82     (2006.01)
C07K 14/415    (2006.01)

(52) U.S. Cl.
CPC .......... C07K 14/415 (2013.01); C12N 15/827 (2013.01); C12N 15/8261 (2013.01); C12N 15/8273 (2013.01); Y02A 40/146 (2018.01)

(58) Field of Classification Search
CPC .................................................. C07K 14/415
USPC ................................................. 800/260, 290
See application file for complete search history.

(56) References Cited

U.S. PATENT DOCUMENTS

| 6,084,153 | A | 7/2000 | Good et al. |
|---|---|---|---|
| 2002/0046419 | A1 | 4/2002 | Choo et al. |
| 2005/0108791 | A1 | 5/2005 | Edgerton |
| 2005/0221290 | A1 | 10/2005 | Inze et al. |
| 2006/0041961 | A1 | 2/2006 | Abad et al. |
| 2006/0179511 | A1 | 8/2006 | Chomet et al. |
| 2012/0246748 | A1 | 9/2012 | Guo et al. |

FOREIGN PATENT DOCUMENTS

| WO | WO 2004/081173 | 9/2004 |
|---|---|---|
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |

(Continued)

OTHER PUBLICATIONS

Genbank Accession No. XM_004229327.2 2014.*
XP 006349746 2013 Genbank Accession Number.*
NCBI "Predicted: Solanum lycopersicum F-box/LRR-repeat protein 17 (LOC101267447), mRNA", NCBI Reference Sequence: XM_004247288.4, 2 pages, Aug. 8, 2018.
International Preliminary Report on Patentability dated Jul. 12, 2018 From the International Bureau of WIPO Re. Application No. PCT/IL2016/051371. (8 Pages).
International Search Report and the Written Opinion dated Mar. 29, 2017 From the International Searching Authority Re. Application No. PCT/IL2016/051371. (16 Pages).
Kosma et al. "The Impact of Water Deficiency on Leaf Cuticle Lipids of Arabidopsis", Plant Physiology, 151(4): 1918-1929, Dec. 2009. Figs.4, 5, P.1925, Last Para—P.1926, First Para.

(Continued)

Primary Examiner — Li Zheng

(57) ABSTRACT

Provided are isolated polypeptides, isolated polynucleotides encoding same, nucleic acid constructs comprising same, transgenic cells expressing same, transgenic plants expressing same and method of using same for increasing yield, abiotic stress tolerance, growth rate, biomass, vigor, oil content, photosynthetic capacity, seed yield, fiber yield, fiber quality, fiber length, early flowering, grain filling period, harvest index, plant height, and/or nitrogen use efficiency of a plant.

24 Claims, 19 Drawing Sheets
Specification includes a Sequence Listing.

(56) References Cited

FOREIGN PATENT DOCUMENTS

| WO | WO 2015/181823 | 12/2015 |
| WO | WO 2016/030885 | 3/2016 |
| WO | WO 2017/115353 | 7/2017 |

OTHER PUBLICATIONS

NCBI "Predicted: Solanum Lycopersicum Long Chain Acyl-CoA Synthetase 1 (LOC101262955) mRNA", Database NCBI [Online], NCBI Reference Sequence; XM_004229327.3, Database Accession No. XM_004229327, Nov. 22, 2016. Replacement of XM_004229327.2, Nov. 19, 2014.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Zhao et al. "Insertional Mutant Analysis Reveals That Long-Chain Acyl-CoA Synthetase 1 (LACS1), But Not LACS8, Functionally Overlaps With LACS9 in *Arabidopsis* See Oil Biosynthesis", The Plant Journal, 64(6): 1048-1058, Published Online Nov. 15, 2010. Abstract, P.1052, Last Para—P.1055, First Para.
Search Report Dated Feb. 4, 2020 from the Brazilian Patent Office Re. Application No. BR 11 2018 012843 0 with an English Summary (6 pages).
Schmutz et al. "Phaseolus Vulgaris Hypothetical Protein (PHAVU_004G150500g) mRNA, Complete cds," NCBI Reference Sequence: XM_007152622.1, Published Mar. 12, 2014, 2 pages.

\* cited by examiner

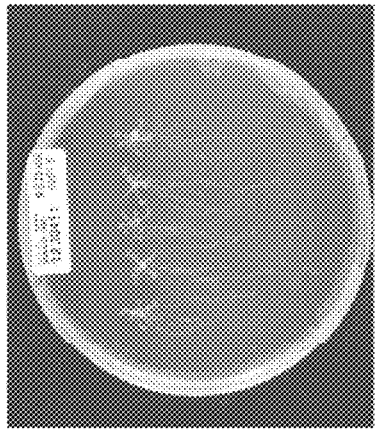
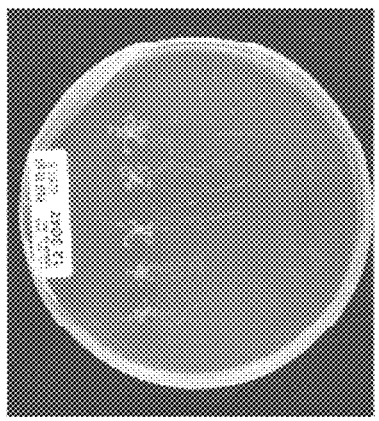
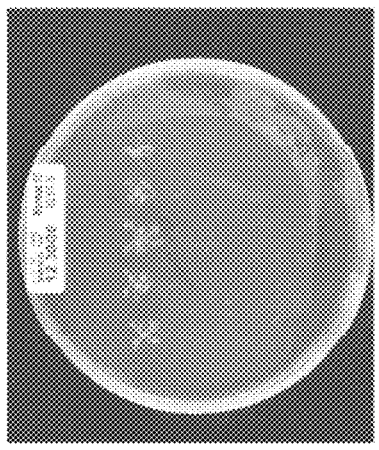
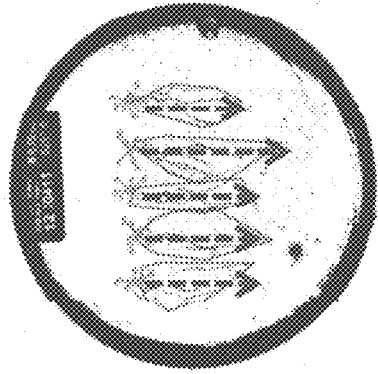
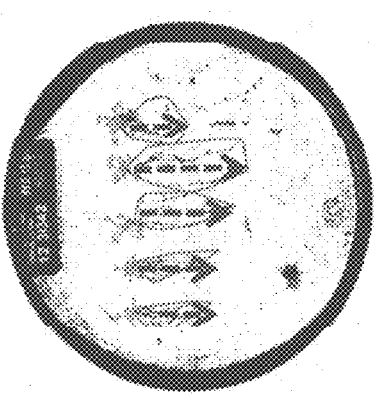
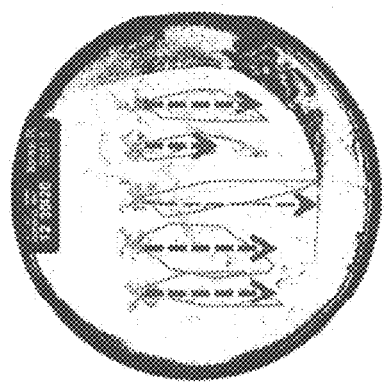
FIG. 3A  FIG. 3C  FIG. 3E
FIG. 3B  FIG. 3D  FIG. 3F pQNa_RP pQXNc

FIG. 14A

TAACACAAGTGTCGAATAGGAAATTCACGAGCTGTCAAAAACCACATGAGGTTTGTTTTGA
CCCGCGACCGCGAGCTTGCTAACGCAAGGTTTCAGTTCTCGCCGAAACGAAACAAAATGACG
GTGCCGCGCTTGCGCTGTCATTTTTTGTTTTCGACGGCCAGGCTGAAACTGTATGGCTGAG
GATGTCACTGAGCTTCTTGTTTCCTAGTGAAAATGGTAGAGAGCAGTTACTTGTTCACGTGA
GAGAAGAAACTAAAGAGAAAATAAATTAGCCTTTCTGCCTTTGTGACTGTTTTGAACTTTTG
ATATATATATCCAGCCTTCCGCATGCTATATTTGAATCTCAATAAACGGTGCTAGGGGGGTT
TTAGCAAAAGTACTTCAATGTTCAATACTGTCTTAATAGACGTCCTTCTCTAACATCAAGGA
GTACATTGCGTACGGGCCCTATTTATTTCGGTTTTTGGCTGTTAGAATCGGCTTTTGGCAGC
CAAATATTTTGTTTTTCAGATTGCTTACATGAGAATCGCGTCTGTAAAAATCGTCTAAATCA
ACGTTAATATAAAATCCTAAATTGTGCAGAGCCCTCCACCTTTCTTAACACACAACACAGGT
CTCAGGATATTCAAATCCATATAAGAGCTAGATTATTCAGTAGTCCAGATTCCGACCAAAAC
TCTTTAGGATGCTATCACAAACAAACATGTCCATATTCTTTCGTGATTTTAACGTATCGTTT
TCGTGCCCTCTAACCAAAACACTCCCAAACTTGTTTTCGCTTTTCGAAAGGAGGCTCGAAAT
TATGAAACTAAATTTTAGGAATAAAGACACAATTGCGACACAAAAATAACCTTTTTTTACCC
AACTTCACACCACCATATGTAGGTCTTCGTGCTACCGGATTTGCCAACACCTATAAAATTTA
TGTCAGGTTGTCACGGCTTTACTATTATCGCGTCTAACTTCAAACACATCTGGAGATGCATT
GATCTCGC (SEQ ID NO:26731)

FIG. 14B

GGAATACTTTGGCAAATTCTGCTCTGTCCTTGCAACCAAGCATAACATACAAGTGACCGAAA
TAGACAAGCAAAGTATATCAGAACATTGTCAAATTGCAAGTTGCAACAAAACTGAAGCAAAC
ACAATGTAGAAACCATTCGGAGCATCACAGGGGTTGGTAGCAATCTGAGATACATGATTAAA
GGAATGGTTTAATAGTACATGCACAATTAAATGTTTCTTTTTGTTTCCAAGCTAGGCTATGA
ATTGTCCACGATCAAGCTAAAACCCCCTACCCACTAAACAGGAGACTGCTAGGCAGGGGCGA
ACAGGGAGCATTCCTGCATGTAAGCAACCAGCCAACCAAATCACAGCCATCTATCATTTCCT
CTTCTTAGTAGGTGGTTGGGGGACATCATCGTCATCATCCTCTTCCTCTTCTTCCTCCTCAT
CTTCCTCATTGTCACCATCCCCATCATCATCGTCGTCATCATCCTCCTCTTCATCCTCTCCA
CCATCATCATCGTCGTCACTTCCTCCTTCACCGTTGGCTGCAGGATCGTTATCATCGTCGTC
GTCATCTTCCTCCTCATTCCCATTGTCATCTGATCCCTCATCACCACCATCATCTTCTTGGT
TTTCAGCATCCTCATCGTCTCCCTCCTCATCATTATCATCATCAGACTCTCCATCATCCTTG
TTCTCGAAATCAGTTGCATTTTTGTTTTGCTCAGAATCCTTGTGGAGAAGGAAACAAACAA
TCCTCAGCTTTGGGAGACGAAAAAAATGCCCATGGCAATAATGATGTGGTACATGTTTTGA
CATTATGCACCAGTGGGCATTACCTATTAATCAAATTCTGATCTCCACCAGATGTAAAGATT
TCATTATGAAGAATCTGCACAAGAAAGTCAAAACAGTACACAGTATTAGTAAGACGAGGTAT
ATTTCCAATTAAAAGTGCACGAACAATGCAACAATGGTTATTCCCGGGCTTTAAAGGACATA
AGACACG (SEQ ID NO:26732)

FIG. 14C

AGATGCATTGATCTCGCGCG    (SEQ ID NO:26729)

FIG. 14D

AGATGCATTGATCTCGC    (SEQ ID NO:26733)

FIG. 14E

ATTTGCCAAAGTATTCCGGG    (SEQ ID NO:26730)

FIG. 14F

GGAATACTTTGGCAAAT    (SEQ ID NO:26734)

FIG. 14G

<u>ATG</u>GCGCCCTCTGCCGCTGCCCCAGGCATCTCTGAGGCTGAGGGGGCACCACGCATGGCC
AAGTTCCTCTGCAGCTTTGGAGGTAGTATCCTTCCCCGACCACTTGATGGCTGTCTTCGA
TATGTTGGTGGCGAGACAAGGATTGTCATATTGCCGCGTGACATATCATATGCCGACCTA
GCTGCACGGATGAGAGATCTCTACAAGGATGCTGATACCATCAAATACCAGCAACCTGAT
GAGGATCTGGATGCGCTGGTCTCGGTCGTGAATCACGATGATGTGGTGAACATGATGGAG
GAGTATGACAAAGTCACTGCCACAGGGGAGGCGTTCACTCGGCTCAGGATCTTCTTATTT
TCTCAGCAATTGGATGACAATGCTGCATCAGTGGCTGTGCATTACAATGTAGACGAGCGG
GAAACAGAGAGAAGGTATGTAGATGCGCTCAACAGCCTTGGTGATGTTAGGTCACCTTCC
TCCCCTGTATCTGTGGAGCAGCTTTTGGCATCGGAGGCAATGATTCAGGAATTCCTGAT
TTTGCTGGCTTGAGACATTTGAATGTCCCTCGTCCATCACATGGTCAGAGGTATGGAGAG
ATGGATTCTCCTTGGAGCCCTGCTTATGTCTCACCAAGCCAGTACAGAGTGCATGACCCG
AGGATTTTCCAATTTCACCGTCATCTGCAAGGTTCCAAGTAGGAGCGGAGGATTTTGAT
GACAGGATTCCTGACGACTTTGTAAGGCAGTCACCAAAATATCATTATTATGAGGCTCAA
TCACCATCACATATGGATAATTTAGTCTGGCTTCCACCTGGTGCTGTAATTCAGCAAAAT
GCAGGTTTCCCTGGTGATTTGAGCAAGCACAATAAATTTTGGATGGGAACAGTGGATGT
GATCACTGTGGTTCACTATTCCACAAGGGTCAGGGTTCGGTGACTGATCCTATCTATATG
AATCCTCGTTGGACTCGGCCAGTCCAACAACATTTTGACCAACCAAGCATGATTAATGAT
TATCCCGGTCACCATGCTAATTCTTGTCCAGATTACTGCCGCCCTGGTGAGCATTATGCG
GGAGGTCAAGATGTTAGATTGGAAAATGGTGTTTATGTTAAAGAGCAAAATGGTGGTCAT
ACTCCCATGCTTTATAATGAGTCACGTCCTCACGATAGAGTCTGGTATGCGCATACCAAC
CAAAGTCATCAGCGGTATGAGGATCCAAGGCTGCATTATCCTACTAATGATAGAGTGATC
GAGCCATACATTGTCGATGCTAGCTCTGTAAATTCCGCATTTGCACCAAACAAAGTATAT
GAAATGCATTCAGCATCTCTTGGTCATTCTAGTTCTAGCCATGAAAGTCCTCACTATTTT
CATGGTAGCAGTGAGCTCATAAATGACGCATATCACAACCAACAAGTTGGAGGCAGTGGG
TCATATGTGCAGCCAGCAGGGTCTGAAGAATCCCCTGGTCAGCATTACAACCACTTTTCG
GCCTATGGTGCAGATTCCTTTTATCAAATGCAACAAAATTTGCCACCCATTCAATCTTTG
AGGAGGAGAGCGAACAGTCCTGTTCACACTGCCTCACCATATGATTCCCCACACCTGCCA
ATACCAAATGGGAGCATTAACATGAATTCTGTTAGAAATACAGGTGATGCGAGTCCCAGG
ATAGCAGGTCTTATTGGATATGATCGAATGCCAAACCCATTTACTCCGCCCAATGGCAGC
ATACTATATAGAGTTGGTGGGCATGATGTTCCTGCAGCTATGGAGAACACTAGTGCTTTT
GGTCCTAGGTCTAATCCAACTGCTGCTCAGTATGTTCAGCCTTTTATTGCTCCTGAATCA
ATCCAGCATCAACCTGGAGTTCCCTTGAGGGAGGTTTATCCTGAAAGAGCATACCCTGAA
CCCATGCCGTCATCATATGCTGATGGCAAAGTAGCTGTTTCTGCATTGCCCCTCACCGAC
CAATTATTCAGGTTGGATATAAACACAATGAAGAAACTTGAAGGACAAGATGATGGGAAC
TCTACTCGAAATGTGAATGAAACAACTCTTTTGCATGCTGTGGATGAACCAAGTACCTTA

FIG. 14G (Cont.)

CCCCACCATGTTGGATCTGTACATGAAGTCGATCCTAAGCAGGAGAAGCTAACCGAAAAA
GAAAGCAGGCAAAAGCAACATGAAGCTGGGGCTACAGCACTGCAGGAATGTGAGGATATT
TCAGAGGATATGTTGAATTTCCTTCCTGAATTAATTGCCTCTGTTAAAAGGTAACACTG
GAAGATGCTGCTGAGACACAAATAGCCCAATCAGATGCTAATGCTGCTGTTTCACCTGTT
CCTGATGATGACGATAATGGAAAGAAGCTGGATGAGGCAACAGCTGGTAATACAAATGCA
AATCAGGACCTTGATTTGCAAGGAAGCCTTGATCGGCAGAAGAGTTTCAAGATTGAGTCT
ACAACTGCTGAAGCTGAAGCTTTGTCGAAAGGACTACAGACTATAAAAATGATGATTTA
GAGGAAATTAGAGAGCTGGGTTCAGGTACTTATGGGCGGTCTATCATGGTAAATGGAGG
GGATGCGATGTTGCTATTAAAAGAATAAAAGCAAGTTGCTTTGCTGGAAGACCATCTGAA
AGAGAGCGTTTGATCACGGATTTCTGGAAGAAGCTCTGATCCTAAGCTCACTTCATCAT
CCAAATGTGGTTGCATTTATGGTGTAGTTCGTGATGGTCCAGATGGAAGCTTAGCAACT
GTTACTGAGTTTATGGTTAATGGGTCTCTCAAACAGTTCCTGAGGAAAAAGACAGGACA
ATAGATCGCCGGAAGAGAGTAATATTAGCCATGGATGCTGCATTTGGCATGGAATATTTG
CACGGGAAGAATATAGTCCATTTTGACCTGAAGTGTGAGAATCTACTGGTGAACATGAGG
GATCCACAGCGACCAATCTGCAAGATCGGTGATCTCGGGCTATCAAAGGTTAAACAGCAT
ACTTTGGTATCTGGTGGTGTTAGAGGAACCTTACCGTGGATGGCACCAGAGCTTCTGAGT
GGGAAAAACAATATGGTGTCAGAGAAGATTGACGTCTATTCGTTTGGAATTGTCATGTGG
GAGCTGCTTACTGGGAAGAGCCATACTCTGATATGCGTGCTGCTGAAATTATTGGGGCC
ATTGTAAACGATTCCTTACGCCCTCAAATCCCTTCATGGTGTGATCCTGAGTGGAAGGGA
TTGATGGAAAGCTGTTGGTCCAGTGATCCAGCGGAGAGACCGTCCTTCACTGATATATCT
CAAAGGTTGAGGAAAATGGCCGCTGCAATGAATGTGAAG<u>TGA</u>   (SEQ ID NO:26736)

FIG. 14H

TAACACAAGTGTCGAATAGGAAATTCACGAGCTGTCAAAAACCACATGAGGTTTGTTTT
TGACCCGCGACCGCGAGCTTGCTAACGCAAGGTTTCAGTTCTCGCCGAAACGAAACAAA
ATGACGGTGCCGCGCTTGCGCTGTCATTTTTTTGTTTTCGACGGCCAGGCTGAAACTGT
ATGGCTGAGGATGTCACTGAGCTTCTTGTTTCCTAGTGAAAATGGTAGAGAGCAGTTAC
TTGTTCACGTGAGAGAAGAAACTAAAGAGAAATAAATTAGCCTTTCTGCCTTTGTGAC
TGTTTTGAACTTTTGATATATATATCCAGCCTTCCGCATGCTATATTTGAATCTCAATA
AACGGTGCTAGGGGGGTTTTAGCAAAAGTACTTCAATGTTCAATACTGTCTTAATAGAC
GTCCTTCTCTAACATCAAGGAGTACATTGCGTACGGGCCCTATTTATTTCGGTTTTTGG
CTGTTAGAATCGGCTTTTGGCAGCCAAATATTTTGTTTTTCAGATTGCTTACATGAGAA
TCGCGTCTGTAAAAATCGTCTAAATCAACGTTAATATAAAATCCTAAATTGTGCAGAGC
CCTCCACCTTTCTTAACACACAACACAGGTCTCAGGATATTCAAATCCATATAAGAGCT
AGATTATTCAGTAGTCCAGATTCCGACCAAAACTCTTTAGGATGCTATCACAAACAAAC
ATGTCCATATTCTTTCGTGATTTAACGTATCGTTTCGTGCCCTCTAACCAAAACACT
CCCAAACTTGTTTTCGCTTTTCGAAGGAGGCTCGAAATTATGAAACTAAATTTTAGGA
ATAAAGACACAATTGCGACACAAAAATAACCTTTTTTTACCCAACTTCACACCACCATA
TGTAGGTCTTCGTGCTACCGGATTTGCCAACACCTATAAAATTTATGTCAGGTTGTCAC
GGCTTTACTATTATCGCGTCTAACTTCAAACACATCTGG*AGATGCATTGATCTCGCGCG*

FIG. 14H (Continued 1)

CTTGAAAATTTAGTTATTAGGTTGGTAAAGACTAGGTTAGGTAAGAAATTTGAAAACAAA
AATCCATGGGAGATGTTTTACGTAGAAGAATAGTGAGAATTTGAGAAACTTTATTTCCTA
AGAAACAAAGAAAGTTTTGGTGAAATAATTGAAACGAAAAATTCGAGAAACTAGAAGCCCG
ATAATGCCCTTCTCCTCTACCAACTACCAGCGCAGTCACTCGCCTCTGCACACGTCGCTGA
TGCTCGTCTTCCTTCCTTCCATCCTTTATAAGGCCCGGCCGCGGCTCTGCTCGCCTCTCC
TCCCTTCCCTCCCGTACCGTATCAGTCTCCCGGATTCTCTCCGGTTCGTGGGAGGGCCAAA
GCTTCGAGTTAGGAAAACCCTACCGCTGTGGGAGTAGCCTCCGGCatggcgccctctgcc
gctgccccaggcatctctgaggctgagggggcaccacgcatggccaagttcctctgcagct
ttggaggtagtatccttccccgaccacttgatggctgtcttcgatatgttggtggcgagac
aaggattgtcatattgccgcgtgacatatcatatgccgacctagctgcacggatgagagat
ctctacaaggatgctgataccatcaaataccagcaacctgatgaggatctggatgcgctgg
tctcggtcgtgaatcacgatgatgtggtgaacatgatggaggagtatgacaagtcactgc
cacaggggaggcgttcactcggctcaggatcttcttatttctcagcaattggatgacaat
gctgcatcagtggctgtgcattacaatgtagacgagcgggaaacagagagaaggtatgtag
atgcgctcaacagccttggtgatgttaggtcaccttcctcccctgtatctgtggagcagct
ttttggcatcggaggcaatgattcaggaattcctgattttgctggcttgagacatttgaat
gtccctcgtccatcacatggtcagaggtatggagagatggattctccttggagccctgctt
atgtctcaccaagccagtacagagtgcatgacccgagggattttccaatttcaccgtcatc
tgcaaggttcaagtaggagcggaggattttgatgacaggattcctgacgactttgtaagg
cagtcaccaaaatatcattatgaggctcaatcaccatcacatatggataatttagtct
ggcttccacctggtgctgtaattcagcaaaatgcaggtttcctggtgatttgagcaagca
caataaattttggatgggaacagtggatgtgatcactgtggttcactattccacaaggt
cagggttcggtgactgatcctatctatatgaatcctcgttggactcggccagtccaacaac
atttgaccaaccaagcatgattaatgattatcccggtcaccatgctaattcttgtccaga
ttactgccgccctggtgagcattatgcgggaggtcaagatgttagattggaaaatggtgtt
tatgttaaagagcaaaatggtggtcatactccatgctttataatgagtcacgtcctcacg
atagagtctggtatgcgcataccaaccaaagtcatcagcggtatgaggatccaaggctgca
ttatcctactaatgatagagtgatcgagccatacattgtcgatgctagctctgtaaattcc
gcatttgcaccaaacaaagtatatgaaatgcattcagcatctcttggtcattctagttcta
gccatgaaagtcctcactattttcatggtagcagtgagctcataaatgacgcatatcacaa
ccaacaagttggaggcagtggtcatatgtgcagccagcagggtctgaagaatccctggt
cagcattacaaccacttttcggcctatggtgcagattccttttatcaaatgcaacaaaatt
tgccaccattcaatctttgaggaggagagcgaacagtcctgttcacactgcctcaccata
tgattccccacacctgccaataccaaatgggagcattaacatgaattctgttagaaataca
ggtgatgcgagtccaggatagcaggtcttattggatatgatcgaatgccaaacccatttta
ctccgcccaatggcagcatactatagagttggtgggcatgatgttcctgcagctatgga
gaacactagtgcttttggtcctaggtctaatccaactgctgctcagtatgttcagccttt
attgctcctgaatcaatccagcatcaacctggagttcccttgagggaggtttatcctgaaa
gagcatacctgaacccatgccgtcatcatatgctgatggcaaagtagctgtttctgcatt
gcccctcaccgaccaattattcaggttggatataaacacaatgaagaaacttgaaggacaa
gatgatgggaactctactcgaaatgtgaatgaaacaactcttttgcatgctgtggatgaac
caagtaccttaccccaccatgttggatctgtacatgaagtcgatcctaagcaggagaagct
aaccgaaaagaaagcaggcaaaagcaacatgaagctgggctacagcactgcaggaatgt
gaggatatttcagaggatatgttgaatttccttcctgaattaattgcctctgttaaaaagg
taacactggaagatgctgctgagacacaaatagcccaatcagatgctaatgctgctgtttc

FIG. 14H (Continued 2)

acctgttcctgatgatgacgataatggaaagaagctggatgaggcaacagctggtaataca
aatgcaaatcaggaccttgatttgcaaggaagccttgatcggcagaagagtttcaagattg
agtctacaactgctgaagctgaagctttgtcgaaggactacagactataaaaaatgatga
tttagaggaaattagagagctgggttcaggtacttatggggcggtctatcatggtaaatgg
agggatgcgatgttgctattaaaagaataaaagcaagttgctttgctggaagaccatctg
aaagagagcgtttgatcacggatttctggaagaagctctgatcctaagctcacttcatca
tccaaatgtggttgcattttatggtgtagttcgtgatggtccagatggaagcttagcaact
gttactgagtttatggttaatgggtctctcaaacagttcctgaggaaaaaagacaggaca
atagatcgccggaagagagtaatattagccatggatgctgcatttggcatggaatatttg
cacgggaagaatatagtccattttgacctgaagtgtgagaatctactggtgaacatgagg
gatccacagcgaccaatctgcaagatcggtgatctcgggctatcaaggttaaacagcat
actttggtatctggtggtgttagaggaaccttaccgtggatggcaccagagcttctgagt
gggaaaaacaatatggtgtcagagaagattgacgtctattcgtttggaattgtcatgtgg
gagctgcttactggggaagagccatactctgatatgcgtgctgctgaaattattggggcc
attgtaaacgattccttacgccctcaaatccttcatggtgtgatcctgagtggaaggga
ttgatggaaagctgttggtccagtgatccagcggagagaccgtccttcactgatatatct
CaaaggttgaggaaaatggccgctgcaatgaatgtgaagtgaGCCAGCGAGAGACGCAGGA
TAAAGGCCGTAGTTTTGCAAGGCGAGTAGAGCAGTATGTCAGTAATACAGCATCTATGGCA
TGTGCTTTTGCTCGTCCAGTTCATGAGCCCCGTTGTGTATTTGGTTTCCGTTTTCTTGGTT
GGAGTTTTTAGTTCCAAGGTCCGATCATGTTTTGATCCCATAAATTCTCTTCCAGCCTTCG
AGCAACTGAGTCCATCTTCCTAAGTCATCAGCCCCAGCGAGACATTGAAGCATGGGGAAAC
TTAAACAGTATGGTGATGATTAATCTCAGCATTTTTTTCTTGCAGCAATCAATATGGACT
TTGCTTAAAATTTCGTTGTCTTTTCAAAACGATATGCAAGCAAAATGGAAGTGATGTTCTT
TGAAACTTTGTTTCAATGCTATAGCAAAGGTTTGCATTTTACAAAGTTCGGTTTAGTGACG
ACCATTTAGATGACATAGATTATGCTTTTCGTATTTTGGTAGCTTCTCGTGCGGACGCGCG
GTCATGCCTAGCATGCCGAAGACCTTGTCATATAGTGAAAGGAATTGCGGTAGCAATTAGT
TCATTTTTCCCTAATCCCCTCCAATCACTTTCTCACCAAACAAACTCCAAAGGTCGTCACC
GAAGGGGACGTTCCC*GGAATACTTTGGCAAAT*CTGCTCTGTCCTTGCAACCAAGCATAA
CATACAAGTGACCGAAATAGACAAGCAAAGTATATCAGAACATTGTCAAATTGCAAGTTGC
AACAAAACTGAAGCAAACACAATGTAGAAACCATTCGGAGCATCACAGGGGTTGGTAGCAA
TCTGAGATACATGATTAAAGGAATGGTTTAATAGTACATGCACAATTAAATGTTTCTTTTT
GTTTCCAAGCTAGGCTATGAATTGTCCACGATCAAGCTAAAACCCCCTACCCACTAAACAG
GAGACTGCTAGGCAGGGGCGAACAGGGAGCATTCCTGCATGTAAGCAACCAGCCAACCAAA
TCACAGCCATCTATCATTTCCTCTTCTTAGTAGGTGGTTGGGGGACATCATCGTCATCATC
CTCTTCCTCTTCTTCCTCCTCATCTTCCTCATTGTCACCATCCCATCATCATCGTCGTCA
TCATCCTCCTCTTCATCCTCTCCACCATCATCATCGTCGTCACTTCCTCCTTCACCGTTGG
CTGCAGGATCGTTATCATCGTCGTCGTCATCTTCCTCCTCATTCCATTGTCATCTGATCC
CTCATCACCACCATCATCTTCTTGGTTTTCAGCATCCTCATCGTCTCCCTCCTCATCATTA
TCATCATCAGACTCTCCATCATCCTTGTTCTCGAAATCAGTTGCATTTTGTTTTTGCTCA
GAATCCTTGTGGAGAAGGAAACAAACAATCCTCAGCTTTGGGAGACGAAAAAAAATGCCCA
TGGCAATAATGATGTGGTACATGTTTTGACATTATGCACCAGTGGGCATTACCTATTAATC
AAATTCTGATCTCCACCAGATGTAAAGATTTCATTATGAAGAATCTGCACAAGAAAGTCAA
AACAGTACACAGTATTAGCTAAGACGAGGTATATTTCCAATTAAAAGTGCACGAACAATGC
AACAATGGTTATTCCCGGGCTTTAAAGGACATAAGACACG (SEQ ID NO:26735)

PLANT TRAITS CONFERRED BY ISOLATED POLYNUCLEOTIDES AND POLYPEPTIDES

RELATED APPLICATIONS

This application is a National Phase of PCT Patent Application No. PCT/IL2016/051371 having International filing date of Dec. 22, 2016, which claims the benefit of priority under 35 USC § 119(e) of U.S. Provisional Patent Application Nos. 62/355,451 filed on Jun. 28, 2016 and 62/271,523 filed on Dec. 28, 2015. The contents of the above applications are all incorporated by reference as if fully set forth herein in their entirety.

SEQUENCE LISTING STATEMENT

The ASCII file, entitled 72942SequenceListing.txt, created on Jun. 27, 2018, comprising 60,504,953 bytes, submitted concurrently with the filing of this application is incorporated herein by reference. The sequence listing submitted herewith is identical to the sequence listing forming part of the international application.

FIELD OF THE INVENTION

The present invention, in some embodiments thereof, relates to isolated polypeptides and polynucleotides, nucleic acid constructs comprising same, transgenic cells comprising same, transgenic plants expressing same and more particularly, but not exclusively, to methods of using same for increasing at least one trait selected from yield (e.g., seed yield, fiber yield), biomass, growth rate, vigor, oil content, fiber quality, fiber length, photosynthetic capacity, fertilizer use efficiency (e.g., nitrogen use efficiency) and/or abiotic stress tolerance of a plant.

BACKGROUND OF THE INVENTION

Yield is affected by various factors, such as the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; Arabidopsis Information Resource (TAIR; arabidopsis (dot) org/), TAIR No. AT2G43710)], OleosinA (TAIR No. AT3G01570) or FAD3 (TAIR No. AT2G29980), and various transcription factors and activators such as Lec1 [TAIR No. AT1G21970, Lotan et al. 1998. Cell. 26; 93(7): 1195-205], Lec2 [TAIR No. AT1G28300, Santos Mendoza et al. 2005, FEBS Lett. 579 (21):4666-70], Fus3 (TAIR No. AT3G26790), ABI3 [TAIR No. AT3G24650, Lara et al. 2003. J Biol Chem. 278(23): 21003-11] and Wri1 [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using Arabidopsis FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. Publication No. 20020046419 (U.S. Pat. No. 7,262,055 to Choo, et al.); U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB 1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmstrim et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield); WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modern spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. Nos. 5,981,834, 5,597,718, 5,620,882, 5,521,708 and 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO publication No. 2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2012/150598 publication discloses isolated polynucleotides and polypeptides and methods of using same for increasing plant yield, biomass, growth rate, vigor, oil content, abiotic stress tolerance of plants and nitrogen use efficiency.

WO2013/027223 publication discloses isolated polynucleotides and polypeptides, and methods of using same for increasing plant yield and/or agricultural characteristics.

WO2013/080203 publication discloses isolated polynucleotides and polypeptides, and methods of using same for increasing nitrogen use efficiency, yield, growth rate, vigor, biomass, oil content, and/or abiotic stress tolerance.

WO2013/098819 publication discloses isolated polynucleotides and polypeptides, and methods of using same for increasing yield of plants.

WO2013/128448 publication discloses isolated polynucleotides and polypeptides and methods of using same for increasing plant yield, biomass, growth rate, vigor, oil content, abiotic stress tolerance of plants and nitrogen use efficiency.

WO 2013/179211 publication discloses isolated polynucleotides and polypeptides, and methods of using same for increasing plant yield and/or agricultural characteristics.

WO2014/033714 publication discloses isolated polynucleotides, polypeptides and methods of using same for increasing abiotic stress tolerance, biomass and yield of plants.

WO2014/102773 publication discloses isolated polynucleotides and polypeptides, and methods of using same for increasing nitrogen use efficiency of plants.

WO2014/102774 publication discloses isolated polynucleotides and polypeptides, construct and plants comprising same and methods of using same for increasing nitrogen use efficiency of plants.

WO2014/188428 publication discloses isolated polynucleotides and polypeptides, and methods of using same for increasing plant yield and/or agricultural characteristics.

WO2015/029031 publication discloses isolated polynucleotides and polypeptides, and methods of using same for increasing plant yield and/or agricultural characteristics.

SUMMARY OF THE INVENTION

According to an aspect of some embodiments of the present invention there is provided a method of increasing at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant, comprising over-expressing within the plant a polypeptide comprising an amino acid sequence at least 80% identical to an amino acid sequence selected from the group consisting of SEQ ID NOs: 15824-23573, thereby increasing the at least one trait selected from yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of the plant.

According to an aspect of some embodiments of the present invention there is provided a method of increasing at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant, comprising over-expressing within the plant a polypeptide comprising an amino acid sequence selected from the group consisting of SEQ ID NOs:15824-25609, thereby increasing the at least one trait selected from yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of said plant.

According to an aspect of some embodiments of the present invention there is provided a method of producing a crop comprising growing a crop plant over-expressing a polypeptide comprising an amino acid sequence at least 80% homologous to the amino acid sequence selected from the group consisting of SEQ ID NOs:15824-23573, wherein the crop plant is derived from plants which have been subjected to genome editing for over-expressing said polypeptide and/or which have been transformed with an exogenous polynucleotide encoding said polypeptide and which have been selected for at least one trait selected from the group consisting of increased yield, increased growth rate, increased biomass, increased vigor, increased oil content, increased seed yield, increased fiber yield, increased fiber quality, increased fiber length, increased photosynthetic capacity, increased nitrogen use efficiency, increased early flowering, increased grain filling period, increased harvest index, increased plant height, and/or increased abiotic stress tolerance as compared to a wild type plant of the same species which is grown under the same growth conditions, and said crop plant having the selected trait(s), thereby producing said crop.

According to an aspect of some embodiments of the present invention there is provided a method of increasing at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant, comprising expressing within the plant an exogenous polynucleotide comprising a nucleic acid sequence at least 80% identical to a nucleic acid sequence selected from the group consisting of SEQ ID NOs: 40-11140 thereby increasing the at least one trait selected from yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of the plant.

According to an aspect of some embodiments of the present invention there is provided a method of increasing at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant, comprising expressing within the plant an exogenous polynucleotide comprising the nucleic acid sequence selected from the group consisting of SEQ ID NOs: 40-15346, thereby increasing the at least one trait selected from yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of the plant.

According to an aspect of some embodiments of the present invention there is provided a method of producing a crop comprising growing a crop plant transformed with an exogenous polynucleotide which comprises a nucleic acid sequence which is at least 80% identical to the nucleic acid sequence selected from the group consisting of SEQ ID NO: 40-11140, wherein the crop plant is derived from plants which have been transformed with said exogenous polynucleotide and which have been selected for at least one trait selected from the group consisting of increased yield, increased growth rate, increased biomass, increased vigor, increased oil content, increased seed yield, increased fiber yield, increased fiber quality, increased fiber length, increased photosynthetic capacity, increased nitrogen use efficiency, increased early flowering, increased grain filling period, increased harvest index, increased plant height, and/or increased abiotic stress tolerance as compared to a wild type plant of the same species which is grown under the same growth conditions, and the crop plant having the selected trait(s), thereby producing the crop.

According to an aspect of some embodiments of the present invention there is provided an isolated polynucleotide comprising a nucleic acid sequence encoding a polypeptide which comprises an amino acid sequence at least 80% homologous to the amino acid sequence set forth in any one of SEQ ID NO: 15824-23573, wherein the polypeptide is capable of increasing at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs:15824-25609.

According to an aspect of some embodiments of the present invention there is provided an isolated polynucleotide comprising a nucleic acid sequence at least 80% identical to a nucleic acid sequence selected from the group consisting of SEQ ID NOs:40-11140, wherein said nucleic acid sequence is capable of increasing at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant.

According to an aspect of some embodiments of the present invention there is provided an isolated polynucleotide comprising the nucleic acid sequence selected from the group consisting of SEQ ID NOs: 40-15346.

According to an aspect of some embodiments of the present invention there is provided a nucleic acid construct comprising the isolated polynucleotide of some embodiments of the invention, and a promoter for directing transcription of said nucleic acid sequence in a host cell.

According to an aspect of some embodiments of the present invention there is provided an isolated polypeptide comprising an amino acid sequence at least 80% homologous to an amino acid sequence selected from the group consigns of SEQ ID NOs: 15824-23573, wherein the polypeptide is capable of increasing at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant.

According to an aspect of some embodiments of the present invention there is provided an isolated polypeptide comprising the amino acid sequence selected from the group consisting of SEQ ID NOs: 15824-25609.

According to an aspect of some embodiments of the present invention there is provided a plant cell comprising an exogenous polynucleotide of some embodiments of the invention, or a nucleic acid construct comprising the exogenous polynucleotide of some embodiments of the invention. According to ceryain embodiment, the exigenous polynucleotide is expressed within the plant cell.

According to an aspect of some embodiments of the present invention there is provided a plant cell expressing the polypeptide encoded by an exogenous polynucleotide of some embodiments of the invention.

According to an aspect of some embodiments of the present invention there is provided a transgenic plant comprising the nucleic acid construct of some embodiments of the invention or the plant cell of some embodiments of the invention.

According to an aspect of some embodiments of the present invention there is provided a method of growing a crop, the method comprising seeding seeds and/or planting plantlets of a plant over-expressing the isolated polypeptide of some embodiments of the invention, and/or transformed with the nucleic acid construct of some embodiments of the invention, wherein the plant is derived from plants which over-express the polypeptide and/or transformed with the nucleic acid construct of some embodiments of the invention and which have been selected for at least one trait selected from the group consisting of: increased nitrogen use efficiency, increased abiotic stress tolerance, increased biomass, increased growth rate, increased vigor, increased yield, increased fiber yield, increased fiber quality, increased fiber length, increased photosynthetic capacity, increased early flowering, increased grain filling period, increased harvest index, increased plant height, and increased oil content as compared to a control plant not over-expressing said polypeptide and/or not transformed with said nucleic acid construct, thereby growing the crop.

According to an aspect of some embodiments of the present invention there is provided a method of selecting a plant having at least one trait selected from the group consisting of increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to a control plant of the same species which is grown under the same growth conditions, the method comprising:

(a) providing plants over-expressing a polypeptide comprising an amino acid sequence at least 80% homologous to the amino acid sequence selected from the group consisting of SEQ ID NOs:15824-23573, (b) selecting from said plants of step (a) a plant having at least one trait selected from increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to a control plant of the same species which is grown under the same growth conditions, thereby selecting the plant having the selected trait(s).

According to certain embodiments, the method comprises providing plants over-expressing a polypeptide comprising an amino acid sequence selected from the group consisting of SEQ ID NOs:15824-26243. According to certain embodiments, the method comprises providing plants over-expressing a polypeptide comprising an amino acid sequence selected from the group consisting of SEQ ID Nose: 23574-25609. According to certain embodiments, the method comprises providing plants over-expressing a polypeptide comprising an amino acid sequence selected from the group consisting of SEQ ID NOs: 25610-26243.

According to an aspect of some embodiments of the present invention there is provided a method of selecting a transformed plant having at least one trait selected from the group consisting of increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to a wild type plant of the same species which is grown under the same growth conditions, the method comprising:

(a) providing plants transformed with an exogenous polynucleotide at least 80% identical to the nucleic acid sequence selected from the group consisting of SEQ ID NOs:40-11140, (b) selecting from said plants of step (a) a plant having at least one trait selected from increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to a control plant of the same species which is grown under the same growth conditions, thereby selecting the plant having the selected trait(s).

According to some embodiments, the method comprises providing plant transformed with an exogenous polynucleotide comprising a nucleic acid sequence selected from the group consisting of SEQ ID NOs:40-15823. According to certain embodiments, the method comprises providing plant transformed with an exogenous polynucleotide consisting of a nucleic acid sequence selected from the group consisting of SEQ ID NOs:40-15823.

According to some embodiments of the invention, the nucleic acid sequence encodes an amino acid sequence selected from the group consisting of SEQ ID NOs: 15824-26243.

According to some embodiments of the invention, the nucleic acid sequence encodes the amino acid sequence selected from the group consisting of SEQ ID NOs: 15824-25609. According to some embodiments of the invention, the nucleic acid sequence encodes the amino acid sequence selected from the group consisting of SEQ ID NOs: 15824-26243.

According to some embodiments of the invention, the plant cell forms part of a plant.

According to some embodiments of the invention, the method further comprises growing the plant over-expressing said polypeptide under abiotic stress.

According to some embodiments of the invention, the abiotic stress is selected from the group consisting of salinity, drought, osmotic stress, water deprivation, flood, etiolation-inducing light conditions, low temperature, high temperature, heavy metal toxicity, anaerobiosis, nutrient deficiency, nitrogen deficiency, nutrient excess, atmospheric pollution and deleterious UV irradiation.

According to some embodiments of the invention, the yield comprises seed yield or oil yield.

According to some embodiments of the invention, the method further comprising growing the plant over-expressing said polypeptide under nitrogen-limiting conditions.

According to some embodiments of the invention, the promoter is heterologous to said isolated polynucleotide and/or to said host cell.

According to some embodiments of the invention, the control plant is a wild type plant not over-expressing said polypeptide or not transformed with saod polynucleotide.

According to some embodiments of the invention, the wild type plant is of identical genetic background.

According to some embodiments of the invention, the wild type plant is of the same species.

According to some embodiments of the invention, the control plant is grown under identical growth conditions.

According to some embodiments of the invention, the method further comprises selecting a plant with at least one increased trait, wherein the trait is selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to the control plant of the same species which is grown under the same growth conditions.

According to some embodiments of the invention, the selecting is performed under non-stress conditions.

According to some embodiments of the invention, the selecting is performed under abiotic stress conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG; FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

FIGS. 14A-H depict an exemplary design of Homology Directed Repair according to some embodiments of the invention. FIG. 14A depicts the sequence of the endogenous 5'-upstream flanking region of the genomic sequence GRMZM2GO69095 (SEQ ID NO:26731). FIG. 14B depicts the sequence of the endogenous 3'-downstream flanking region of the genomic sequence GRMZM2GO69095 havin the nucleic acid sequence set forth in SEQ ID NO:26732. FIG. 14C depicts the sequence of the 5'-UTR sgRNA (SEQ ID NO: 26729). FIG. 14D depicts the sequence of the 5'-UTR gRNA without NGG nucleotides (SEQ ID NO: 26733). FIG. 14E depicts the sequence of the 3'-UTR gRNA (SEQ ID NO: 26730). FIG. 14F depicts the sequence of the 3'-UTR gRNA after cut (SEQ ID NO: 26734). FIG. 14G depicts the coding sequence (from the "ATG" start codon to the "TGA" termination codon, marked by bold and underlined) of the desired LBY245 sequence (SEQ ID NO: 26736) encoding the polypeptide set forth by SEQ ID NO: 16122. FIG. 14H depicts the exemplary repair template (SEQ ID NO: 26735) which includes (1) the upstream flanking region (1 kbp) sequence including part of the gRNA after cutting (SEQ ID NO: 26733; shown in bold and italics); (2) 5' UTR of genomic DNA from Cas9 cutting site to ATG; (3) the coding sequence (CDS) of the desired LBY245 sequence (SEQ ID NO:26736) marked in lower case with the start (ATG) and the stop (TGA) codons marked in bold and underlined; (4) 3' UTR of genomic DNA from the stop codon to Cas9 cutting site including the predicted part of the gRNA after cutting (SEQ ID NO: 26734, shown in bold and italics and (5) the downstream flanking region (1 kbp) sequence.

DESCRIPTION OF SPECIFIC EMBODIMENTS OF THE INVENTION

Figure 1:
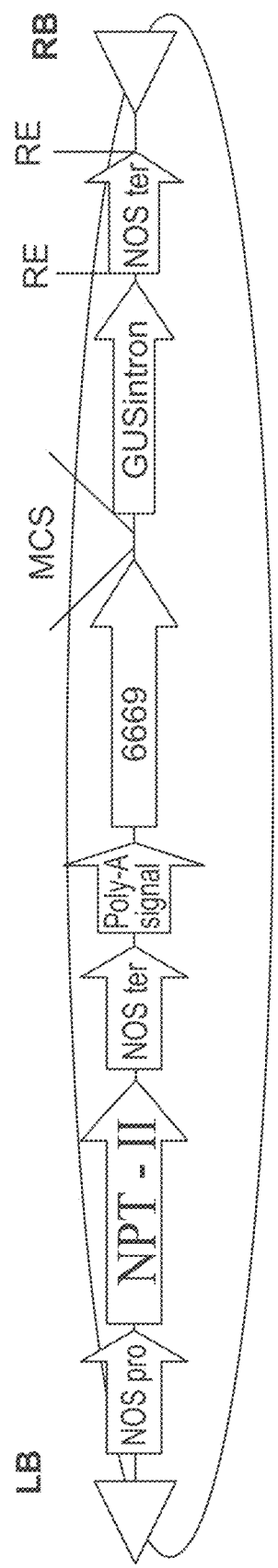
FIG. 1 is a schematic illustration of the modified pGI binary plasmid containing the new At6669 promoter (SEQ ID NO: 25) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
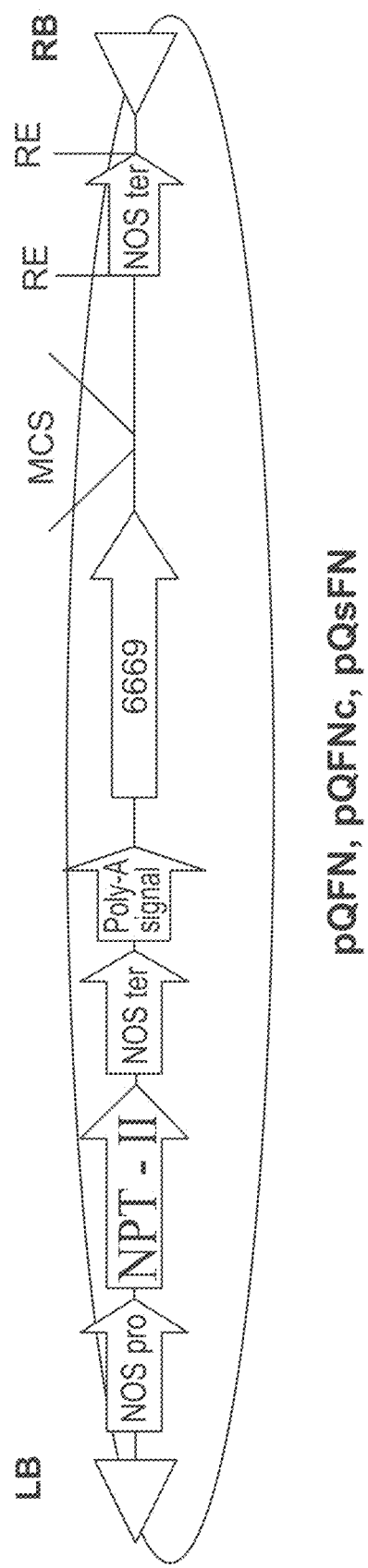
FIG. 2 is a schematic illustration of the modified pGI binary plasmid containing the new At6669 promoter (SEQ ID NO: 25) (pQFN or pQFNc or pQsFN) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 4:
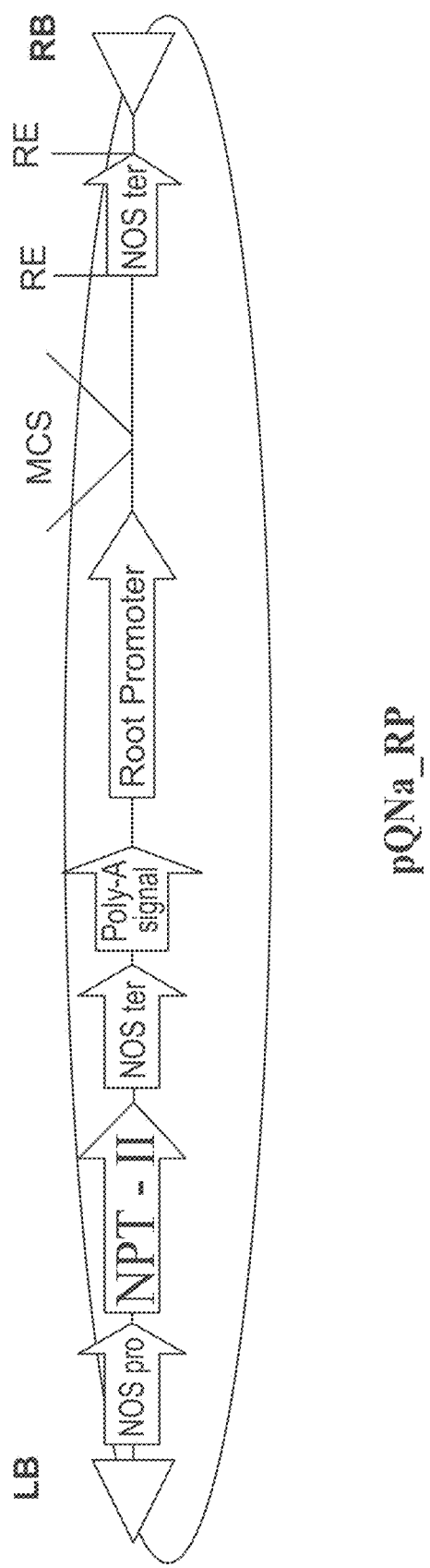
FIG. 4 is a schematic illustration of the modified pGI binary plasmid containing the Root Promoter (pQNa RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS (Multiple cloning site) of the vector.
Figure 5:
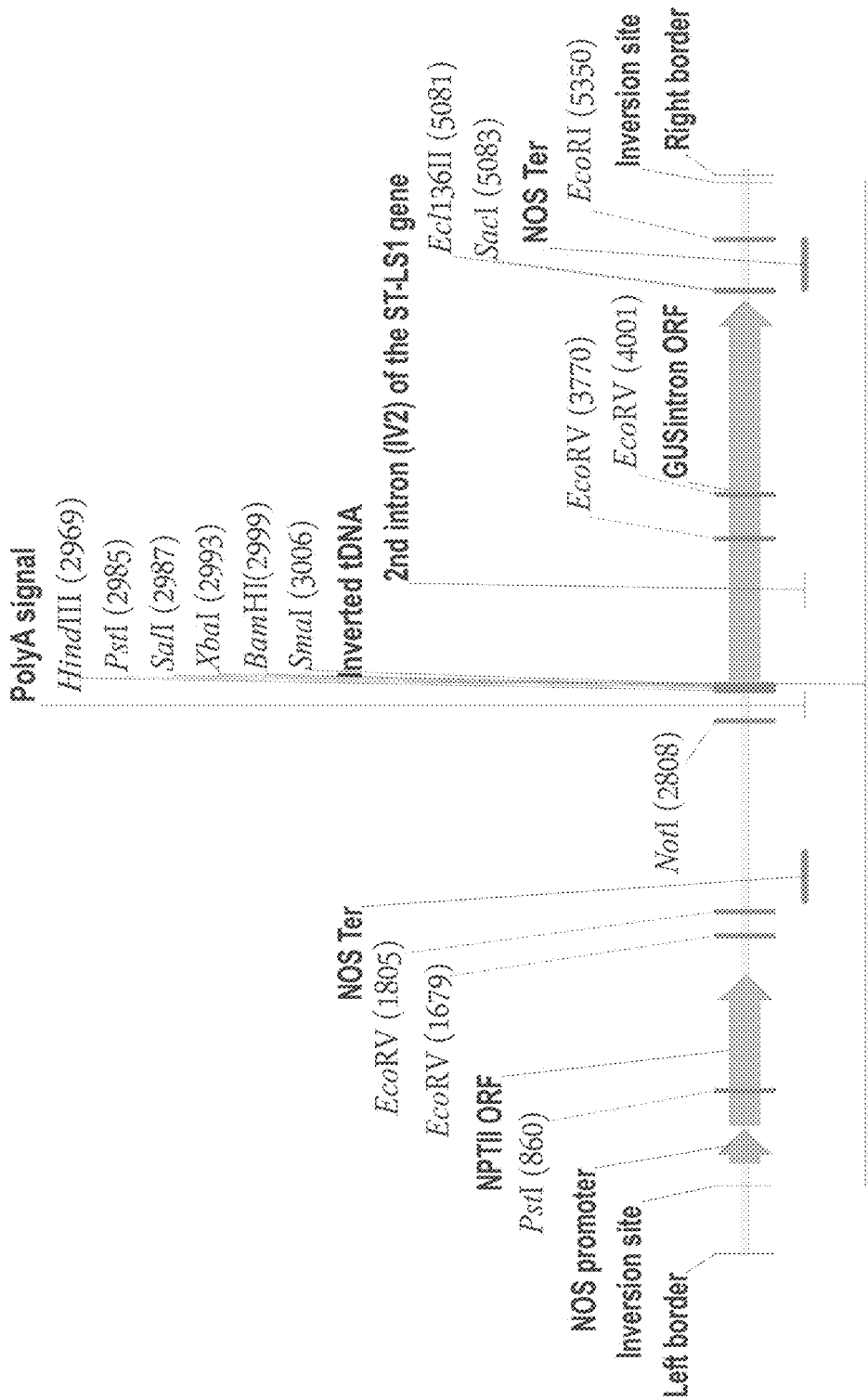
FIG. 5 is a schematic illustration of the pQYN plasmid.
Figure 6:
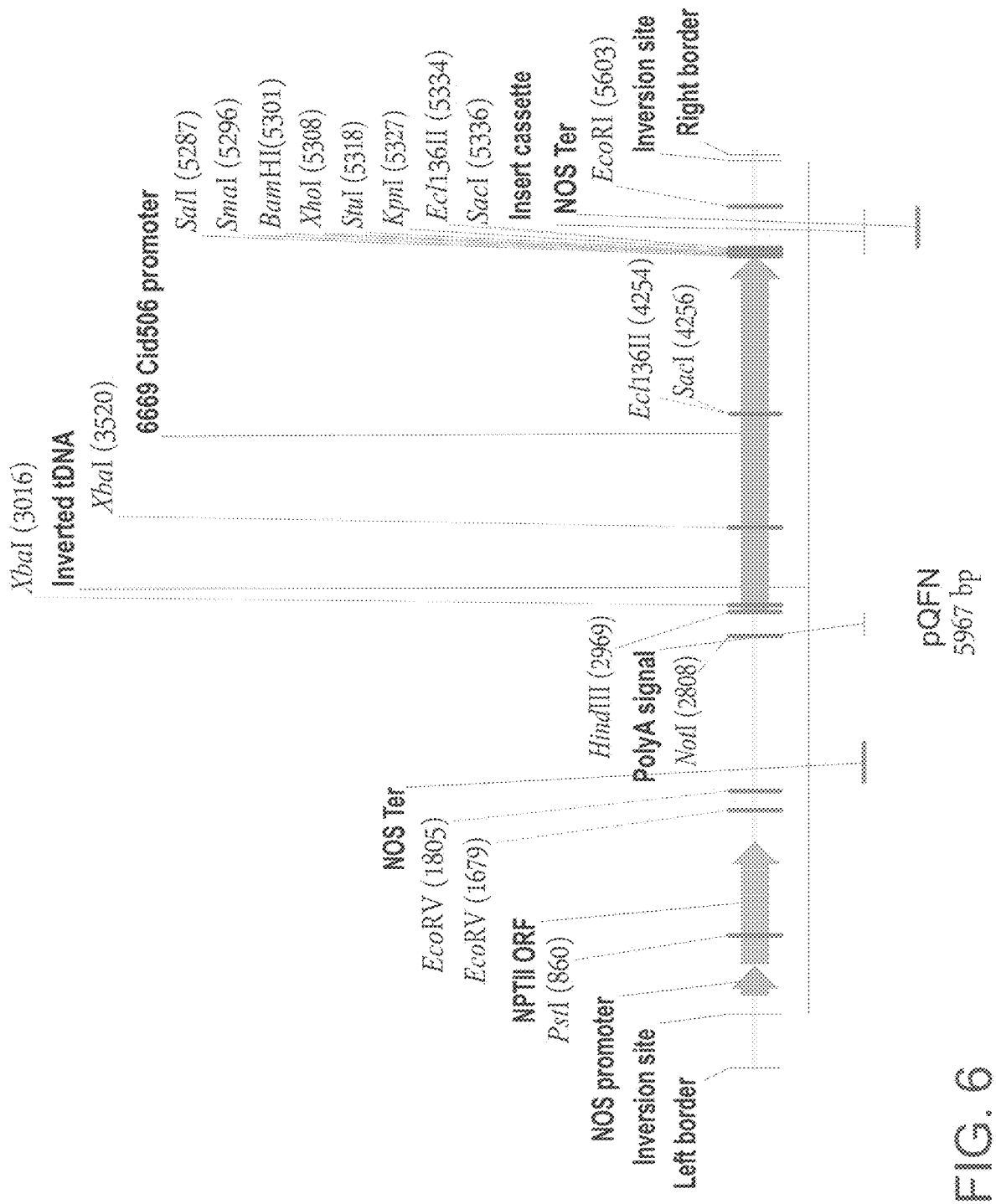
FIG. 6 is a schematic illustration of the pQFN plasmid.
Figure 7:
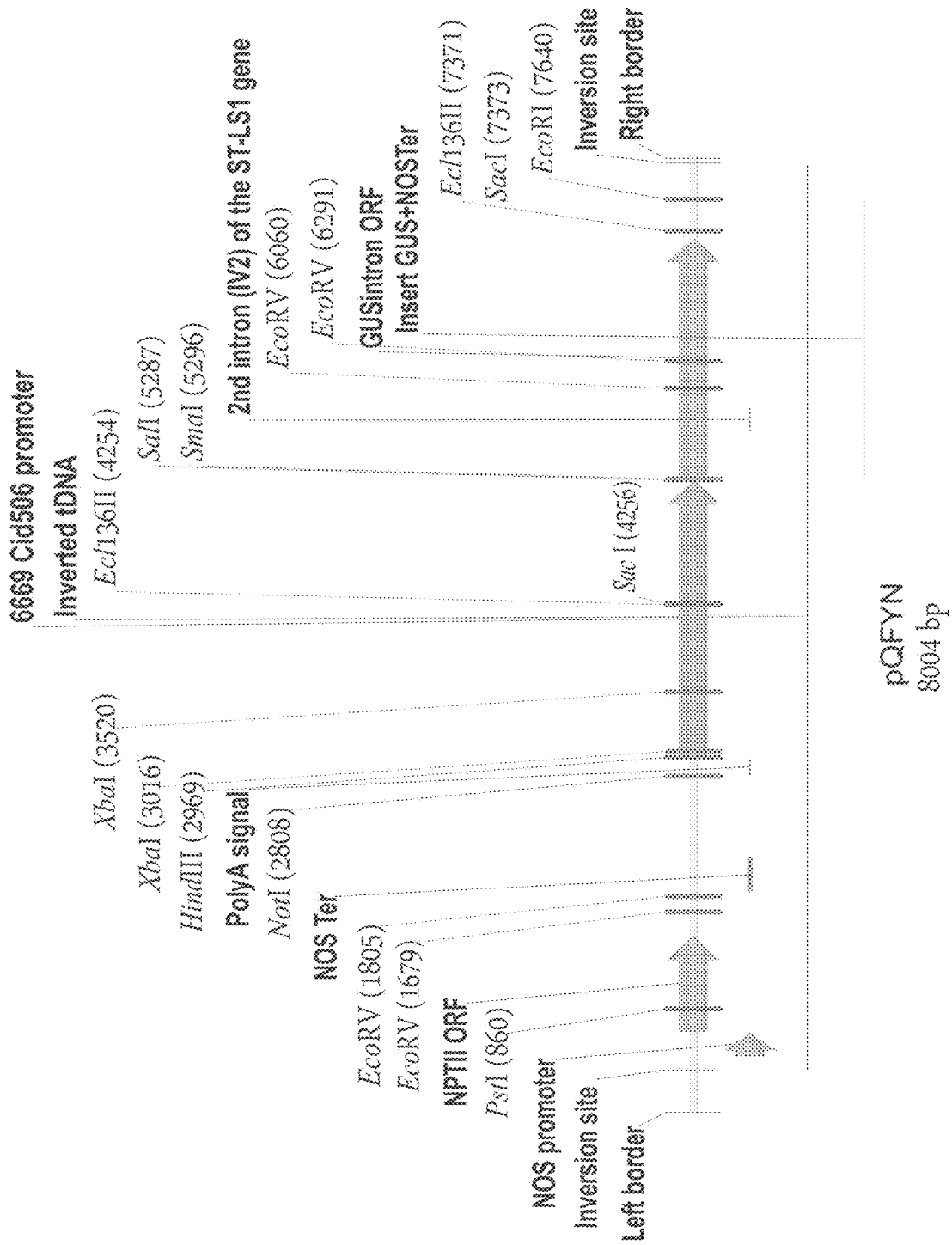
FIG. 7 is a schematic illustration of the pQFYN plasmid.
Figure 8:
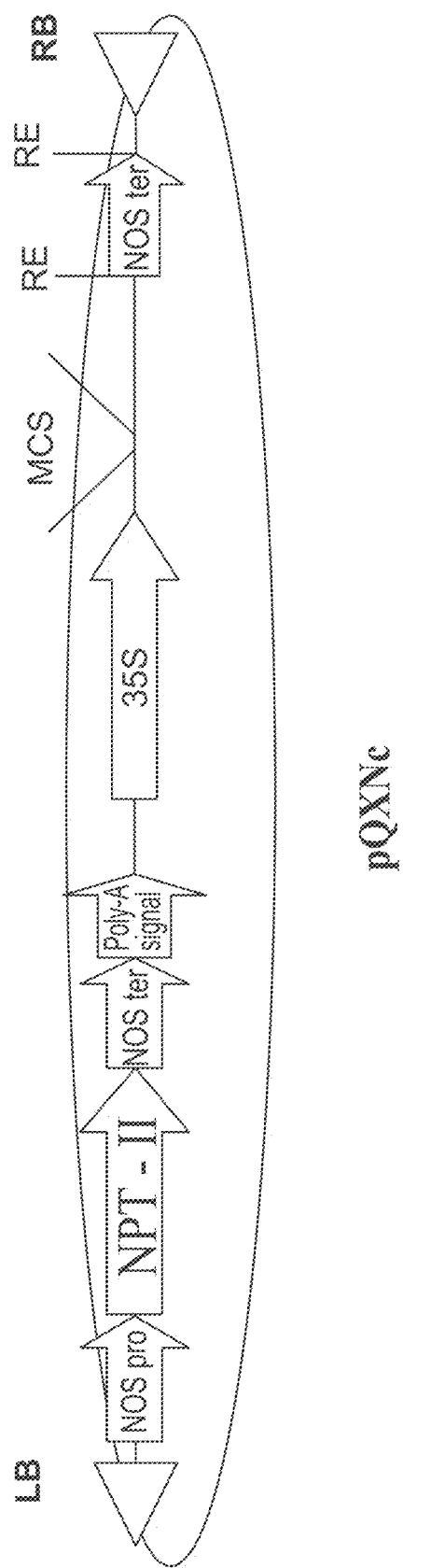
FIG. 8 is a schematic illustration of the modified pGI binary plasmid (pQXNc) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pQXNc); SEQ ID NO: 21). The isolated polynucleotide sequences of some embodiments of the invention were cloned into the MCS (Multiple cloning site) of the vector.

The present invention, in some embodiments thereof, relates to isolated polynucleotides, polypeptides encoded by same and nucleic acid constructs comprising same, plant cells transformed with same and methods of using same.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to generate nucleic acid constructs, transgenic plant cells, transgenic plants and to increase at least one trait selected from nitrogen use efficiency, fertilizer use efficiency, yield, growth rate, vigor, biomass, oil content, fiber yield, fiber quality, fiber length, photosynthetic capacity, early flowering, grain filling period, harvest index, plant height, abiotic stress tolerance and/or water use efficiency of a plant, such as a wheat plant.

Thus, as shown in the Examples section which follows, the present inventors have utilized bioinformatics tools to identify polynucleotides which enhance/increase at least one of fertilizer use efficiency (e.g., nitrogen use efficiency), yield (e.g., seed yield, oil yield), growth rate, biomass, vigor, fiber yield, fiber quality, fiber length, photosynthetic capacity, early flowering, grain filling period, harvest index, plant height, and/or abiotic stress tolerance of a plant. Genes which affect the trait-of-interest were identified (core genes, SEQ ID NOs: 15824-16121, 23574-23587 and 25610-25615) for polypeptides; and SEQ ID NOs: 40-347 and 11,141-11,160 (for polynucleotides) based on expression profiles of genes in various tissues of several Arabidopsis, Barley, Sorghum, Maize, Soybean, Tomato, Cotton, bean, Brassica Juncea (Canola), Wheat, and Foxtail millet ecotypes and accessions under various growth conditions, homology with genes known to affect the trait-of-interest and using digital expression profile in specific tissues and conditions (Tables 1-284, Examples 1-23 of the Examples section which follows). Homologous (e.g., orthologous) polypeptides and polynucleotides having the same function in increasing at least one of fertilizer use efficiency (e.g., nitrogen use efficiency), yield (e.g., seed yield, oil yield), oil content, growth rate, biomass, vigor, fiber yield, fiber quality, fiber length, photosynthetic capacity, early flowering, grain filling period, harvest index, plant height, and/or abiotic stress tolerance of a plant were also identified (polypeptides set forth in any one of SEQ ID NOs:16122-23573, 23588-25609, 25616-26243 and polynucleotides set forth in any one of SEQ ID NOs:348-11140 and 11161-15823); Table 286, Example 24 of the Examples section which follows. The polynucleotides of some embodiments of the invention were cloned into binary vectors (Example 25, Table 287), and were further transformed into Arabidopsis and Brachypodium plants (Examples 26-28). Altogether, these results suggest the use of the novel polynucleotides and polypeptides of the invention (e.g., any one of SEQ ID NOs:15824-26243) for increasing at least one of nitrogen use efficiency, fertilizer use efficiency, yield (e.g., oil yield, seed yield), oil content growth rate, biomass, vigor, fiber yield, fiber quality, fiber length, photosynthetic capacity, early flowering, grain filling period, harvest index, plant height, water use efficiency and/or abiotic stress tolerance of a plant.

Thus, according to an aspect of some embodiments of the invention, there is provided a method of increasing at least one trait selected from the group consisting of oil content, yield, seed yield, growth rate, biomass, vigor, fiber yield, fiber quality, fiber length, photosynthetic capacity, fertilizer use efficiency (e.g., nitrogen use efficiency), early flowering, grain filling period, harvest index, plant height, and/or abiotic stress tolerance of a plant, comprising over-expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs:15824-25609 e.g., using an exogenous polynucleotide which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the polynucleotide selected from the group consisting of SEQ ID NOs: 40-15346, thereby increasing the at least one trait selected from oil content, yield, seed yield, growth rate, biomass, vigor, fiber yield, fiber quality, fiber length, photosynthetic capacity, fertilizer use efficiency (e.g., nitrogen use efficiency), early flowering, grain filling period, harvest index, plant height, and/or abiotic stress tolerance of the plant.

According to an aspect of some embodiments of the invention, there is provided a method of increasing at least one trait selected from the group consisting of oil content, yield, growth rate, biomass, vigor, fiber yield, fiber quality, fiber length, photosynthetic capacity, fertilizer use efficiency (e.g., nitrogen use efficiency), early flowering, grain filling period, harvest index, plant height, and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NO: 15824-25609, thereby increasing the at least one trait selected from oil content, yield, growth rate, biomass, vigor, fiber yield, fiber quality, fiber length, photosynthetic capacity, fertilizer use efficiency (e.g., nitrogen use efficiency), early flowering, grain filling period, harvest index, plant height, and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, pod or spike weight, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area or by increase harvest index (seed yield per the total biomass).

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, leaf size or area, leaf thickness, roots and seeds.

It should be noted that an increase in plant's dry weight, rosette area, leaf blade area, leaf petiole length, leaf thickness, shoot dry weight, shoot fresh weight, vegetative dry weight, and/or total dry matter per plant indicates an increased biomass as compared to a matching control plant under the same growth conditions.

As used herein the term "root biomass" refers to the total weight of the plant's root(s). Root biomass can be determined directly by weighing the total root material (fresh and/or dry weight) of a plant.

Additional or alternatively, the root biomass can be indirectly determined by measuring root coverage, root density and/or root length of a plant.

It should be noted that plants having a larger root coverage exhibit higher fertilizer (e.g., nitrogen) use efficiency and/or higher water use efficiency as compared to plants with a smaller root coverage.

As used herein the phrase "root coverage" refers to the total area or volume of soil or of any plant-growing medium encompassed by the roots of a plant.

According to some embodiments of the invention, the root coverage is the minimal convex volume encompassed by the roots of the plant.

It should be noted that since each plant has a characteristic root system, e.g., some plants exhibit a shallow root system (e.g., only a few centimeters below ground level), while others have a deep in soil root system (e.g., a few tens of centimeters or a few meters deep in soil below ground level), measuring the root coverage of a plant can be performed in any depth of the soil or of the plant-growing medium, and comparison of root coverage between plants of the same species (e.g., a transgenic plant exogenously expressing the polynucleotide of some embodiments of the invention and a control plant) should be performed by measuring the root coverage in the same depth.

According to some embodiments of the invention, the root coverage is the minimal convex area encompassed by the roots of a plant in a specific depth.

Figure 10:
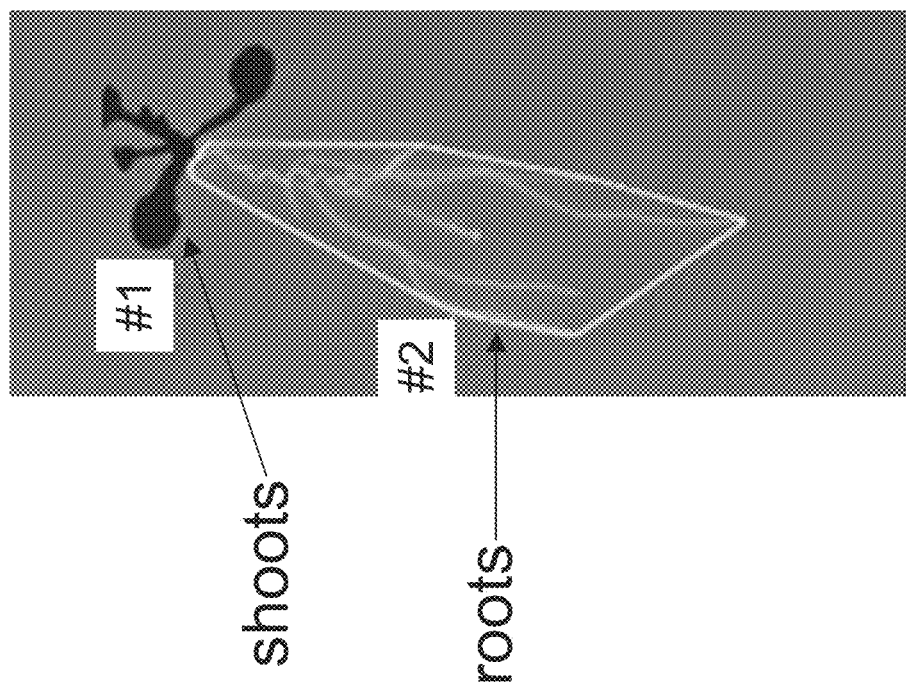
FIG. 10 depicts seedling analysis of an *Arabidopsis* plant having shoots (upper part, marked "#1") and roots (lower part, marked "#2"). Using an image analysis system the minimal convex area encompassed by the roots is determined. Such area corresponds to the root coverage of the plant.

A non-limiting example of measuring root coverage is shown in FIG. 10.

As used herein the term "root density" refers to the density of roots in a given area (e.g., area of soil or any plant growing medium). The root density can be determined by counting the root number per a predetermined area at a predetermined depth (in units of root number per area, e.g., $mm^2$, $cm^2$ or $m^2$).

As used herein the phrase "root length" refers to the total length of the longest root of a single plant.

As used herein the phrase "root length growth rate" refers to the change in total root length per plant per time unit (e.g., per day).

As used herein the phrase "growth rate" refers to the increase in plant organ/tissue size per time (can be measured in $cm^2$ per day or cm/day).

As used herein the phrase "photosynthetic capacity" (also known as "$A_{max}$") is a measure of the maximum rate at which leaves are able to fix carbon during photosynthesis. It is typically measured as the amount of carbon dioxide that is fixed per square meter per second, for example as mol $m^{-2}$ $sec^{-1}$. Plants are able to increase their photosynthetic capacity by several modes of action, such as by increasing the total leaves area (e.g., by increase of leaves area, increase in the number of leaves, and increase in plant's vigor, e.g., the ability of the plant to grow new leaves along time course) as well as by increasing the ability of the plant to efficiently execute carbon fixation in the leaves. Hence, the increase in total leaves area can be used as a reliable measurement parameter for photosynthetic capacity increment.

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

As used herein the phrase "Harvest index" refers to the efficiency of the plant to allocate assimilates and convert the vegetative biomass in to reproductive biomass such as fruit and seed yield.

Harvest index is influenced by yield component, plant biomass and indirectly by all tissues participant in remobilization of nutrients and carbohydrates in the plants such as stem width, rachis width and plant height. Improving harvest index will improve the plant reproductive efficiency (yield per biomass production) hence will improve yield per growing area. The Harvest Index can be calculated using Formulas 15, 16, 17, 18, and 65 as described below.

It should be noted that an increase in 1000 grain weight, plant height, inflorescence node number, grain number, spikelet's dry matter per plant, total grain yield per plant and/or rachis diameter in a transformed plant expressing an exogenous polynucleotide encoding the polypeptide of some embodiments of the invention indicates the ability of the polypeptide to increase the harvest index of the transformed plant as compared to a control, non-transformed plant, under the same growth conditions.

As used herein the phrase "Grain filling period" refers to the time in which the grain or seed accumulates the nutrients and carbohydrates until seed maturation (when the plant and grains/seeds are dried).

Grain filling period is measured as number of days from flowering/heading until seed maturation. Longer period of "grain filling period" can support remobilization of nutrients and carbohydrates that will increase yield components such as grain/seed number, 1000 grain/seed weight and grain/seed yield. It should be noted that an increase in rosette area, leaf blade area, seed yield, and/or rachis diameter in a transformed plant expressing an exogenous polynucleotide encoding the polypeptide of some embodiments of the invention indicates the ability of the polypeptide to increase the grain filling period in the transformed plant as compared to a control, non-transformed plant, under the same growth conditions.

As used herein the phrase "heading" or "time to heading" which is interchangeably used herein, refers to the time from germination to the time when the first head immerges.

It should be noted that a shorter time to heading (i.e., a negative increment in the measured time to heading) in a plant enables the plant a longer time period for grain filling.

Thus, a shorter time to heading in a transformed plant expressing an exogenous polynucleotide encoding the polypeptide of some embodiments of the invention indicates the ability of the polypeptide to increase the grain filling period in the transformed plant as compared to a control, non-transformed plant, under the same growth conditions.

As used herein the phrase "flowering" or "time to flowering" which is interchangeably used herein, refers to the time from germination to the time when the first flower is open.

As used herein the phrase "increasing early flowering" refers to increasing the ability of the plant to exhibit an early flowering as compared to a matching control plant (e.g., a non-transformed, or a native plant of the same species under the same growth conditions). Additionally or alternatively, increasing early flowering of a population of plants indicates increasing the number or percentage of plants having an early flowering.

It should be noted that increasing the ability of the plant to exhibit an early flowering of a plant (i.e., a shorter time period between germination to the time in which the first flower opens) is advantageous since it enables the plant to produce more flowers, fruits, pods and seeds without changing plant maturity period, which eventually leads to increased biomass and yield of the plant.

It should be noted that increasing the ability of the plant to exhibit an early flowering along with a longer grain filling period is advantageous to the plant since it supports a higher yield of the plant.

It should be noted that an increase in dry weight, rosette area, leaf blade area, and/or leaf petiole length in a transformed plant expressing an exogenous polynucleotide encoding the polypeptide of some embodiments of the invention indicates the ability of the polypeptide to increase early flowering of the transformed plant as compared to a control, non-transformed plant, under the same growth conditions.

As used herein the phrase "plant height" refers to measuring plant height as indication for plant growth status, assimilates allocation and yield potential. In addition, plant height is an important trait to prevent lodging (collapse of plants with high biomass and height) under high density agronomical practice.

Plant height is measured in various ways depending on the plant species but it is usually measured as the length between the ground level and the top of the plant, e.g., the head or the reproductive tissue.

It should be noted that a plant trait such as those described herein [e.g., yield, growth rate, biomass, vigor, oil content, fiber yield, fiber quality, fiber length, harvest index, grain filling period, flowering, heading, plant height, photosynthetic capacity, fertilizer use efficiency (e.g., nitrogen use efficiency), early flowering, grain filling period, harvest index, plant height] can be determined under stress (e.g., abiotic stress, nitrogen-limiting conditions) and/or non-stress (normal) conditions.

As used herein, the phrase "non-stress conditions" or "normal conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

Following is a non-limiting description of non-stress (normal) growth conditions which can be used for growing the transgenic plants expressing the polynucleotides or polypeptides of some embodiments of the invention.

For example, normal conditions for growing sorghum include irrigation with about 452,000 liter water per dunam (1000 square meters) and fertilization with about 14 units nitrogen per dunam per growing season.

Normal conditions for growing cotton include irrigation with about 580,000 liter water per dunam (1000 square meters) and fertilization with about 24 units nitrogen per dunam per growing season.

Normal conditions for growing bean include irrigation with about 524,000 liter water per dunam (1000 square meters) and fertilization with about 16 units nitrogen per dunam per growing season.

Normal conditions for growing B. Juncea include irrigation with about 861,000 liter water per dunam (1000 square meters) and fertilization with about 12 units nitrogen per dunam per growing season.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, osmotic stress, water deprivation, drought, flooding, freezing, low or high temperature, heavy metal toxicity, anaerobiosis, nutrient deficiency (e.g., nitrogen deficiency or limited nitrogen), atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The Arabidopsis rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In Mesembryanthemum crystallinum (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein, the phrase "drought conditions" refers to growth conditions with limited water availability. It should be noted that in assays used for determining the tolerance of a plant to drought stress the only stress induced is limited water availability, while all other growth conditions such as fertilization, temperature and light are the same as under normal conditions.

For example drought conditions for growing Brachypodium include irrigation with 240 milliliter at about 20% of tray filled capacity in order to induce drought stress, while under normal growth conditions trays irrigated with 900 milliliter whenever the tray weight reached 50% of its filled capacity.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of Sorghum vulgare used in the manufacture of brushes and brooms).

Example of fiber producing plants, include, but are not limited to, agricultural crops such as cotton, silk cotton tree (Kapok, Ceiba pentandra), desert willow, creosote bush, winterfat, balsa, kenaf, roselle, jute, sisal abaca, flax, corn, sugar cane, hemp, ramie, kapok, coir, bamboo, spanish moss and Agave spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As mentioned hereinabove, transgenic plants of the present invention can be used for improving myriad of commercially desired traits which are all interrelated as is discussed hereinbelow.

As used herein the term "trait" refers to a characteristic or quality of a plant which may overall (either directly or indirectly) improve the commercial value of the plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in the trait [e.g., yield, seed yield, biomass, growth rate, vigor, oil content, fiber yield, fiber quality, fiber length, photosynthetic capacity, early flowering, grain filling period, harvest index, plant height, abiotic stress tolerance, and/or nitrogen use efficiency] of a plant as compared to a control plant (e.g., a native plant, a wild type plant), i.e., a plant not modified with the biomolecules (polynucleotide or polypeptides) of the invention, e.g., a non-transformed plant or a plant not-being subject to genome editing of the same species which is grown under the same (e.g., identical) growth conditions].

The phrase "over-expressing a polypeptide" as used herein refers to increasing the level of the polypeptide within the plant as compared to a control plant of the same species under the same growth conditions.

Methods of over-expressing a polypeptide in a plant are known in the art and include expressing within the plant an exogenous polynucleotide encoding the polypeptide (e.g., by recombinant means) and/or genome editing and/or mutagenesis for identifying of mutations resulting in upregulation of the polypeptide as further described herein below.

As used herein the phrase "expressing an exogenous polynucleotide encoding a polypeptide" refers to expression at the mRNA level.

As used herein, the phrase "exogenous polynucleotide" refers to a heterologous nucleic acid sequence which is not naturally expressed within the plant (e.g., a nucleic acid sequence from a different species) or to an endogenous nucleic acid of which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NO: 15824-25609.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y (Sequence—Evolution—Function: Computational Approaches in Comparative Genomics. Boston: Kluwer Academic; 2003. Chapter 2, Evolutionary Concept in Genetics and Genomics. Available from: ncbi (dot) nlm (dot) nih (dot) gov/books/NBK20255) and therefore have great likelihood of having the same function.

One option to identify orthologues in monocot plant species is by performing a reciprocal blast search. This may be done by a first blast involving blasting the sequence-of-interest against any sequence database, such as the publicly available NCBI database which may be found at: ncbi (dot) nlm (dot) nih (dot) gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [ebi (dot) ac (dot) uk/Tools/clustalw2/index (dot) html], followed by a neighbor-joining tree (wikipedia (dot) org/wiki/Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9].

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., a homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration (dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss (dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter):
EMBOSS-6.0.1 Needleman-Wunsch algorithm with the following modified parameters: gapopen=8 gapextend=2. The rest of the parameters are unchanged from the default options listed here:

Standard (Mandatory) Qualifiers:

| | | |
|---|---|---|
| [-asequence] | sequence | Sequence filename and optional format, or reference (input USA) |
| [-bsequence] | seqall | Sequence(s) filename and optional format, or reference (input USA) |
| -gapopen | float | [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0) |
| -gapextend | float | [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0) |
| [-outfile] | align | [*.needle] Output alignment file name |

Additional (Optional) Qualifiers:

| | | |
|---|---|---|
| -datafile | matrixf | [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation. |

Advanced (Unprompted) Qualifiers:

| | | |
|---|---|---|
| -[no]brief | boolean | [Y] Brief identity and similarity |

Associated Qualifiers:

| "-asequence" associated qualifiers | | |
|---|---|---|
| -sbegin1 | integer | Start of the sequence to be used |
| -send1 | integer | End of the sequence to be used |
| -sreverse1 | boolean | Reverse (if DNA) |
| -sask1 | boolean | Ask for begin/end/reverse |
| -snucleotide1 | boolean | Sequence is nucleotide |
| -sprotein1 | boolean | Sequence is protein |
| -slower1 | boolean | Make lower case |
| -supper1 | boolean | Make upper case |
| -sformat1 | string | Input sequence format |
| -sdbname1 | string | Database name |
| -sid1 | string | Entryname |
| -ufo1 | string | UFO features |
| -fformat1 | string | Features format |
| -fopenfile1 | string | Features file name |
| "-bsequence" associated qualifiers | | |
| -sbegin2 | integer | Start of each sequence to be used |
| -send2 | integer | End of each sequence to be used |
| -sreverse2 | boolean | Reverse (if DNA) |
| -sask2 | boolean | Ask for begin/end/reverse |
| -snucleotide2 | boolean | Sequence is nucleotide |
| -sprotein2 | boolean | Sequence is protein |
| -slower2 | boolean | Make lower case |
| -supper2 | boolean | Make upper case |
| -sformat2 | string | Input sequence format |
| -sdbname2 | string | Database name |
| -sid2 | string | Entryname |
| -ufo2 | string | UFO features |
| -fformat2 | string | Features format |
| -fopenfile2 | string | Features file name |
| "-outfile" associated qualifiers | | |
| -aformat3 | string | Alignment format |
| -aextension3 | string | File name extension |
| -adirectory3 | string | Output directory |
| -aname3 | string | Base file name |
| -awidth3 | integer | Alignment width |
| -aaccshow3 | boolean | Show accession number in the header |
| -adesshow3 | boolean | Show description in the header |
| -ausashow3 | boolean | Show the full USA in the alignment |
| -aglobal3 | boolean | Show the full sequence in alignment |

General Qualifiers:

| | | |
|---|---|---|
| -auto | boolean | Turn off prompts |
| -stdout | boolean | Write first file to standard output |
| -filter | boolean | Read first file from standard input, write first file to standard output |
| -options | boolean | Prompt for standard and additional values |
| -debug | boolean | Write debug output to program.dbg |
| -verbose | boolean | Report some/full command line options |
| -help | boolean | Report command line options. More information on associated and general qualifiers can be found with-help-verbose |
| -warning | boolean | Report warnings |
| -error | boolean | Report errors |
| -fatal | boolean | Report fatal errors |
| -die | boolean | Report dying program messages |

2. Between a Protein Sequence and a Nucleotide Sequence (Following the Tblastn Filter):

GenCore 6.0 OneModel application utilizing the Frame+ algorithm with the following parameters: model=frame+_p2n.model mode=qglobal -q=protein.sequence-db=nucleotide.sequence. The rest of the parameters are unchanged from the default options:

Usage:

om -model=<model_fname> [-q=]query [-db=]database [options]

-model=<model_fname> Specifies the model that you want to run. All models supplied by Compugen are located in the directory $CGNROOT/models/.

Valid command line parameters:

-dev=<dev_name> Selects the device to be used by the application.

Valid devices are:

bic—Bioccelerator (valid for SW, XSW, FRAME_N2P, and FRAME_P2N models).

xlg—BioXL/G (valid for all models except XSW).

xlp—BioXL/P (valid for SW, FRAME+_N2P, and FRAME_P2N models).

xlh—BioXL/H (valid for SW, FRAME+_N2P, and FRAME_P2N models).

soft—Software device (for all models).

-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.

-db=<database name> Chooses the database set. The database set can be a sequence file or a database reference. The database format is detected automatically. However, you may specify a format using -dfmt parameter.

-qacc Add this parameter to the command line if you specify query using accession numbers.
-dacc Add this parameter to the command line if you specify a database using accession numbers.
-dfmt/-qfmt=<format_type> Chooses the database/query format type. Possible formats are:
    fasta—fasta with seq type auto-detected.
    fastap—fasta protein seq.
    fastan—fasta nucleic seq.
    gcg—gcg format, type is auto-detected.
    gcg9seq—gcg9 format, type is auto-detected.
    gcg9seqp—gcg9 format protein seq.
    gcg9seqn—gcg9 format nucleic seq.
    nbrf—nbrf seq, type is auto-detected.
    nbrfp—nbrf protein seq.
    nbrfn—nbrf nucleic seq.
    embl—embl and swissprot format.
    genbank—genbank format (nucleic).
    blast—blast format.
    nbrf gcg—nbrf-gcg seq, type is auto-detected.
    nbrf gcgp—nbrf-gcg protein seq.
    nbrf gcgn—nbrf-gcg nucleic seq.
    raw—raw ascii sequence, type is auto-detected.
    rawp—raw ascii protein sequence.
    rawn—raw ascii nucleic sequence.
    pir—pir codata format, type is auto-detected.
    profile—gcg profile (valid only for -qfmt
    in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
    Valid for SW and XSW.
-dtrans Performs a translated search, relevant for a protein query against a DNA database. Each database entry is translated to six reading frames and a result is given for each frame.
    Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
    zscore.
    escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS. Possible values are:
    PFS—PFS text format
    FASTA—FASTA text format
    BLAST—BLAST text format
-nonorm Do not perform score normalization.
-norm=<norm_name> Specifies the normalization method. Valid options are:
    log—logarithm normalization.
    std—standard normalization.
    stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.
-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note: "-batch" and "-wait" parameters are mutually exclusive.
-version Prints the software version number.
-help Displays this help message. To get more specific help type:
    "om -model=<model_fname>-help".

According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:15824-23573.

According to some embodiments of the invention, the exogenous polynucleotide of the invention encodes a polypeptide having the amino acid sequence selected from the group consisting of SEQ ID NOs: 15824-25609.

According to some embodiments of the invention, the method of increasing at least one trait selected from the group consisting of yield, biomass, growth rate, vigor, oil content, fiber yield, fiber quality, fiber length, photosynthetic capacity, early flowering, grain filling period, harvest index, plant height, abiotic stress tolerance, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 15824-23573, thereby increasing the at least one trait selected from yield, biomass, growth rate, vigor, oil content, fiber yield, fiber quality, fiber length, photosynthetic capacity, early flowering, grain filling period, harvest index, plant height, abiotic stress tolerance, and/or nitrogen use efficiency of the plant.

According to some embodiments of the invention, the exogenous polynucleotide encodes a polypeptide consisting of the amino acid sequence set forth in any one of SEQ ID NOs:23574-25609.

According to an aspect of some embodiments of the invention, the method of increasing at least one trait selected from the group consisting of yield, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs:23574-25609, thereby increasing the at least one trait selected from yield, biomass, growth rate, vigor, oil content, fiber yield, fiber quality, fiber length, photosynthetic capacity, early flowering, grain filling period, harvest index, plant height, abiotic stress tolerance, and/or nitrogen use efficiency of the plant.

According to an aspect of some embodiments of the invention, there is provided a method of increasing at least one trait selected from the group consisting of yield, biomass, growth rate, vigor, oil content, fiber yield, fiber quality, fiber length, photosynthetic capacity, early flowering, grain filling period, harvest index, plant height, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs:23574-25609, thereby increasing the at least one trait selected from yield, biomass, growth rate, vigor, oil content, fiber yield, fiber quality, fiber length, photosynthetic capacity, early flowering, grain filling period, harvest index, plant height, abiotic stress tolerance, and/or nitrogen use efficiency of the plant.

According to some embodiments of the invention, the exogenous polynucleotide encodes a polypeptide consisting of the amino acid sequence set forth in any one of SEQ ID NOs:23574-25609.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NO:40-11140.

According to an aspect of some embodiments of the invention, there is provided a method of increasing at least one trait selected from the group consisting of yield, biomass, growth rate, vigor, oil content, fiber yield, fiber quality, fiber length, photosynthetic capacity, early flowering, grain filling period, harvest index, plant height, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:40-11140, thereby increasing the at least one trait selected from yield, biomass, growth rate, vigor, oil content, fiber yield, fiber quality, fiber length, photosynthetic capacity, early flowering, grain filling period, harvest index, plant height, abiotic stress tolerance, and/or nitrogen use efficiency of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:40-11140.

According to some embodiments of the invention the exogenous polynucleotide is set forth in any one of SEQ ID NOs:40-15346.

According to an aspect of some embodiments of the invention, there is provided a method of increasing fiber yield and/or fiber quality of a plant, comprising:

(a) expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:12054, 12092, 12162, 12259, 12264, 12310-12311, 12449, 12482-12484, 12507, 12530-12531, 12544-12547, 12561, 12648, 12664, 12670, 12698, and 12701, and;

(b) selecting transformed plant resulting from step (a) which expresses the exogenous polynucleotide for plants exhibiting increased fiber yield and/or fiber quality as compared to non-transformed plant under the same growth conditions, thereby increasing the fiber yield and/or fiber quality of the plant.

According to an aspect of some embodiments of the invention, there is provided a method of increasing at least one trait selected from the group consisting of grain filling period, harvest index, plant height, early flowering and any combination thereof of a plant, comprising:

(a) expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:15348, 15350-15358, 15362-15365 and 15368-15371, and;

(b) selecting transformed plant resulting from step (a) which expresses the exogenous polynucleotide for plants exhibiting at least one of increased grain filling period, harvest index, plant height and early flowering as compared to non-transformed plant under the same growth conditions, thereby increasing the at least one of filling period; harvest index; plant height, early flowering and early flowering of the plant.

According to an aspect of some embodiments of the invention, there is provided a method of increasing at least one trait selected from the group consisting of oil content, fiber quality, photosynthetic capacity, early flowering, grain filling period, harvest index, plant height and any combination thereof of a plant, comprising:

(a) expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:15800-15801, 15803-15806, 15810-15812, 15814, 15820, 15822 and 15823, and;

(b) selecting transformed plant resulting from step (a) which expresses the exogenous polynucleotide for plants exhibiting at least one of increased oil content, fiber quality, photosynthetic capacity, early flowering, grain filling period, harvest index and plant height as compared to non-transformed plant under the same growth conditions, thereby increasing the at least one of oil content, fiber quality, photosynthetic capacity, early flowering, grain filling period, harvest index and plant height of the plant.

According to an aspect of some embodiments of the invention, there is provided a method of increasing at least one trait selected from the group consisting of photosynthetic capacity, early flowering, grain filling period, harvest index, plant height and any combination thereof of a plant, comprising:

(a) expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:15366, 15367, 15374, 15376, 15382-15384, 15386-15395, 15397-15404, 15406, 15408-15415, 15419-15422, 1542, 15428, 15438-15445, 15447, 15448, 15450-15461, 15463, 15468-15480, 15482, 15484-15490, 15493, 15494, 15497, 15498-15502, 15505, 15507-15511, 15513-15515, 15522, 15523, 15525, 15528, 15529, 15531, 15532, 15534-15538, 15541, 15542, 15544-15548, 15550, 15551, 15557, 15559, 15560, 15562-15564, 15570, 15576-15578, 15582-15584, 15599, 15600, 15603, 15606-15610, 15612, 15614, 15615, 15619-15626, 15628, 15632, 15635-15637, 15641-15649, 15651-15661, 15663, 15667, 15669-15671, 15673-15680, 15682-15702, 15704-15706, 15708, 15710, 15711, 15712, 15715, 15716, 15718, 15721, 15723, 15725, 15729-15731, 15733, 15734, 15736-15747, 15750, 15751, 15753-15755, 15757, 15759, 15760, 15768, 15770, 15772, 15773, 15774, 15781-15785, 15788 and 15795-15799 and;

(b) selecting transformed plant resulting from step (a) which expresses the exogenous polynucleotide for plants exhibiting at least one of increased photosynthetic capacity, early flowering, grain filling period, harvest index and plant height as compared to non-transformed plant under the same growth conditions, thereby increasing the at least one of photosynthetic capacity, early flowering, grain filling period, harvest index and plant height of the plant.

According to an aspect of some embodiments of the invention, there is provided a method of increasing at least one trait selected from the group consisting of fiber quality, photosynthetic capacity, early flowering, grain filling period, harvest index, plant height and any combination thereof of a plant, comprising:

(a) expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide set forth in SEQ ID NO: 15347 and;

(b) selecting transformed plant resulting from step (a) which expresses the exogenous polynucleotide for plants exhibiting at least one of fiber quality, photosynthetic capacity, early flowering, grain filling period, harvest index, and plant height compared to non-transformed plant under the same growth conditions, thereby increasing the at least one of fiber quality, photosynthetic capacity, early flowering, grain filling period, harvest index, and plant height of the plant.

According to some embodiments of the invention the method of increasing at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant further comprising selecting a plant having at least trait selected from an increased yield, growth rate, biomass, vigor, oil content, seed yield, fiber yield, fiber quality, fiber length, photosynthetic capacity, early flowering, grain filling period, harvest index, plant height, nitrogen use efficiency, and/or abiotic stress tolerance as compared to a control wild type plant of the same species which is grown under the same growth conditions.

It should be noted that selecting a transformed plant having an increased trait as compared to a control wild type (or non-transformed) plant grown under the same growth conditions can be performed by selecting for the trait, e.g., validating the ability of the transformed plant to exhibit the increased trait using well known assays (e.g., seedling analyses, greenhouse assays, field experiments) as is further described herein below.

According to some embodiments of the invention selecting is performed under non-stress conditions.

According to some embodiments of the invention selecting is performed under abiotic stress conditions.

According to some embodiments of the invention selecting is performed under nitrogen limiting (e.g., nitrogen deficient) conditions.

According to an aspect of some embodiments of the invention, there is provided a method of selecting a transformed plant having at least one trait selected from the group consisting of increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (e.g., having sequence similarity or sequence identity) to the amino acid sequence selected from the group consisting of SEQ ID NOs:15824-23573;

(b) selecting from the plants of step (a) a plant having at least one trait selected from increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance (e.g., by selecting the plants for the increased trait), thereby selecting the plant having at least one trait selected from increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to a control wild type plant of the same species which is grown under the same growth conditions.

According to an aspect of some embodiments of the invention, there is provided a method of selecting a transformed plant having at least one trait selected from the group consisting of increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to a wild type plant of the same species which is grown under the same growth conditions, the method comprising:

(a) providing plants transformed with an exogenous polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:40-11140, (b) selecting from the plants of step (a) a plant having at least one trait selected from increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance, thereby selecting the plant having at least one trait selected from increased yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance as compared to a control wild type plant of the same species which is grown under the same growth conditions.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

It should be noted that the nucleic acid sequence of a polynucleotide encoding a polypeptide which is provided in the sequence listing as a single strand refers to the sense direction which is equivalent to the mRNA transcribed from the polynucleotide.

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to an aspect of some embodiments of the invention, there is provided a method of increasing oil content and/or nitrogen use efficiency of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 19822, 19823, 19824, 19831, 19832, 19837, 19838, 19839, 19845, 19855, 24637, 24639, 24640, 24642, 24660, 24674, 24675 and 24682, and (b) selecting transformed plant resulting from step (a) which expresses the exogenous polynucleotide for plants exhibiting increased oil content and/or nitrogen use efficiency as compared to non-transformed plant under the same growth conditions, thereby increasing the oil content and/or nitrogen use efficiency of the plant.

According to an aspect of some embodiments of the invention, there is provided a method of increasing fiber yield and/or fiber quality of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 16239, 22970, 22975, 22978, 22988, 22991, 22996, 23015, 23052, 23064, 23068, 23071, 23072, 23074, 23081, 23086, 23087, 23089, 23090, 23094, 23105, 23109, 23115, 23117, 23128, 23136, 23137, 23145, 23151, 23159, 23163, 23167, 23168, 23181, 23182, 23184, 23187, 23188, 23202, 23209, 23210, 23219, 23224, 23250, 23268, 23292, 23302, 23303, 23313, 23314, 23317, 23320, 23322, 23326, 23334, 23336, 23337, 23352, 23353, 23361, 23366, 23367, 23368, 23371, 23375, 23380, 23381, 23382, 23384, 23386, 23387, 23389, 23390, 23396, 23402, 23403, 23404, 23405, 23413-23419, 23421, 23423, 23427, 23429, 23430, 23432, 23437, 23438, 23439, 23448, 23449, 23462, 23472, 23473, 23474, 23482, 23483, 23484, 23491, 23498, 23500, 23515, 23521, 23522, 23526, 23529, 23534, 23535, 23536, 23547, 23549, and 23550, and (b) selecting transformed plant resulting from step (a) which expresses the exogenous polynucleotide for plants exhibiting increased fiber yield and/or fiber quality as compared to non-transformed plant under the same growth conditions, thereby increasing the fiber yield and/or fiber quality of the plant.

According to an aspect of some embodiments of the invention, there is provided a method of increasing oil content of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence set forth by SEQ ID NO: 22610, and (b) selecting transformed plant resulting from step (a) which expresses the exogenous polynucleotide for plants exhibiting increased oil content as compared to non-transformed plant under the same growth conditions, thereby increasing the oil content of the plant.

According to an aspect of some embodiments of the invention, there is provided a method of increasing at least one trait selected from the group consisting of abiotic stress tolerance, nitrogen use efficiency, fiber yield and/or fiber length of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence set forth by SEQ ID NO: 16250, and (b) selecting transformed plant resulting from step (a) which expresses the exogenous polynucleotide for plants exhibiting at least one trait selected from increased abiotic stress tolerance, nitrogen use efficiency, fiber yield and/or fiber length as compared to non-transformed plant under the same growth conditions, thereby increasing at least one trait selected from increased abiotic stress tolerance, nitrogen use efficiency fiber yield and/or fiber length of the plant.

According to an aspect of some embodiments of the invention, there is provided a method of increasing at least one trait selected from the group consisting of grain filling period, harvest index, plant height, early flowering and any combination thereof of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs:23758, 23952, 24367, 24379, 24384, 24721, 24729, 24755, 24888, 24898, 25099, 25132, 25352, 25513, 25598, 25628, 25637, 25915, 25939, 26053, 26224, and (b) selecting transformed plant resulting from step (a) which expresses the exogenous polynucleotide for plants exhibiting at least one of increased grain filling period, harvest index, plant height and early flowering as compared to non-transformed plant under the same growth conditions, thereby increasing the at least one trait of the plant.

According to an aspect of some embodiments of the invention, there is provided a method of increasing at least one trait selected from the group consisting of fiber quality, photosynthetic capacity and any combination thereof of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence set forth in SEQ ID NO:25352, and (b) selecting transformed plant resulting from step (a) which expresses the exogenous polynucleotide for plants exhibiting at least one of increased grain fiber quality and photosynthetic capacity as compared to non-transformed plant under the same growth conditions, thereby increasing the at least one trait of the plant.

According to an aspect of some embodiments of the invention, there is provided a method of increasing at least one trait selected from the group consisting of oil content, fiber quality, photosynthetic capacity, early flowering, grain filling period, harvest index, plant height and any combination thereof of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs:23580, 23690, 23694, 23696, 23710, 23718, 23745, 23760, 23793, 23800, 23811, 23817, 23821, 23838, 23844, 23852, 23876, 23886, 23923, 23927, 24297-24299, 24311, 24314, 24335, 24378, 24409, 24445, 24463, 24490, 24519, 24544, 24573, 24596, 24633, 24644, 24677, 24684, 24697, 24713, 24739, 24742, 24743, 24745, 24758, 24802, 24807, 24826, 24827, 24843, 24872, 24877, 24884, 24886, 24891, 24902, 24905, 24915, 25004, 25005, 25008, 25034, 25096, 25102, 25133, 25137, 25155, 25246, 25283, 25309, 25342, 25557, 25561, 25579, 25584, 25605, 25608, 25615, 25640, 25644, 25647, 25647, 25673, 25676, 25726, 25765, 25784, 25785, 25810, 25826, 25831, 25832, 25875, 25876, 25878, 25888, 25893, 25910, 25935, 25935, 25946, 25954, 25956, 26042, 26063, 26148, 26185, 26191, 2622, and (b) selecting transformed plant resulting from step (a) which expresses the exogenous polynucleotide for plants exhibiting at least one of increased oil content, fiber quality, photosynthetic capacity, early flowering, grain filling period, harvest index and plant height as compared to non-transformed plant under the same growth conditions, thereby increasing the at least one trait of the plant.

According to an aspect of some embodiments of the invention, there is provided a method of increasing at least one trait selected from the group consisting of nitrogen and/or fertilizer use efficiency of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence set forth in SEQ ID NO:23800, and (b) selecting transformed plant resulting from step (a) which expresses the exogenous polynucleotide for plants exhibiting at least one of increased nitrogen and/or fertilizer use efficiency as compared to non-transformed plant under the same growth conditions, thereby increasing the nitrogen and/or fertilizer use efficiency of the plant.

According to an aspect of some embodiments of the invention, there is provided a method of increasing at least one trait selected from the group consisting of oil content, photosynthetic capacity, nitrogen and/or fertilizer use efficiency, early flowering, grain filling period, harvest index, plant height and any combination thereof of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88, at least about 89, at least about 90, at least about 91, at least about 92 at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs:23706, 23707, 23707, 23731, 23877, 24728, 25020, 25174, 25362, 25568, 25658, 25738, 25916, 25971, 26170, and (b) selecting transformed plant resulting from step (a) which expresses the exogenous polynucleotide for plants exhibiting at least one of increased oil content, photosynthetic capacity, nitrogen and/or fertilizer use efficiency, early flowering, grain filling period, harvest index and plant height as compared to non-transformed plant under the same growth conditions, thereby increasing the at least one trait of the plant.

According to an aspect of some embodiments of the invention, there is provided a method of increasing at least one trait selected from the group consisting of photosynthetic capacity, early flowering, grain filling period, harvest index, plant height and any combination thereof of a plant, comprising:

(a) expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 23581, 23584, 23591, 23596, 23612, 23613, 23620, 23641, 23652, 23653, 23659, 23682, 23703, 23704, 23708, 23709, 23712, 23713, 23714, 23715, 23717, 23725, 23741, 23743, 23750, 23753, 23754, 23772, 23777, 23782, 23786, 23787, 23789, 23806, 23809, 23818, 23825, 23828, 23829, 23832, 23850, 23853, 23854, 23856, 23860, 23868, 23872, 23874, 23884, 23903, 23909, 23924, 23926, 23949, 23959, 23963, 23967, 24194, 24197, 24201, 24207, 24217, 24225, 24232, 24239, 24249, 24261, 24286, 24309, 24315, 24316, 24318, 24320, 24321, 24323, 24325, 24337, 24339, 24341, 24343, 24348, 24355, 24356, 24359, 24364, 24382, 24391, 24393, 24419, 24428, 24442, 24454, 24458, 24462, 24464, 24466, 24470, 24484, 24485, 24486, 24502, 24517, 24523, 24534, 24550, 24558, 24563, 24566, 24568, 24572, 24593, 24603, 24609, 24611, 24617, 24623, 24632, 24635, 24638-24640, 24642, 24652, 24655, 24657, 24661, 24663, 24665, 24666, 24681, 24686, 24689, 24692, 24698, 24703, 24704, 24709, 24718, 24720, 24722, 24726, 24727, 24730, 24733, 24735, 24741, 24748, 24751, 24774, 24778, 24789, 24792, 24798, 24800, 24805, 24821, 24824, 24836, 24847, 24851, 24853, 24869, 24874, 24883, 24892, 24899, 24900, 24910-24913, 24918, 24931, 24934, 24936, 24945, 24951, 24966, 24970, 24989, 24990, 24995, 24997, 25010, 25025, 25035, 25043, 25050, 25053, 25062, 25075, 25076, 25086, 25087, 25091, 25094, 25098, 25103, 25106, 25108, 25112, 25114, 25115, 25120, 25122, 25124, 25139, 25152, 25153, 25154, 25156, 25159, 25160, 25163, 25168, 25171, 25176, 25180, 25183, 25193, 25210, 25211, 25213, 25227, 25233, 25238, 25248, 25252, 25253, 25259-25272, 25278, 25289, 25293, 25298, 25304, 25319, 25326, 25344, 25367, 25372, 25381, 25385, 25390, 25392, 25396, 25398, 25403, 25407, 25414, 25415, 25419, 25421, 25428, 25429, 25433, 25443, 25445, 25468, 25473, 25487, 25494, 25497, 25498, 25506, 25507, 25511, 25515, 25518, 25529, 25537, 25544, 25560, 25566, 25569, 25571, 25575, 25577, 25592, 25595, 25604, 25610, 25616, 25621, 25629, 25630, 25632, 25633, 25634, 25635, 25638, 25641, 25643, 25645, 25646, 25648-25651, 25659, 25666, 25668, 25669, 25672, 25674, 25682, 25687, 25690, 25692, 25697, 25706, 25708, 25710, 25719, 25729, 25730-25732, 25736, 25739-25741, 25752, 25758, 25759, 25761, 25763, 25764, 25767, 25771, 25777, 25780, 25787, 25788, 25804, 25806, 25813, 25815, 25816, 25819, 25821, 25823, 25830, 25833, 25836, 25840, 25843, 25844, 25852, 25856, 25860, 25870, 25872, 25874, 25894, 25896, 25905, 25907, 25909, 25918, 25921, 25922, 25930, 25933, 25938, 25941, 25942, 25955, 25957, 25964, 25975, 25978, 25985, 25988, 25993, 25995, 26011, 26012, 26022, 26027, 26034, 26037, 26041, 26048, 26052, 26058, 26066, 26071, 26072, 26074, 26077, 26080, 26085, 26100, 26105, 26107, 26109, 26113, 26115, 26118, 26121, 26127, 26128, 26135-26139, 26141, 26142, 26146, 26149, 26154, 26160, 26162, 26163, 26164, 26166-26180, 26183, 26194, 26197, 26200, 26211, 26214, 26217, 26231, 26232, 26234, 26235, 26237, and (b) selecting transformed plant resulting from step (a) which expresses the exogenous polynucleotide for plants exhibiting at least one of increased photosynthetic capacity, early flowering, grain filling period, harvest index and plant height as compared to non-transformed plant under the same growth conditions, thereby increasing the at least one trait of the plant.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [($X_n$−$Y_n$)/$Y_n$]2/N, where $X_n$ refers to the frequency of usage of codon n in highly expressed plant genes, where $Y_n$ to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (kazusa.or.jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in the nucleic acid sequence set forth in any one of SEQ ID NOs: 905, 1024, 1542, 1662, 1734, 1756, 1793, 1851, 2130, 2294-2295, 2335, 2572, 3507, 3739, 5270, 5700, 5935, 6428, 6438, 6659-6660, 8282, 8446, 8480, 8495, 8576, 8841, 8868, 8870, 8953, 9112, 9147, 9153, 9177, 9223, 9277-9278, 9339-9340, 9411-9413, 9500-9502, 9569, 9573, 9629, 9739, 9784, 9907, 9911, 10153-10155, 10335-10338, 10383, 10402, 10453-10454, 10457, 10484, 10509, 10539, 10556, 10558, 10565, 10608, and 13460.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to some embodiments of the invention, the exogenous polynucleotide encodes a polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NO: 15824-23573.

According to some embodiments of the invention, the polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs:15824-23573.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:40-11140.

According to some embodiments of the invention the nucleic acid sequence is capable of increasing at least one trait selected from the group consisting of nitrogen use efficiency, fertilizer use efficiency, yield (e.g., seed yield, oil yield), growth rate, vigor, biomass, oil content, fiber yield, fiber quality, fiber length, photosynthetic capacity, early flowering, grain filling period, harvest index, plant height, abiotic stress tolerance and/or water use efficiency of a plant.

According to some embodiments of the invention the isolated polynucleotide comprising the nucleic acid sequence selected from the group consisting of SEQ ID NOs: 11141-15346.

According to some embodiments of the invention the isolated polynucleotide is set forth in any one of SEQ ID NOs: 11141-15346.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 15824-23573.

According to some embodiments of the invention the amino acid sequence is capable of increasing at least one trait selected from the group consisting of nitrogen use efficiency, fertilizer use efficiency, yield, seed yield, growth rate, vigor, biomass, oil content, fiber yield, fiber quality, fiber length, photosynthetic capacity, early flowering, grain filling period, harvest index, plant height, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs:15824-25609.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 15824-23573.

According to some embodiments of the invention, the polypeptide comprising an amino acid sequence selected from the group consisting of SEQ ID NOs15824-25609.

According to some embodiments of the invention, the polypeptide is set forth in any one of SEQ ID NOs:15824-25609.

The invention also encompasses fragments of the above described polypeptides and polypeptides having mutations, such as deletions, insertions or substitutions of one or more amino acids, either naturally occurring or man induced, either randomly or in a targeted fashion.

The term "'plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, *lupinus*, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell expressing the exogenous polynucleotide of some embodiments of the invention, the nucleic acid construct comprising the exogenous polynucleotide of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell (e.g., the polynucleotide is derived from a different plant species when compared to the plant cell, thus the isolated polynucleotide and the plant cell are not from the same plant species).

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 1; Albani et al, Plant Cell, 9: 171-184, 1997, which is fully incorporated herein by reference), wheat LMW (SEQ ID NO: 2 (longer LMW promoter), and SEQ ID NO: 3 (LMW promoter) and HMW glutenin-1 (SEQ ID NO: 4 (Wheat HMW glutenin-1 longer promoter); and SEQ ID NO: 5 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 6 (wheat alpha gliadin, B genome, promoter); SEQ ID NO: 7 (wheat gamma gliadin promoter); EMBO 3:1409-15, 1984, which is fully incorporated herein by reference], wheat TdPR60 [SEQ ID NO:8 (wheat TdPR60 longer promoter) or SEQ ID NO:9 (wheat TdPR60 promoter); Kovalchuk et al., Plant Mol Biol 71:81-98, 2009, which is fully incorporated herein by reference], maize Ubl Promoter [cultivar Nongda 105 (SEQ ID NO:10); GenBank: DQ141598.1; Taylor et al., Plant Cell Rep 1993 12: 491-495, which is fully incorporated herein by reference; and cultivar B73 (SEQ ID NO:11); Christensen, A H, et al. Plant Mol. Biol. 18 (4), 675-689 (1992), which is fully incorporated herein by reference]; rice actin 1 (SEQ ID NO:12; Mc Elroy et al. 1990, The Plant Cell, Vol. 2, 163-171, which is fully incorporated herein by reference), rice GOS2 [SEQ ID NO: 13 (rice GOS2 longer promoter) and SEQ ID NO: 14 (rice GOS2 Promoter); De Pater et al. Plant J. 1992; 2: 837-44, which is fully incorporated herein by reference], arabidopsis Pho1 [SEQ ID NO: 15 (arabidopsis Pho1 Promoter); Hamburger et al., Plant Cell. 2002; 14: 889-902, which is fully incorporated herein by reference], ExpansinB promoters, e.g., rice ExpB5 [SEQ ID NO: 16 (rice ExpB5 longer promoter) and SEQ ID NO: 17 (rice ExpB5 promoter)] and Barley ExpB1 [SEQ ID NO: 18 (barley ExpB1 Promoter), Won et al. Mol Cells. 2010; 30:369-76, which is fully incorporated herein by reference], barley SS2 (sucrose synthase 2) [(SEQ ID NO: 19), Guerin and Carbonero, *Plant Physiology* May 1997 vol. 114 no. 1 55-62, which is fully incorporated herein by reference], and rice PG5a [SEQ ID NO:20, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 21 (CaMV 35S (pQXNc) Promoter); SEQ ID NO: 22 (PJJ 35S from *Brachypodium*); SEQ ID NO: 23 (CaMV 35S (OLD) Promoter) (Odell et al., Nature 313:810-812, 1985)], *Arabidopsis* At6669 promoter (SEQ ID NO: 24 (*Arabidopsis* At6669 (OLD) Promoter); see PCT Publication No. WO04081173A2 or the new At6669 promoter (SEQ ID NO: 25 (*Arabidopsis* At6669 (NEW) Promoter)); maize Ubl Promoter [cultivar Nongda 105 (SEQ ID NO: 10); GenBank: DQ141598.1; Taylor et al., Plant Cell Rep 1993 12: 491-495, which is fully incorporated herein by reference; and cultivar B73 (SEQ ID NO: 11); Christensen, A H, et al. Plant Mol. Biol. 18 (4), 675-689 (1992), which is fully incorporated herein by reference]; rice actin 1 (SEQ ID NO: 12, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 13 (rice GOS2 longer Promoter) and SEQ ID NO: 14 (rice GOS2 Promoter), de Pater et al, Plant J November; 2(6):837-44, 1992]; RBCS promoter (SEQ ID NO:26); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597; 5,466,785; 5,399,680; 5,268,463; and 5,608,142.

Suitable tissue-specific promoters include, but not limited to, leaf-specific promoters [e.g., AT5G06690 (Thioredoxin) (high expression, SEQ ID NO: 27), AT5G61520 (AtSTP3) (low expression, SEQ ID NO: 28) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 29 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 20; U.S. Pat. No. 7,700,835), early seed development *Arabidopsis* BAN (AT1G61720) (SEQ ID NO: 30, US 2009/0031450 A1), late seed development *Arabidopsis* ABI3 (AT3G24650) (SEQ ID NO: 31 (*Arabidopsis* ABI3 (AT3G24650) longer Promoter) or SEQ ID NO: 32 (*Arabidopsis* ABI3 (AT3G24650) Promoter)) (Ng et al., Plant Molecular Biology 54: 25-38, 2004), Brazil Nut albumin (Pearson's et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (SEQ ID NO:1; Albani et al, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 2 (Wheat LMW Longer Promoter), and SEQ ID NO: 3 (Wheat LMW Promoter) and HMW glutenin-1 [(SEQ ID NO: 4 (Wheat HMW glutenin-1 longer Promoter)); and SEQ ID NO: 5 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 6 (wheat alpha gliadin (B genome) promoter); SEQ ID NO: 7 (wheat gamma gliadin promoter); EMBO 3:1409-15, 1984), Barley Itr1 promoter, barley BI, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 19 (Barley SS2 Promoter); Guerin and Carbonero *Plant Physiology* 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis apetala*-3 (Tilly et al., Development. 125:1647-57, 1998), *Arabidopsis APETALA* 1 (AT1G69120, AP1) (SEQ ID NO: 33 (*Arabidopsis* (AT1G69120) *APETALA* 1)) (Hempel et al., Development 124:3845-3853, 1997)], and root promoters [e.g., the ROOTP promoter [SEQ ID NO: 34]; rice ExpB5 [SEQ ID NO:17 (rice ExpB5 Promoter); or SEQ ID NO: 16 (rice ExpB5 longer Promoter)] and barley ExpB1 promoters (SEQ ID NO: 18) (Won et al. Mol. Cells 30: 369-376, 2010); *arabidopsis* ATTPS-CIN (AT3G25820) promoter (SEQ ID NO: 35; Chen et al., Plant Phys 135:1956-66, 2004); *arabidopsis* Pho1 promoter (SEQ ID NO: 15, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plant is generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments of the invention, the transformed plant is homozygote to the transgene (i.e., the exogenous polynucleotide of some embodiments of the invention), and accordingly all seeds generated thereby include the transgene.

According to some embodiments, there is provided a method of improving at least one trait selected from the group consisting of nitrogen use efficiency, yield, growth rate, biomass, vigor, oil content, oil yield, seed yield, fiber yield, fiber quality, fiber length, photosynthetic capacity, early flowering, grain filling period, harvest index, plant height, and/or abiotic stress tolerance of a grafted plant, the method comprising providing a scion that does not transgenically express a polynucleotide encoding a polypeptide at least 80% homologous (e.g., identical) to the amino acid sequence selected from the group consisting of SEQ ID NOs:15824-25609 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs:15824-23573, (e.g., in a constitutive, tissue specific or inducible, e.g., in an abiotic stress responsive manner), thereby improving the at least one trait selected from nitrogen use efficiency, yield, growth rate, biomass, vigor, oil content, seed yield, fiber yield, fiber quality, fiber length, photosynthetic capacity, early flowering, grain filling period, harvest index, plant height, and/or abiotic stress tolerance of the grafted plant.

In some embodiments, the plant scion is non-transgenic.

Several embodiments relate to a grafted plant exhibiting at least one trait selected from the group consisting of improved nitrogen use efficiency, yield, growth rate, biomass, vigor, oil content, seed yield, fiber yield, fiber quality, fiber length, photosynthetic capacity, early flowering, grain filling period, harvest index, plant height, and/or abiotic stress tolerance, comprising a scion that does not transgenically express a polynucleotide encoding a polypeptide at least 80% homologous to the amino acid sequence selected from the group consisting of SEQ ID NOs:15824-23573 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs:15824-23573.

In some embodiments, the plant root stock transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs:15824-23573 in a stress responsive manner.

According to some embodiments of the invention, the plant root stock transgenically expresses a polynucleotide encoding a polypeptide selected from the group consisting of SEQ ID NOs: 15824-25609.

According to some embodiments of the invention, the plant root stock transgenically expresses a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 40-11140.

According to some embodiments of the invention, the plant root stock transgenically expresses a polynucleotide selected from the group consisting of SEQ ID NOs:40-15346.

Since processes which increase a trait selected from nitrogen use efficiency, fertilizer use efficiency, oil content, yield, seed yield, fiber yield, fiber quality, fiber length, photosynthetic capacity, growth rate, biomass, vigor, early flowering, grain filling period, harvest index, plant height, abiotic stress tolerance or any combination thereof in a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on nitrogen use efficiency, fertilizer use efficiency, oil content, yield, seed yield, fiber yield, fiber quality, fiber length, photosynthetic capacity, growth rate, biomass, vigor, early flowering, grain filling period, harvest index, plant height, and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, early flowering, grain filling period, harvest index, plant height, growth, biomass, yield and/or vigor traits, using conventional plant breeding techniques.

According to some embodiments of the invention, overexpression of the polypeptide of the invention is achieved by means of genome editing.

Genome editing is a reverse genetics method which uses artificially engineered nucleases to cut and create specific double-stranded breaks at a desired location(s) in the genome, which are then repaired by cellular endogenous processes such as, homology directed repair (HDR) and nonhomologous end-joining (NHEJ). NHEJ directly joins the DNA ends in a double-stranded break, while HDR utilizes a homologous sequence as a template for regenerating the missing DNA sequence at the break point. In order to introduce specific nucleotide modifications to the genomic DNA, a DNA repair template containing the desired sequence must be present during HDR. Genome editing cannot be performed using traditional restriction endonucleases since most restriction enzymes recognize a few base pairs on the DNA as their target and the probability is very high that the recognized base pair combination will be found in many locations across the genome resulting in multiple cuts not limited to a desired location. To overcome this challenge and create site-specific single- or double-stranded breaks, several distinct classes of nucleases have been discovered and bioengineered to date. These include the meganucleases, Zinc finger nucleases (ZFNs), transcription-activator like effector nucleases (TALENs) and CRISPR/Cas system.

Genome editing is a powerful mean to impact target traits by modifications of the target plant genome sequence. Such modifications can result in new or modified alleles or regulatory elements.

In addition, the traces of genome-edited techniques can be used for marker assisted selection (MAS) as is further described hereinunder. Target plants for the mutagenesis/genome editing methods according to the invention are any plants of interest including monocot or dicot plants.

Over expression of a polypeptide by genome editing can be achieved by: (i) replacing an endogenous sequence encoding the polypeptide of interest or a regulatory sequence under which it is placed, and/or (ii) inserting a new gene encoding the polypeptide of interest in a targeted region of the genome, and/or (iii) introducing point mutations which result in up-regulation of the gene encoding the polypeptide of interest (e.g., by altering the regulatory sequences such as promoter, enhancers, 5'-UTR and/or 3'-UTR, or mutations in the coding sequence).

Genome Editing Systems Overview

Several systems have been reported to enable genome editing implementation. Examples detailed herein below:

Meganucleases—Meganucleases are commonly grouped into four families: the LAGLIDADG family, the GIY-YIG family, the His-Cys box family and the HNH family. These families are characterized by structural motifs, which affect catalytic activity and recognition sequence. For instance, members of the LAGLIDADG family are characterized by having either one or two copies of the conserved LAGLIDADG motif. The four families of meganucleases are widely separated from one another with respect to conserved structural elements and, consequently, DNA recognition sequence specificity and catalytic activity. Meganucleases are found commonly in microbial species and have the unique property of having very long recognition sequences (>14 bp) thus making them naturally very specific for cutting at a desired location. This can be exploited to make site-specific double-stranded breaks directing modifications in regulatory elements or coding regions upon introduction of the desired sequence. One of skill in the art can use these naturally occurring meganucleases, however the number of such naturally occurring meganucleases is limited. To overcome this challenge, mutagenesis and high throughput screening methods have been used to create meganuclease variants that recognize unique sequences. For example, various meganucleases have been fused to create hybrid enzymes that recognize a new sequence. Alternatively, DNA interacting amino acids of the meganuclease can be altered to design sequence specific meganucleases (see e.g., U.S. Pat. No. 8,021,867). Meganucleases can be designed using the methods described in e.g., Certo, M T et al. Nature Methods (2012) 9:073-975; U.S. Pat. Nos. 8,304,222; 8,021,867; 8,119,381; 8,124,369; 8, 129,134; 8,133,697; 8,143,015; 8,143,016; 8, 148,098; or 8, 163,514, the contents of each are incorporated herein by reference in their entirety. Alternatively, meganucleases with site specific cutting characteristics can be obtained using commercially available technologies e.g., Precision Biosciences' Directed Nuclease Editor™ genome editing technology.

ZFNs and TALENs—Two distinct classes of engineered nucleases, zinc-finger nucleases (ZFNs) and transcription activator-like effector nucleases (TALENs), have both proven to be effective at producing targeted double-stranded breaks (Christian et al., 2010; Kim et al., 1996; Li et al., 2011; Mahfouz et al., 2011; Miller et al., 2010).

Basically, ZFNs and TALENs restriction endonuclease technology utilizes a non-specific DNA cutting enzyme which is linked to a specific DNA binding domain (either a series of zinc finger domains or TALE repeats, respectively). Typically a restriction enzyme whose DNA recognition site and cleaving site are separate from each other is selected. The cleaving portion is separated and then linked to a DNA binding domain, thereby yielding an endonuclease with very high specificity for a desired sequence. An exemplary restriction enzyme with such properties is FokI. Additionally FokI has the advantage of requiring dimerization to have nuclease activity and this means the specificity increases dramatically as each nuclease partner recognizes a unique DNA sequence. To enhance this effect, FokI nucleases have been engineered that can only function as heterodimers and have increased catalytic activity. The heterodimer functioning nucleases avoid the possibility of unwanted homodimer activity and thus increase specificity of the double-stranded break.

Thus, for example to target a specific site, ZFNs and TALENs are constructed as nuclease pairs, with each member of the pair designed to bind adjacent sequences at the targeted site. Upon transient expression in cells, the nucleases bind to their target sites and the FokI domains heterodimerize to create a double-stranded break. Repair of these double-stranded breaks through the nonhomologous end-joining (NHEJ) pathway most often results in small deletions or small sequence insertions. Since each repair made by NHEJ is unique, the use of a single nuclease pair can produce an allelic series with a range of different deletions at the target site. The deletions typically range anywhere from a few base pairs to a few hundred base pairs in length, but larger deletions have successfully been generated in cell culture by using two pairs of nucleases simultaneously (Carlson et al., 2012; Lee et al., 2010). In addition, when a fragment of DNA with homology to the targeted region is introduced in conjunction with the nuclease pair, the double-stranded break can be repaired via homology directed repair to generate specific modifications (Li et al., 2011; Miller et al., 2010; Urnov et al., 2005).

Although the nuclease portions of both ZFNs and TALENs have similar properties, the difference between these engineered nucleases is in their DNA recognition peptide. ZFNs rely on Cys2-His2 zinc fingers and TALENs on TALEs. Both of these DNA recognizing peptide domains have the characteristic that they are naturally found in combinations in their proteins. Cys2-His2 Zinc fingers typically found in repeats that are 3 bp apart and are found in diverse combinations in a variety of nucleic acid interacting proteins. TALEs on the other hand are found in repeats with a one-to-one recognition ratio between the amino acids and the recognized nucleotide pairs. Because both zinc fingers and TALEs happen in repeated patterns, different combinations can be tried to create a wide variety of sequence specificities. Approaches for making site-specific zinc finger endonucleases include, e.g., modular assembly (where Zinc fingers correlated with a triplet sequence are attached in a row to cover the required sequence), OPEN (low-stringency selection of peptide domains vs. triplet nucleotides followed by high-stringency selections of peptide combination vs. the final target in bacterial systems), and bacterial one-hybrid screening of zinc finger libraries, among others. ZFNs can also be designed and obtained commercially from e.g., Sangamo Biosciences™ (Richmond, Calif.).

Method for designing and obtaining TALENs are described in e.g. Reyon et al. Nature Biotechnology 2012 May; 30(5):460-5; Miller et al. Nat Biotechnol. (2011) 29: 143-148; Cermak et al. Nucleic Acids Research (2011) 39 (12): e82 and Zhang et al. Nature Biotechnology (2011) 29 (2): 149-53. A recently developed web-based program named Mojo Hand was introduced by Mayo Clinic for designing TAL and TALEN constructs for genome editing applications. TALEN can also be designed and obtained commercially from e.g., Sangamo Biosciences™ (Richmond, Calif.).

The ZFN/TALEN system capability for precise targeting can be utilized for directing modifications in regulatory elements and/or coding regions upon introduction of the sequence of interest for trait improvement.

CRISPR/Cas9—The CRIPSR/Cas system for genome editing contains two distinct components: a gRNA (guide RNA) and an endonuclease e.g. Cas9.

The gRNA is typically a 20 nucleotide sequence encoding a combination of the target homologous sequence (crRNA) and the endogenous bacterial RNA that links the crRNA to the Cas9 nuclease (tracrRNA) in a single chimeric transcript. The gRNA/Cas9 complex is recruited to the target sequence by the base-pairing between the gRNA sequence and the complement genomic DNA. For successful binding of Cas9, the genomic target sequence must also contain the correct Protospacer Adjacent Motif (PAM) sequence immediately following the target sequence. The binding of the gRNA/Cas9 complex localizes the Cas9 to the genomic target sequence so that the Cas9 can cut both strands of the DNA causing a double-strand break. Just as with ZFNs and TALENs, the double-stranded brakes produced by CRISPR/Cas can undergo homologous recombination or NHEJ.

The Cas9 nuclease has two functional domains: RuvC and HNH, each cutting a different DNA strand. When both of these domains are active, the Cas9 causes double strand breaks in the genomic DNA.

A significant advantage of CRISPR/Cas is that the high efficiency of this system coupled with the ability to easily create synthetic gRNAs enables multiple genes to be targeted simultaneously. In addition, the majority of cells carrying the mutation present biallelic mutations in the targeted genes.

However, apparent flexibility in the base-pairing interactions between the gRNA sequence and the genomic DNA target sequence allows imperfect matches to the target sequence to be cut by Cas9.

Modified versions of the Cas9 enzyme containing a single inactive catalytic domain, either RuvC- or HNH-, are called 'nickases'. With only one active nuclease domain, the Cas9 nickase cuts only one strand of the target DNA, creating a single-strand break or 'nick'. A single-strand break, or nick, is normally quickly repaired through the HDR pathway, using the intact complementary DNA strand as the template. However, two proximal, opposite strand nicks introduced by a Cas9 nickase are treated as a double-strand break, in what is often referred to as a 'double nick' CRISPR system. A double-nick can be repaired by either NHEJ or HDR depending on the desired effect on the gene target. Thus, if specificity and reduced off-target effects are crucial, using the Cas9 nickase to create a double-nick by designing two gRNAs with target sequences in close proximity and on opposite strands of the genomic DNA would decrease off-target effect as either gRNA alone will result in nicks that will not change the genomic DNA.

Modified versions of the Cas9 enzyme containing two inactive catalytic domains (dead Cas9, or dCas9) have no nuclease activity while still able to bind to DNA based on gRNA specificity. The dCas9 can be utilized as a platform for DNA transcriptional regulators to activate or repress gene expression by fusing the inactive enzyme to known regulatory domains. For example, the binding of dCas9 alone to a target sequence in genomic DNA can interfere with gene transcription.

There are a number of publically available tools available to help choose and/or design target sequences as well as lists of bioinformatically determined unique gRNAs for different genes in different species such as the Feng Zhang lab's Target Finder, the Michael Boutros lab's Target Finder (E-CRISP), the RGEN Tools: Cas-OFFinder, the CasFinder: Flexible algorithm for identifying specific Cas9 targets in genomes and the CRISPR Optimal Target Finder.

In order to use the CRISPR system, both gRNA and Cas9 should be expressed in a target cell. The insertion vector can contain both cassettes on a single plasmid or the cassettes are expressed from two separate plasmids. CRISPR plasmids are commercially available such as the px330 plasmid from Addgene.

Recombinant adeno-associated virus (rAAV) platform—this genome-editing platform is based on rAAV vectors which enable insertion, deletion or substitution of DNA sequences in the genomes of live mammalian cells. The rAAV genome is a single-stranded deoxyribonucleic acid (ssDNA) molecule, either positive- or negative-sensed, which is about 4.7 kb long. These single-stranded DNA viral vectors have high transduction rates and have a unique property of stimulating endogenous homologous recombination in the absence of double-strand DNA breaks in the genome. One of skill in the art can design a rAAV vector to target a desired genomic locus and perform both gross and/or subtle endogenous gene alterations in a cell. rAAV genome editing has the advantage in that it targets a single allele and does not result in any off-target genomic alterations. rAAV genome editing technology is commercially available, for example, the rAAV GENESIS™ system from Horizon™ (Cambridge, UK).

Methods for qualifying efficacy and detecting sequence alteration are well known in the art and include, but not limited to, DNA sequencing, electrophoresis, an enzyme-based mismatch detection assay and a hybridization assay such as PCR, RT-PCR, RNase protection, in-situ hybridization, primer extension, Southern blot, Northern Blot and dot blot analysis.

Sequence alterations in a specific gene can also be determined at the protein level using e.g. chromatography, electrophoretic methods, immunodetection assays such as ELISA and western blot analysis and immunohistochemistry.

In addition, one ordinarily skilled in the art can readily design a knock-in/knock-out construct including positive and/or negative selection markers for efficiently selecting transformed cells that underwent a homologous recombination event with the construct. Positive selection provides a means to enrich the population of clones that have taken up foreign DNA. Non-limiting examples of such positive markers include glutamine synthetase, dihydrofolate reductase (DHFR), markers that confer antibiotic resistance, such as neomycin, hygromycin, puromycin, and blasticidin S resistance cassettes. Negative selection markers are necessary to select against random integrations and/or elimination of a marker sequence (e.g. positive marker). Non-limiting examples of such negative markers include the herpes simplex-thymidine kinase (HSV-TK) which converts ganciclovir (GCV) into a cytotoxic nucleoside analog, hypoxanthine phosphoribosyltransferase (HPRT) and adenine phosphoribosytransferase (ARPT).

Recombination Procedures—Common to Different Genome Editing Systems

Hit and run" or "in-out"—involves a two-step recombination procedure. In the first step, an insertion-type vector containing a dual positive/negative selectable marker cassette is used to introduce the desired sequence alteration. The insertion vector contains a single continuous region of homology to the targeted locus and is modified to carry the mutation of interest. This targeting construct is linearized with a restriction enzyme at a one site within the region of homology, electroporated into the cells, and positive selection is performed to isolate homologous recombinants. These homologous recombinants contain a local duplication that is separated by intervening vector sequence, including the selection cassette. In the second step, targeted clones are subjected to negative selection to identify cells that have lost the selection cassette via intrachromosomal recombination between the duplicated sequences. The local recombination event removes the duplication and, depending on the site of recombination, the allele either retains the introduced mutation or reverts to wild type. The end result is the introduction of the desired modification without the retention of any exogenous sequences.

The "double-replacement" or "tag and exchange" strategy—involves a two-step selection procedure similar to the hit and run approach, but requires the use of two different targeting constructs. In the first step, a standard targeting vector with 3' and 5' homology arms is used to insert a dual positive/negative selectable cassette near the location where the mutation is to be introduced. After electroporation and positive selection, homologously targeted clones are identified. Next, a second targeting vector that contains a region of homology with the desired mutation is electroporated into targeted clones, and negative selection is applied to remove the selection cassette and introduce the mutation. The final allele contains the desired mutation while eliminating unwanted exogenous sequences.

Site-Specific Recombinases—The Cre recombinase derived from the P1 bacteriophage and Flp recombinase derived from the yeast *Saccharomyces cerevisiae* are site-specific DNA recombinases each recognizing a unique 34 base pair DNA sequence (termed "Lox" and "FRT", respectively) and sequences that are flanked with either Lox sites or FRT sites can be readily removed via site-specific recombination upon expression of Cre or Flp recombinase, respectively. For example, the Lox sequence is composed of an asymmetric eight base pair spacer region flanked by 13 base pair inverted repeats. Cre recombines the 34 base pair lox DNA sequence by binding to the 13 base pair inverted repeats and catalyzing strand cleavage and religation within the spacer region. The staggered DNA cuts made by Cre in the spacer region are separated by 6 base pairs to give an overlap region that acts as a homology sensor to ensure that only recombination sites having the same overlap region recombine. Basically, the site specific recombinase system offers means for the removal of selection cassettes after homologous recombination. This system also allows for the generation of conditional altered alleles that can be inactivated or activated in a temporal or tissue-specific manner. Of note, the Cre and Flp recombinases leave behind a Lox or FRT "scar" of 34 base pairs. The Lox or FRT sites that remain are typically left behind in an intron or 3' UTR of the modified locus, and current evidence suggests that these sites usually do not interfere significantly with gene function. Thus, Cre/Lox and Flp/FRT recombination involves introduction of a targeting vector with 3' and 5' homology arms containing the mutation of interest, two Lox or FRT sequences and typically a selectable cassette placed between the two Lox or FRT sequences. Positive selection is applied and homologous recombinants that contain targeted mutation are identified. Transient expression of Cre or Flp in conjunction with negative selection results in the excision of the selection cassette and selects for cells where the cassette has been lost. The final targeted allele contains the Lox or FRT scar of exogenous sequences.

Transposases—As used herein, the term "transposase" refers to an enzyme that binds to the ends of a transposon and catalyzes the movement of the transposon to another part of the genome.

As used herein the term "transposon" refers to a mobile genetic element comprising a nucleotide sequence which can move around to different positions within the genome of a single cell. In the process the transposon can cause mutations and/or change the amount of a DNA in the genome of the cell. A number of transposon systems that are able to also transpose in cells e.g. vertebrates have been isolated or designed, such as Sleeping Beauty [Izsvik and Ivics Molecular Therapy (2004) 9, 147-156], piggyBac [Wilson et al. Molecular Therapy (2007) 15, 139-145], Tol2 [Kawakami et al. PNAS (2000) 97 (21): 11403-11408] or Frog Prince [Miskey et al. Nucleic Acids Res. December 1, (2003) 31(23): 6873-6881]. Generally, DNA transposons translocate from one DNA site to another in a simple, cut-and-paste manner. Each of these elements has their own advantages, for example, Sleeping Beauty is particularly useful in region-specific mutagenesis, whereas Tol2 has the highest tendency to integrate into expressed genes. Hyperactive systems are available for Sleeping Beauty and piggyBac. Most importantly, these transposons have distinct target site preferences, and can therefore introduce sequence alterations in overlapping, but distinct sets of genes. Therefore, to achieve the best possible coverage of genes, the use of more than one element is particularly preferred. The basic mechanism is shared between the different transposases, therefore we will describe piggyBac (PB) as an example. PB is a 2.5 kb insect transposon originally isolated from the cabbage looper moth, *Trichoplusia ni*. The PB transposon consists of asymmetric terminal repeat sequences that flank a transposase, PBase. PBase recognizes the terminal repeats and induces transposition via a "cut-and-paste" based mechanism, and preferentially transposes into the host genome at the tetranucleotide sequence TTAA. Upon insertion, the TTAA target site is duplicated such that the PB transposon is flanked by this tetranucleotide sequence. When mobilized, PB typically excises itself precisely to reestablish a single TTAA site, thereby restoring the host sequence to its pretransposon state. After excision, PB can transpose into a new location or be permanently lost from the genome. Typically, the transposase system offers an alternative means for the removal of selection cassettes after homologous recombination quit similar to the use Cre/Lox or Flp/FRT. Thus, for example, the PB transposase system involves introduction of a targeting vector with 3' and 5' homology arms containing the mutation of interest, two PB terminal repeat sequences at the site of an endogenous TTAA sequence and a selection cassette placed between PB terminal repeat sequences. Positive selection is applied and homologous recombinants that contain targeted mutation are identified. Transient expression of PBase removes in conjunction with negative selection results in the excision of the selection cassette and selects for cells where the cassette has been lost. The final targeted allele contains the introduced mutation with no exogenous sequences.

For PB to be useful for the introduction of sequence alterations, there must be a native TTAA site in relatively close proximity to the location where a particular mutation is to be inserted.

Homology Directed Repair (HDR) Homology Directed Repair (HDR) can be used to generate specific nucleotide changes (also known as gene "edits") ranging from a single nucleotide change to large insertions. In order to utilize HDR for gene editing, a DNA "repair template" containing the desired sequence must be delivered into the cell type of interest with e.g. the guide RNA [gRNA(s)] and Cas9 or Cas9 nickase or other genome editing method (examples herein below). The repair template must contain the desired edit as well as additional homologous sequence immediately upstream and downstream of the target (termed left and right homology arms). The length and binding position of each homology arm is dependent on the size of the change being introduced. The repair template can be a single stranded oligonucleotide, double-stranded oligonucleotide, or double-stranded DNA plasmid depending on the specific application.

The HDR method was successfully used for targeting a specific modification in a coding sequence of a gene in plants (Budhagatapalli Nagaveni et al. 2015. "Targeted Modification of Gene Function Exploiting Homology-Directed Repair of TALEN-Mediated Double-Strand Breaks in Barley". G3 (Bethesda). 2015 September; 5(9): 1857-1863). Thus, the gfp-specific transcription activator-like effector nucleases were used along with a repair template that, via HDR, facilitates conversion of gfp into yfp, which is associated with a single amino acid exchange in the gene product. The resulting yellow-fluorescent protein accumulation along with sequencing confirmed the success of the genomic editing.

Similarly, Zhao Yongping et al. 2016 (An alternative strategy for targeted gene replacement in plants using a dual-sgRNA/Cas9 design. Scientific Reports 6, Article number: 23890 (2016)) describe co-transformation of *Arabidopsis* plants with a combinatory dual-sgRNA/Cas9 vector that successfully deleted miRNA gene regions (MIR169a and MIR827a) and second construct that contains sites homologous to *Arabidopsis* TERMINAL FLOWER 1 (TFL1) for homology-directed repair (HDR) with regions corresponding to the two sgRNAs on the modified construct to provide both targeted deletion and donor repair for targeted gene replacement by HDR.

Specific considerations for Homology Directed Repair (HDR) utilizing CRISPR/Cas9 system are described herein: It should be noted that the repair template should not include a sequence that exhibits more than 90% identity to the gRNA designed to the genomic DNA or to the reverse complement sequence of the gRNA which is designed to the genomic sequence, otherwise the repair template becomes a suitable target for Cas9 cleavage. Additionally or alternatively, when using a short repair template (e.g., about 40-200 base pairs) the repair template should preferably lack the Protospacer Adjacent Motif (PAM) sequence. For example, the PAM could be mutated such that it is no longer present, but the coding region of the gene is not affected (i.e. a silent mutation).

Introduction of large double stranded DNA as repair template can be performed using plasmids, yet, the plasmid should be linearized before transfection.

Activation of Target Genes Using CRISPR/Cas9 system

Many bacteria and archea contain endogenous RNA-based adaptive immune systems that can degrade nucleic acids of invading phages and plasmids. These systems consist of clustered regularly interspaced short palindromic repeat (CRISPR) genes that produce RNA components and CRISPR associated (Cas) genes that encode protein components. The CRISPR RNAs (crRNAs) contain short stretches of homology to specific viruses and plasmids and act as guides to direct Cas nucleases to degrade the complementary nucleic acids of the corresponding pathogen. Studies of the type II CRISPR/Cas system of *Streptococcus pyogenes* have shown that three components form an RNA/protein complex and together are sufficient for sequence-specific nuclease activity: the Cas9 nuclease, a crRNA containing 20 base pairs of homology to the target sequence, and a trans-activating crRNA (tracrRNA) (Jinek et al. Science (2012) 337: 816-821.). It was further demonstrated that a synthetic chimeric guide RNA (gRNA) composed of a fusion between crRNA and tracrRNA could direct Cas9 to cleave DNA targets that are complementary to the crRNA in vitro. It was also demonstrated that transient expression of CRISPR-associated endonuclease (Cas9) in conjunction with synthetic gRNAs can be used to produce targeted double-stranded brakes in a variety of different species.

The CRISPR/Cas9 system is a remarkably flexible tool for genome manipulation. A unique feature of Cas9 is its ability to bind target DNA independently of its ability to cleave target DNA. Specifically, both RuvC- and HNH-nuclease domains can be rendered inactive by point mutations (D10A and H840A in SpCas9), resulting in a nuclease dead Cas9 (dCas9) molecule that cannot cleave target DNA. The dCas9 molecule retains the ability to bind to target DNA based on the gRNA targeting sequence. The dCas9 can be tagged with transcriptional activators, and targeting these dCas9 fusion proteins to the promoter region results in robust transcription activation of downstream target genes. The simplest dCas9-based activators consist of dCas9 fused directly to a single transcriptional activator. Importantly, unlike the genome modifications induced by Cas9 or Cas9 nickase, dCas9-mediated gene activation is reversible, since it does not permanently modify the genomic DNA.

Indeed, genome editing was successfully used to overexpress a protein of interest in a plant by, for example, mutating a regulatory sequence, such as a promoter to overexpress the endogenous polynucleotide operably linked to the regulatory sequence. For example, U.S. Patent Application Publication No. 20160102316 to Rubio Munoz, Vicente et al. which is fully incorporated herein by reference, describes plants with increased expression of an endogenous DDA1 plant nucleic acid sequence wherein the endogenous DDA1 promoter carries a mutation introduced by mutagenesis or genome editing which results in increased expression of the DDA1 gene, using for example, CRISPR. The method involves targeting of Cas9 to the specific genomic locus, in this case DDA1, via a 20 nucleotide guide sequence of the single-guide RNA. An online CRISPR Design Tool can identify suitable target sites (http://tools(dot)genome-engineering(dot)org(dot) Ran et al. Genome engineering using the CRISPR-Cas9 system nature protocols, VOL. 8 NO.11, 2281-2308, 2013).

The CRISPR-Cas system was used for altering gene expression in plants as described in U.S. Patent Application publication No. 20150067922 to Yang; Yinong et al., which is fully incorporated herein by reference. Thus, the engineered, non-naturally occurring gene editing system comprises two regulatory elements, wherein the first regulatory element (a) operable in a plant cell operably linked to at least one nucleotide sequence encoding a CRISPR-Cas system guide RNA (gRNA) that hybridizes with the target sequence in the plant, and a second regulatory element (b) operable in a plant cell operably linked to a nucleotide sequence encoding a Type-II CRISPR-associated nuclease, wherein components (a) and (b) are located on same or different vectors of the system, whereby the guide RNA targets the target sequence and the CRISPR-associated nuclease cleaves the DNA molecule, thus altering the expression of a gene product in a plant. It should be noted that the CRISPR-associated nuclease and the guide RNA do not naturally occur together.

In addition, as described above, point mutations which activate a gene-of-interest and/or which result in over-expression of a polypeptide-of-interest can be also introduced into plants by means of genome editing. Such mutation can be for example, deletions of repressor sequences which result in activation of the gene-of-interest; and/or mutations which insert nucleotides and result in activation of regulatory sequences such as promoters and/or enhancers.

According to some embodiments of the invention, the method further comprising growing the plant over-expressing the polypeptide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency (e.g., nitrogen deficiency or nitrogen limitation), nutrient excess, atmospheric pollution and UV irradiation.

According to some embodiments of the invention, the method further comprises growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions), wherein the normal or optimal conditions include about 6-15 mM Nitrogen, e.g., 6-10 mM Nitrogen).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 15824-23573, wherein the plant is derived from a plant (parent plant) that has been transformed to express the exogenous polynucleotide and that has been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 15824-23573 wherein the crop plant is derived from plants which have been transformed with the exogenous polynucleotide and which have been selected for at least one trait selected from increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency) as compared to a control wild type plant of the same species which is grown under the same growth conditions, and the crop plant having the at least one trait selected from increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency), thereby producing the crop.

According to some embodiments of the invention the polypeptide is selected from the group consisting of SEQ ID NOs:15824-26243.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:40-11140, wherein the plant is derived from a plant selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs:40-11140, wherein the crop plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency) as compared to a wild type plant of the same species which is grown under the same growth conditions, and the crop plant having the at least one trait selected from increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency), thereby producing the crop.

According to some embodiments of the invention the exogenous polynucleotide is selected from the group consisting of SEQ ID NOs:40-15823.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency) as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to any one of SEQ ID NOs:15824-23573, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency) as compared to a non-transformed plant, thereby growing the crop.

According to some embodiments of the invention the polypeptide is selected from the group consisting of SEQ ID NOs:15824-26243.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to a nucleic acid sequence selected from the group consisting of SEQ ID NO:40-11140, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, increased early flowering, increased grain filling period, increased harvest index, increased plant height, and/or increased fertilizer use efficiency (e.g., increased nitrogen use efficiency) as compared to a non-transformed plant, thereby growing the crop.

According to some embodiments of the invention the exogenous polynucleotide is selected from the group consisting of SEQ ID NOs:40-15823.

According to an aspect of some embodiments of the present invention there is provided a method of growing a crop comprising:

(a) selecting a parent plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide selected from the group consisting of set forth in SEQ ID NOs:15824-23573 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased early flowering, increased grain filling period, increased harvest index, increased plant height, increased nitrogen use efficiency, and increased abiotic stress tolerance as compared to a non-transformed plant of the same species which is grown under the same growth conditions, and (b) growing a progeny crop plant of the parent plant, wherein the progeny crop plant which comprises the exogenous polynucleotide has at least one trait selected from the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, the increased early flowering, the increased grain filling period, the increased harvest index, the increased plant height, and/or the increased abiotic stress, thereby growing the crop.

According to an aspect of some embodiments of the present invention there is provided a method of producing seeds of a crop comprising:

(a) selecting parent plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide selected from the group consisting of set forth in SEQ ID NOs: 15824-23573 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased early flowering, increased grain filling period, increased harvest index, increased plant height, increased nitrogen use efficiency, and increased abiotic stress as compared to a non-transformed plant of the same species which is grown under the same growth conditions, (b) growing a seed producing plant from the parent plant resultant of step (a), wherein the seed producing plant which comprises the exogenous polynucleotide has at least bone trait selected from the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, the increased early flowering, the increased grain filling period, the increased harvest index, the increased plant height, and/or the increased abiotic stress, to the seed production stage; and (c) harvesting seeds from the seed producing plant resultant of step (b), thereby producing seeds of the crop.

According to some embodiments of the invention, the seeds produced from the seed producing plant comprise the exogenous polynucleotide.

According to an aspect of some embodiments of the present invention there is provided a method of growing a crop comprising:

(a) selecting a parent plant transformed with an exogenous polynucleotide comprising a nucleic acid sequence encoding the polypeptide selected from the group consisting of SEQ ID NOs:15824-26243 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, increased early flowering, increased grain filling period, increased harvest index, increased plant height, and increased abiotic stress tolerance as compared to a non-transformed plant of the same species which is grown under the same growth conditions, and (b) growing progeny crop plant of the parent plant, wherein the progeny crop plant which comprises the exogenous polynucleotide has the selected trait(s), thereby growing the crop.

According to an aspect of some embodiments of the present invention there is provided a method of producing seeds of a crop comprising:

(a) selecting parent plant transformed with an exogenous polynucleotide comprising a nucleic acid sequence encoding the polypeptide selected from the group consisting of SEQ ID NOs:15824-26243 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, increased early flowering, increased grain filling period, increased harvest index, increased plant height, and increased abiotic stress as compared to a non-transformed plant of the same species which is grown under the same growth conditions, (b) growing a seed producing plant from the parent plant resultant of step (a), wherein the seed producing plant which comprises the exogenous polynucleotide has at least one trait selected from the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, the increased early flowering, the increased grain filling period, the increased harvest index, the increased plant height, and/or the increased abiotic stress, to the seed production stage; and (c) harvesting seeds from the seed producing plant resultant of step (b), thereby producing seeds of the crop.

According to some embodiments of the invention the exogenous polynucleotide is selected from the group consisting of SEQ ID NOs: 40-421, 737-13994, 24733-24737, 24739, 24740-24888 and 24889.

The effect of the transgene (the exogenous polynucleotide encoding the polypeptide) on abiotic stress tolerance can be determined using known methods such as detailed below and in the Examples section which follows.

Abiotic Stress Tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM, 400 mM mannitol.

Drought Tolerance Assay/Osmoticum Assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat Stress Tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water Use Efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)] \times 100 \qquad \text{Formula 1}$$

Fertilizer Use Efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Use Efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use Efficiency Assay Using Plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen Determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of NaNO2. The procedure is described in details in Samonte et al. 2006 Agron. J. 98:168-176.

Germination Tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 *Plant Physiology* 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant Vigor—The plant vigor can be calculated by the increase in growth parameters such as leaf area, fiber length, rosette diameter, plant fresh weight and the like per time.

Growth Rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

It should be noted that an increase in rosette parameters such as rosette area, rosette diameter and/or rosette growth rate in a plant model such as *Arabidopsis* predicts an increase in canopy coverage and/or plot coverage in a target plant such as *Brassica* sp., soy, corn, wheat, Barley, oat, cotton, rice, tomato, sugar beet, and vegetables such as lettuce.

Evaluation of growth rate can be done by measuring plant biomass produced, rosette area, leaf size or root length per time (can be measured in $cm^2$ per day of leaf area).

Relative growth area can be calculated using Formula 2.

Formula 2: Relative growth rate area=Regression coefficient of area along time course Thus, the relative growth area rate is in units of area units (e.g., $mm^2$/day or $cm^2$/day) and the relative length growth rate is in units of length units (e.g., cm/day or mm/day).

For example, RGR can be determined for plant height (Formula 3), SPAD (Formula 4), Number of tillers (Formula 5), root length (Formula 6), vegetative growth (Formula 7), leaf number (Formula 8), rosette area (Formula 9), rosette diameter (Formula 10), plot coverage (Formula 11), leaf blade area (Formula 12), and leaf area (Formula 13).

Formula 3: Relative growth rate of Plant height=Regression coefficient of Plant height along time course (measured in cm/day).

Formula 4: Relative growth rate of SPAD=Regression coefficient of SPAD measurements along time course.

Formula 5: Relative growth rate of Number of tillers=Regression coefficient of Number of tillers along time course (measured in units of "number of tillers/day").

Formula 6: Relative growth rate of root length=Regression coefficient of root length along time course (measured in cm per day).

Vegetative growth rate analysis—was calculated according to Formula 7 below.

Formula 7: Relative growth rate of vegetative growth=Regression coefficient of vegetative dry weight along time course (measured in grams per day).

Formula 8: Relative growth rate of leaf number=Regression coefficient of leaf number along time course (measured in number per day).

Formula 9: Relative growth rate of rosette area=Regression coefficient of rosette area along time course (measured in $cm^2$ per day).

Formula 10: Relative growth rate of rosette diameter=Regression coefficient of rosette diameter along time course (measured in cm per day).

Formula 11: Relative growth rate of plot coverage=Regression coefficient of plot (measured in $cm^2$ per day).

Formula 12: Relative growth rate of leaf blade area=Regression coefficient of leaf area along time course (measured in $cm^2$ per day).

Formula 13: Relative growth rate of leaf area=Regression coefficient of leaf area along time course (measured in $cm^2$ per day).

$$1000 \text{ Seed Weight} = \text{number of seed in sample/sample weight} \times 1000 \qquad \text{Formula 14}$$

The Harvest Index can be calculated using Formulas 15, 16, 17, 18, 65 and 66 below.

$$\text{Harvest Index(seed)} = \text{Average seed yield per plant/Average dry weight.} \qquad \text{Formula 15}$$

$$\text{Harvest Index(Sorghum)} = \text{Average grain dry weight per Head/(Average vegetative dry weight per Head+Average Head dry weight)} \qquad \text{Formula 16}$$

$$\text{Harvest Index(Maize)} = \text{Average grain weight per plant/(Average vegetative dry weight per plant plus Average grain weight per plant)} \qquad \text{Formula 17}$$

Harvest Index (for barley)—The harvest index is calculated using Formula 18.

$$\text{Harvest Index(for barley and wheat)} = \text{Average spike dry weight per plant/(Average vegetative dry weight per plant+Average spike dry weight per plant)} \qquad \text{Formula 18}$$

Following is a non-limited list of additional parameters which can be detected in order to show the effect of the transgene on the desired plant's traits:

$$\text{Grain circularity} = 4 \times 3.14 \, (\text{grain area/perimeter}^2) \qquad \text{Formula 19}$$

$$\text{Internode volume} = 3.14 \times (d/2)^2 \times 1 \qquad \text{Formula 20}$$

$$\text{Total dry matter (kg)} = \text{Normalized head weight per plant+vegetative dry weight.} \qquad \text{Formula 21}$$

$$\text{Root/Shoot Ratio} = \text{total weight of the root at harvest/total weight of the vegetative portion above ground at harvest. } (=\text{RBiH/BiH}) \qquad \text{Formula 22}$$

Ratio of the number of pods per node on main stem at pod set=Total number of pods on main stem/Total number of nodes on main stem. Formula 23

Ratio of total number of seeds in main stem to number of seeds on lateral branches=Total number of seeds on main stem at pod set/Total number of seeds on lateral branches at pod set. Formula 24

Petiole Relative Area=(Petiole area)/Rosette area (measured in %). Formula 25 percentage of reproductive tiller=Number of Reproductive tillers/number of tillers)×100. Formula 26

Spikes Index=Average Spikes weight per plant/(Average vegetative dry weight per plant plus Average Spikes weight per plant). Formula 27

Formula 28: Relative growth rate of root coverage=Regression coefficient of root coverage along time course.

$$\text{Seed Oil yield} = \text{Seed yield per plant (gr.)} \times \text{Oil \% in seed.} \qquad \text{Formula 29}$$

shoot/root Ratio=total weight of the vegetative portion above ground at harvest/total weight of the root at harvest. Formula 30

Spikelets Index=Average Spikelets weight per plant/(Average vegetative dry weight per plant plus Average Spikelets weight per plant). Formula 31

% Canopy coverage=(1−(PAR_DOWN/PAR_UP))×100 measured using AccuPAR Ceptometer Model LP-80. Formula 32 leaf mass fraction=Leaf area/shoot FW. Formula 33

Formula 34: Relative growth rate based on dry weight=Regression coefficient of dry weight along time course.

Formula 35: Dry matter partitioning (ratio)—At the end of the growing period 6 plants heads as well as the rest of the plot heads were collected, threshed and grains were weighted to obtain grains yield per plot. Dry matter partitioning was calculated by dividing grains yield per plot to vegetative dry weight per plot.

Formula 36: 1000 grain weight filling rate (gr/day)—The rate of grain filling was calculated by dividing 1000 grain weight by grain fill duration.

Formula 37: Specific leaf area ($cm^2$/gr)—Leaves were scanned to obtain leaf area per plant, and then were dried in an oven to obtain the leaves dry weight. Specific leaf area was calculated by dividing the leaf area by leaf dry weight.

Vegetative dry weight per plant at flowering/water until flowering (gr/lit)—Calculated by dividing vegetative dry weight(excluding roots and reproductive organs)per plant at flowering by the water used for irrigation up to flowering  Formula 38

Yield filling rate (gr/day)—The rate of grain filling was calculated by dividing grains Yield by grain fill duration. Formula 39

Yield per dunam/water until tan (kg/lit)—Calculated by dividing Grains yield per dunam by water used for irrigation until tan. Formula 40

Yield per plant/water until tan (gr/lit)—Calculated by dividing Grains yield per plant by water used for irrigation until tan Formula 41

Yield per dunam/water until maturity (gr/lit)—Calculated by dividing grains yield per dunam by the water used for irrigation up to maturity. "Lit"=Liter. Formula 42

Vegetative dry weight per plant/water until maturity (gr/lit): Calculated by dividing vegetative dry weight per plant(excluding roots and reproductive organs) at harvest by the water used for irrigation up to maturity. Formula 43

Total dry matter per plant/water until maturity (gr/lit): Calculated by dividing total dry matter at harvest(vegetative and reproductive, excluding roots)per plant by the water used for irrigation up to maturity. Formula 44

Total dry matter per plant/water until flowering (gr/lit): Calculated by dividing total dry matter at flowering(vegetative and reproductive, excluding roots)per plant by the water used for irrigation up to flowering.     Formula 45

Heads index(ratio): Average heads weight/(Average vegetative dry weight per plant plus Average heads weight per plant).     Formula 46

Yield/SPAD (kg/SPAD units)—Calculated by dividing grains yield by average SPAD measurements per plot.     Formula 47

Stem water content(percentage)—stems were collected and fresh weight (FW) was weighted. Then the stems were oven dry and dry weight (DW) was recorded. Stems dry weight was divided by stems fresh weight, subtracted from 1 and multiplied by 100.     Formula 48

Leaf water content(percentage)—Leaves were collected and fresh weight (FW) was weighted. Then the leaves were oven dry and dry weight (DW) was recorded. Leaves dry weight was divided by leaves fresh weight, subtracted from 1 and multiplied by 100.     Formula 49 stem volume (cm$^3$)—The average stem volume was calculated by multiplying the average stem length by(3.14*((mean lower and upper stem width)/2)^2).     Formula 50

NUE—is the ratio between total grain yield per total nitrogen(applied+content) in soil.     Formula 51

NUpE—Is the ratio between total plant N content per total N(applied+content) in soil.     Formula 52

Formula 53: Total NUtE—Is the ratio between total dry matter per N content of total dry matter.

Formula 54: Stem density—is the ratio between internode dry weight and internode volume.

Formula 55: Grain NUtE—Is the ratio between grain yield per N content of total dry matter Formula 56: N harvest index (Ratio)—Is the ratio between nitrogen content in grain per plant and the nitrogen of whole plant at harvest.

Formula 57: Biomass production efficiency—is the ratio between plant biomass and total shoot N.

Harvest index(plot)(ratio)—Average seed yield per plot/Average dry weight per plot.     Formula 58

Formula 59: Relative growth rate of petiole relative area—Regression coefficient of petiole relative area along time course (measured in cm2 per day).

Yield per spike filling rate (gr/day)—spike filling rate was calculated by dividing grains yield per spike to grain fill duration.     Formula 60

Yield per micro plots filling rate (gr/day)—micro plots filling rate was calculated by dividing grains yield per micro plots to grain fill duration.     Formula 61

Grains yield per hectare [ton/ha]—all spikes per plot were harvested threshed and grains were weighted after sun dry. The resulting value was divided by the number of square meters and multiplied by 10,000 (10,000 square meters=1 hectare).     Formula 62

Total dry matter(for Maize)=Normalized ear weight per plant+vegetative dry weight.     Formula 63

$$\text{Agronomical } NUE = \frac{\text{Yield per plant (Kg.)}^{X\ Nitrogen\ Fertilization} - \text{Yield per plant (Kg.)}^{0\%\ Nitrogen\ Fertilization}}{\text{Fertilizer}^X} \quad \text{Formula 64}$$

Harvest Index(brachypodium)=Average grain weight/average dry(vegetative+spikelet)weight per plant.     Formula 65

Harvest Index for Sorghum*(*when the plants were not dried)=FW(fresh weight)Heads/(FW Heads+FW Plants)     Formula 66

Formula 67: Relative growth rate of nodes number=Regression coefficient of nodes number along time course (measured in number per day).

Grain Protein Concentration—Grain protein content (g grain protein m$^{-2}$) is estimated as the product of the mass of grain N (g grain N m$^{-2}$) multiplied by the N/protein conversion ratio of k-5.13 (Mosse 1990, supra). The grain protein concentration is estimated as the ratio of grain protein content per unit mass of the grain (g grain protein kg$^{-1}$ grain).

Fiber Length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (cottoninc(dot)com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000–weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000–weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000–weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000–weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000–weight), increase oil content per seed, improve fiber length, fiber strength, among others. An increase in yield may also result in modified architecture, or may occur because of modified architecture.

Oil Content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [invitrogen (dot) corn/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, CA USA). For convenience, each micro-array expression information tissue type has received an expression Set ID.

Correlation analysis—was performed for selected genes according to some embodiments of the invention, in which the characterized parameters (measured parameters according to the correlation IDs) were used as "X axis" for correlation with the tissue transcriptome, which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) and the phenotypic characteristic (e.g., improved yield, growth rate, nitrogen use efficiency, abiotic stress tolerance and the like).

Example 1

Production of Barley Transcriptome and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [chem. (dot) agilent (dot) com/Scripts/PDS (dot) asp?lPage=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [davidmlane (dot) com/hyperstat/ A34739 (dot) html].

Experimental Procedures

Analyzed Barley tissues—six tissues at different developmental stages [leaf, meristem, root tip, adventitious root, booting spike and stem], representing different plant characteristics, were sampled and RNA was extracted as described above. Each micro-array expression information tissue type has received a Set ID as summarized in Tables 1-3 below.

TABLE 1

Barley transcriptome expression sets under normal and low nitrogen conditions (set 1)

| Expression Set | Set ID |
|---|---|
| Root at vegetative stage under low nitrogen conditions | 1 |
| Root at vegetative stage under normal conditions | 2 |
| Leaf at vegetative stage under low nitrogen conditions | 3 |
| Leaf at vegetative stage under normal conditions | 4 |
| Root tip at vegetative stage under low nitrogen conditions | 5 |
| Root tip at vegetative stage under normal conditions | 6 |

Table 1. Provided are the barley transcriptome expression sets IDs under normal and low nitrogen conditions (set 1 - vegetative stage).

TABLE 2

Barley transcriptome expression sets under normal and low nitrogen conditions (set 2)

| Expression Set | Set ID |
|---|---|
| Booting spike at reproductive stage under low nitrogen conditions | 1 |
| Booting spike at reproductive stage under normal conditions | 2 |
| Leaf at reproductive stage under low nitrogen conditions | 3 |
| Leaf at reproductive stage under normal conditions | 4 |
| Stem at reproductive stage under low nitrogen conditions | 5 |
| Stem at reproductive stage under normal conditions | 6 |

Table 2. Provided are the barley transcriptome expression sets under normal and low nitrogen conditions (set 2 - reproductive stage).

TABLE 3

Barley transcriptome expression sets under drought and recovery conditions

| Expression Set | Set ID |
|---|---|
| Booting spike at reproductive stage under drought conditions | 1 |
| Leaf at reproductive stage under drought conditions | 2 |
| Leaf at vegetative stage under drought conditions | 3 |
| Meristem at vegetative stage under drought conditions | 4 |
| Root tip at vegetative stage under drought conditions | 5 |
| Root tip at vegetative stage under recovery from drought conditions | 6 |

Table 3. Provided are the expression sets IDs at the reproductive and vegetative stages.

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting as recommended for commercial growth under normal conditions [normal growth conditions included irrigation 2-3 times a week and fertilization given in the first 1.5 months of the growth period]; under low Nitrogen (80% percent less Nitrogen); or under drought stress (cycles of drought and re-irrigating were conducted throughout the whole experiment, overall 40% less water as compared to normal conditions were given in the drought treatment). Plants were phenotyped on a daily basis following the standard descriptor of barley (Tables 4 and 5, below). Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grains number—The total number of grains from all spikes that were manually threshed was counted. Number of grains per plot was counted.

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using a measuring tape. Height was measured from ground level to top of the longest spike excluding awns at two time points at the Vegetative growth (30 days after sowing) and at harvest.

Spike weight—The biomass and spikes weight of each plot were separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Root dry weight=total weight of the root portion underground after drying at 70° C. in oven for 48 hours at harvest.

Root/Shoot Ratio—The Root/Shoot Ratio calculated using Formula 22 (above).

Total No. of tillers—all tillers were counted per plot at two time points at the vegetative growth (30 days after sowing) and at harvest.

Percent of reproductive tillers—was calculated based on Formula 26 (above).

SPAD [SPAD unit]—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW—weight of 3 plants per plot were recorded at different time-points.

Heading date—the day in which booting stage was observed was recorded and number of days from sowing to heading was calculated.

Relative water content (RWC)—was calculated based on Formula 1 described above.

Harvest Index (for barley)—The harvest index was performed using Formula 18 above.

Relative growth rate: the relative growth rate (RGR) of Plant Height, SPAD and number of tillers were calculated based on Formulas 3, 4 and 5 respectively.

Average Grain Area ($cm^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains.

Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Ratio Drought/Normal: Represent ratio for the results of the specified parameters measured under Drought condition divided by results of the specified parameters measured under Normal conditions (maintenance of phenotype under drought in comparison to normal conditions).

TABLE 4

Barley correlated parameters (vectors) under low nitrogen and normal conditions (set 1)

| Correlated parameter with | Correlation ID |
|---|---|
| SPAD at TP2, under low Nitrogen conditions | 1 |
| Root FW (gr.) at TP2, under low Nitrogen conditions | 2 |
| shoot FW (gr.) at TP2, under low Nitrogen conditions | 3 |
| Seed Yield (gr.), under low Nitrogen conditions | 4 |
| Spike Width (cm), under low Nitrogen conditions | 5 |
| Root length (cm) at TP2, under low Nitrogen conditions | 6 |
| Plant Height (cm) at TP1, under low Nitrogen conditions | 7 |
| Spike Length (cm), under low Nitrogen conditions | 8 |
| Plant Height (cm) at TP2, under low Nitrogen conditions | 9 |
| Leaf Number at TP4, under low Nitrogen conditions | 10 |
| No. of lateral roots at TP2, under low Nitrogen conditions | 11 |
| Max Width (mm) at TP4, under low Nitrogen conditions | 12 |
| Max Length (mm) at TP4, under low Nitrogen conditions | 13 |
| Seed Number (per plot), under low Nitrogen conditions | 14 |
| Total No of Spikes per plot, under low Nitrogen conditions | 15 |
| Total Leaf Area ($mm^2$) at TP4, under low Nitrogen conditions | 16 |
| Total No of tillers per plot, under low Nitrogen conditions | 17 |
| Spike total weight (per plot), under low Nitrogen conditions | 18 |
| Seed Yield (gr.), under normal conditions | 19 |
| Num Seeds, under normal conditions | 20 |
| Plant Height (cm) at TP2, under normal conditions | 21 |
| Num Spikes per plot, under normal conditions | 22 |
| Spike Length (cm), under normal conditions | 23 |
| Spike Width (cm), under normal conditions | 24 |
| Spike weight per plot (gr.), under normal conditions | 25 |
| Total Tillers per plot (number), under normal conditions | 26 |
| Root Length (cm), under normal conditions | 27 |
| Lateral Roots (number), under normal conditions | 28 |
| Root FW (gr.), under normal conditions | 29 |
| Num Tillers per plant, under normal growth conditions | 30 |
| SPAD, under normal conditions | 31 |
| Shoot FW (gr.), under normal conditions | 32 |
| Plant Height (cm) at TP1, under normal conditions | 33 |
| Num Leaves, under normal conditions | 34 |
| Leaf Area ($mm^2$), under normal conditions | 35 |
| Max Width (mm), under normal conditions | 36 |
| Max Length (mm), under normal conditions | 37 |

TP = time point;
Low N = Low Nitrogen.

Table 4. Provided are the barley correlated parameters.
DW = dry weight;
FW = fresh weight;

TABLE 5

Barley correlated parameters (vectors) under low nitrogen and normal conditions (set 2)

| Correlated parameter with | Correlation ID |
|---|---|
| Row number (number) | 1 |
| shoot/root ratio (ratio) | 2 |
| Spikes FW (Harvest) (gr.) | 3 |
| Spikes num (number) | 4 |
| Tillering (Harvest) (number) | 5 |
| Vegetative DW (Harvest) (gr.) | 6 |
| Grain area (cm$^2$) | 7 |
| Grain length (mm) | 8 |
| Grain Perimeter (mm) | 9 |
| Grain width (mm) | 10 |
| Grains DW/Shoots DW (ratio) | 11 |
| Grains per plot (number) | 12 |
| Grains weight per plant (gr.) | 13 |
| Grains weight per plot (gr.) | 14 |
| percent of reproductive tillers (%) | 15 |
| Plant Height (cm) | 16 |
| Roots DW (gr.) | 17 |

Table 5. Provided are the barley correlated parameters. "DW" = dry weight; "ratio" - maintenance of phenotypic performance under drought in comparison to under normal conditions.

TABLE 6

Barley correlated parameters (vectors) under drought conditions

| Correlated parameter with | Correlation ID |
|---|---|
| Harvest index | 1 |
| Dry weight vegetative growth (gr.) | 2 |
| Relative water content | 3 |
| Heading date | 4 |
| RBiH/BiH (root/shoot ratio, Formula 22 hereinabove) | 5 |
| Height Relative growth rate | 6 |
| SPAD Relative growth rate | 7 |
| Number of tillers Relative growth rate | 8 |
| Grain number | 9 |
| Grain weight (gr.) | 10 |
| Plant height T2 (cm) | 11 |
| Spike number per plant | 12 |
| Spike length (cm) | 13 |
| Spike width (cm) | 14 |
| Spike weight per plant (gr.) | 15 |
| Tillers number T2 (number) | 16 |
| Dry weight harvest (gr.) | 17 |
| Root dry weight (gr.) | 18 |
| Root length (cm) | 19 |
| Lateral root number (number) | 20 |
| Root fresh weight (gr.) | 21 |
| Tillers number T1 (number) | 22 |
| Chlorophyll levels | 23 |
| Plant height T1 (cm) | 24 |
| Fresh weight (gr.) | 25 |

Table 6. Provided are the barley correlated parameters.
"TP" = time point;
"DW" = dry weight;
"FW" = fresh weight;
"Low N" = Low Nitrogen;
"Normal" = regular growth conditions.
"Max" = maximum.

TABLE 7

Barley correlated parameters (vectors) for maintenance of performance under drought conditions

| Correlated parameter with | Correlation ID |
|---|---|
| Grain number (ratio) | 1 |
| Grain weight (ratio) | 2 |
| Plant height (ratio) | 3 |

TABLE 7-continued

Barley correlated parameters (vectors) for maintenance of performance under drought conditions

| Correlated parameter with | Correlation ID |
|---|---|
| Spike number (ratio) | 4 |
| Spike length (ratio) | 5 |
| Spike width (ratio) | 6 |
| Spike weight per plant (ratio) | 7 |
| Tillers number (ratio) | 8 |
| Dry weight at harvest (ratio) | 9 |
| Root dry weight (ratio) | 10 |
| Root length (ratio) | 11 |
| lateral root number (ratio) | 12 |
| Root fresh weight (ratio) | 13 |
| Chlorophyll levels (ratio) | 14 |
| Fresh weight (ratio) | 15 |
| Dry weightvegetative growth (ratio) | 16 |
| Relative water content (ratio) | 17 |
| Harvest index (ratio) | 18 |
| Heading date (ratio) | 19 |
| Root/shoot (ratio) | 20 |

Table 7. Provided are the barley correlated parameters.
"DW" = dry weight;
"ratio" - maintenance of phenotypic performance under drought in comparison to normal conditions.

Experimental Results 15 different Barley accessions were grown and characterized for different parameters as described above. The average for each of the measured parameter was calculated using the JMP software and values are summarized in Tables 8-17 below. Subsequent correlation analysis between the various transcriptome expression sets and the average parameters was conducted (Tables 18-21). Follow, results were integrated to the database.

TABLE 8

Measured parameters of correlation IDs in Barley accessions (set 1) under low N and normal conditions (see Table 4)

| Line/Corr. ID | Line-1 | Line-2 | Line-3 | Line-4 | Line-5 |
|---|---|---|---|---|---|
| 1 | 24.00 | 23.30 | 26.50 | 23.90 | 26.60 |
| 2 | 0.38 | 0.23 | 0.12 | 0.40 | 0.88 |
| 3 | 0.43 | 0.43 | 0.33 | 0.58 | 0.78 |
| 4 | 9.76 | 7.31 | 3.30 | 5.06 | 6.02 |
| 5 | 7.95 | 8.13 | 9.43 | 4.94 | 9.60 |
| 6 | 24.70 | 21.70 | 22.00 | 21.70 | 22.20 |
| 7 | 41.00 | 82.00 | 61.40 | 59.40 | 65.80 |
| 8 | 15.20 | 19.60 | 16.30 | 19.30 | 90.20 |
| 9 | 16.30 | 18.80 | 17.30 | 26.00 | 22.50 |
| 10 | 8.00 | 8.00 | 7.50 | 8.50 | 10.00 |
| 11 | 5.00 | 6.00 | 4.33 | 6.00 | 6.33 |
| 12 | 5.25 | 5.17 | 5.12 | 5.30 | 5.20 |
| 13 | 102.90 | 107.80 | 111.60 | 142.40 | 152.40 |
| 14 | 230.20 | 164.60 | 88.20 | 133.60 | 106.00 |
| 15 | 12.20 | 9.00 | 11.60 | 25.00 | 7.80 |
| 16 | 39.40 | 46.30 | 51.50 | 57.10 | 67.80 |
| 17 | 16.20 | 14.60 | 16.00 | 20.80 | 12.50 |
| 18 | 13.70 | 13.40 | 9.20 | 11.60 | 11.30 |
| 19 | 46.40 | 19.80 | 10.80 | 22.60 | 30.30 |
| 20 | 1090.00 | 510.00 | 242.00 | 582.00 | 621.00 |
| 21 | 64.70 | 84.00 | 67.40 | 82.00 | 72.00 |
| 22 | 41.50 | 32.00 | 36.00 | 71.40 | 34.20 |
| 23 | 16.50 | 19.20 | 18.30 | 20.40 | 17.20 |
| 24 | 9.54 | 9.05 | 8.25 | 6.55 | 10.50 |
| 25 | 69.40 | 39.40 | 34.90 | 50.30 | 60.80 |
| 26 | 46.70 | 41.60 | 40.00 | 48.80 | 34.60 |
| 27 | 21.30 | 15.00 | 21.80 | 20.30 | 27.20 |
| 28 | 7.00 | 8.67 | 8.33 | 9.67 | 10.70 |
| 29 | 0.27 | 0.27 | 0.25 | 0.35 | 0.62 |
| 30 | 2.00 | 2.00 | 1.00 | 2.33 | 2.33 |
| 31 | 39.10 | 41.40 | 35.20 | 33.70 | 34.20 |

TABLE 8-continued

Measured parameters of correlation IDs in Barley accessions (set 1) under low N and normal conditions (see Table 4)

| Line/Corr. ID | Line-1 | Line-2 | Line-3 | Line-4 | Line-5 |
|---|---|---|---|---|---|
| 32 | 2.17 | 1.90 | 1.25 | 3.00 | 15.60 |
| 33 | 39.20 | 37.00 | 36.80 | 49.80 | 46.80 |
| 34 | 24.20 | 18.20 | 22.70 | 25.50 | 23.20 |
| 35 | 294.0 | 199.0 | 273.0 | 276.0 | 313.0 |
| 36 | 5.77 | 5.45 | 5.80 | 6.03 | 4.63 |
| 37 | 502.0 | 348.0 | 499.0 | 594.0 | 535.0 |

Table 8. Provided are the values of each of the parameters (as described above) measured in Barley accessions (line) under low nitrogen and normal growth conditions. Growth conditions are specified in the experimental procedure section. "Corr ID" = correlation vector identification.

TABLE 9

Additional measured parameters of correlation IDs in Barley accessions (set 1) under low N and normal conditions (see Table 4)

| Line/Corr. ID | Line-6 | Line-7 | Line-8 | Line-9 | Line-10 |
|---|---|---|---|---|---|
| 1 | 23.20 | 25.40 | 24.20 | 25.00 | 26.10 |
| 2 | 0.50 | 0.43 | 0.32 | 0.30 | 0.55 |
| 3 | 0.53 | 0.45 | 0.43 | 0.50 | 0.62 |
| 4 | 9.74 | 7.35 | 5.80 | 7.83 | 6.29 |
| 5 | 7.16 | 7.06 | 8.51 | 10.01 | 9.40 |
| 6 | 23.00 | 30.50 | 22.80 | 23.80 | 24.50 |
| 7 | 47.80 | 53.80 | 56.40 | 81.80 | 44.60 |
| 8 | 16.40 | 20.40 | 18.80 | 18.80 | 16.60 |
| 9 | 18.20 | 19.70 | 19.80 | 19.20 | 19.20 |
| 10 | 11.50 | 8.60 | 6.33 | 7.50 | 10.00 |
| 11 | 6.00 | 6.67 | 4.67 | 5.67 | 7.33 |
| 12 | 5.33 | 5.32 | 5.10 | 5.15 | 5.10 |
| 13 | 149.30 | 124.10 | 95.00 | 124.10 | 135.20 |
| 14 | 222.60 | 219.20 | 143.40 | 201.80 | 125.00 |
| 15 | 14.50 | 15.00 | 7.00 | 5.40 | 8.40 |
| 16 | 64.20 | 52.40 | 46.20 | 68.00 | 57.90 |
| 17 | 18.80 | 21.20 | 11.00 | 6.80 | 14.00 |
| 18 | 15.10 | 12.20 | 10.90 | 12.20 | 10.60 |
| 19 | 54.10 | 37.00 | 42.00 | 35.40 | 38.30 |
| 20 | 1070.00 | 903.00 | 950.00 | 984.00 | 768.00 |
| 21 | 56.60 | 65.80 | 62.80 | 91.60 | 66.20 |
| 22 | 45.60 | 49.80 | 28.00 | 19.30 | 38.00 |
| 23 | 19.10 | 20.30 | 21.70 | 16.50 | 16.10 |
| 24 | 8.83 | 7.38 | 10.40 | 10.20 | 10.30 |
| 25 | 79.10 | 62.70 | 60.00 | 55.90 | 59.70 |
| 26 | 48.60 | 49.20 | 29.00 | 27.50 | 38.80 |
| 27 | 16.00 | 24.00 | 13.50 | 21.50 | 15.20 |
| 28 | 9.67 | 9.67 | 8.67 | 10.00 | 9.67 |
| 29 | 0.27 | 0.35 | 0.32 | 0.23 | 0.27 |
| 30 | 3.33 | 2.33 | 1.33 | 1.33 | 1.67 |
| 31 | 42.80 | 37.00 | 36.90 | 35.00 | 36.80 |
| 32 | 3.02 | 2.58 | 1.75 | 2.18 | 1.82 |
| 33 | 34.80 | 43.20 | 35.70 | 46.20 | 40.20 |
| 34 | 28.30 | 22.20 | 19.00 | 17.30 | 22.00 |
| 35 | 309.0 | 259.0 | 291.0 | 299.0 | 296.0 |
| 36 | 5.33 | 5.83 | 5.43 | 5.75 | 6.03 |
| 37 | 551.0 | 479.0 | 399.0 | 384.0 | 470.0 |

Table 9. Provided are the values of each of the parameters (as described above) measured in Barley accessions (line) under low nitrogen and normal growth conditions. Growth conditions are specified in the experimental procedure section. "Corr ID" = correlation vector identification.

TABLE 10

Measured parameters of correlation IDs in Barley accessions under normal conditions (set 2)

| Line/Corr. ID | Line-1 | Line-2 | Line-3 | Line-4 | Line-5 | Line-6 | Line-7 | Line-8 |
|---|---|---|---|---|---|---|---|---|
| 1 | 6.00 | 6.00 | 6.00 | 6.00 | 6.00 | 2.80 | 6.00 | 2.00 |
| 2 | 1.48 | 0.64 | 0.84 | 0.82 | 1.15 | 0.69 | 1.26 | 0.72 |
| 3 | 69.80 | 39.90 | 69.40 | 59.70 | 60.80 | 79.10 | 63.50 | 62.70 |
| 4 | 38.60 | 32.00 | 41.50 | 38.00 | 34.20 | 45.60 | 30.00 | 49.80 |
| 5 | 44.20 | 41.60 | 46.70 | 38.80 | 34.60 | 48.60 | 32.40 | 55.20 |
| 6 | 89.20 | 99.70 | 45.80 | 49.40 | 74.30 | 55.10 | 47.30 | 60.30 |
| 7 | 0.25 | 0.24 | 0.24 | 0.23 | 0.24 | 0.25 | 0.24 | 0.22 |
| 8 | 0.89 | 0.87 | 0.86 | 0.80 | 0.83 | 0.78 | 0.90 | 0.72 |
| 9 | 2.24 | 2.24 | 2.18 | 2.05 | 2.08 | 2.03 | 2.25 | 1.88 |
| 10 | 0.352 | 0.350 | 0.350 | 0.369 | 0.365 | 0.406 | 0.346 | 0.387 |
| 11 | 0.40 | 0.16 | 1.01 | 0.79 | 0.41 | 0.99 | 0.67 | 0.61 |
| 12 | 683.40 | 510.50 | 1093.50 | 767.60 | 621.00 | 1069.00 | 987.80 | 903.20 |
| 13 | 6.65 | 3.96 | 9.27 | 7.65 | 6.06 | 10.83 | 7.94 | 7.40 |
| 14 | 33.20 | 19.80 | 46.40 | 38.30 | 30.30 | 54.10 | 39.70 | 37.00 |
| 15 | 82.30 | 77.70 | 86.70 | 94.20 | 89.70 | 93.70 | 89.50 | 90.30 |
| 16 | 76.40 | 84.00 | 64.70 | 66.20 | 72.00 | 56.60 | 68.00 | 65.80 |
| 17 | 118.30 | 150.70 | 86.30 | 85.20 | 120.30 | 90.70 | 40.60 | 90.50 |

Table 10. Provided are the values of each of the parameters (as described above) measured in Barley accessions (line) under normal growth conditions. Growth conditions are specified in the experimental procedure section. "Corr ID" = correlation vector identification.

TABLE 11

Additional measured parameters of correlation IDs in Barley accessions under normal conditions (set 2)

| Line/Corr. ID | Line-9 | Line-10 | Line-11 | Line-12 | Line-13 | Line-14 | Line-15 |
|---|---|---|---|---|---|---|---|
| 1 | 2 | 5.2 | 6 | 6 | 6 | 4.67 | 4 |
| 2 | 1.169 | 0.707 | 0.38 | 0.511 | 2.161 | 0.666 | 0.395 |

TABLE 11-continued

Additional measured parameters of correlation IDs in Barley accessions under normal conditions (set 2)

| Line/Corr. ID | Line-9 | Line-10 | Line-11 | Line-12 | Line-13 | Line-14 | Line-15 |
|---|---|---|---|---|---|---|---|
| 3 | 50.3 | 60 | 34.9 | 60.1 | 55.9 | 16.9 | 21.7 |
| 4 | 71.4 | 28 | 36 | 27.6 | 23.6 | 54.7 | 48 |
| 5 | 50.6 | 29 | 40 | 28.5 | 27.5 | 26 | |
| 6 | 88 | 38.9 | 97.7 | 48.3 | 62.5 | 58 | 72.8 |
| 7 | 0.232 | 0.223 | 0.235 | 0.213 | 0.177 | 0.191 | 0.174 |
| 8 | 0.823 | 0.794 | 0.797 | 0.799 | 0.65 | 0.824 | 0.773 |
| 9 | 2.09 | 2.03 | 2.02 | 1.98 | 1.69 | 1.98 | 1.89 |
| 10 | 0.359 | 0.356 | 0.374 | 0.337 | 0.346 | 0.294 | 0.287 |
| 11 | 0.282 | 1.037 | 0.116 | 0.859 | 0.576 | 0.05 | 0.079 |
| 12 | 581.8 | 904.4 | 242.4 | 928.4 | 984.2 | 157.7 | 263.2 |
| 13 | 4.52 | 8.41 | 2 | 8.05 | 7.07 | 0.75 | 1.14 |
| 14 | 22.6 | 39.7 | 10.8 | 40.3 | 35.4 | 3.7 | 5.7 |
| 15 | 91.2 | 92.5 | 91.7 | 85.3 | | | |
| 16 | 82 | 62.8 | 67.4 | 76.2 | 91.6 | 44 | 52.8 |
| 17 | 92.6 | 64 | 286.6 | 95.8 | 34 | 121.3 | 206.8 |

Table 11: Provided are the values of each of the parameters (as described above) measured in Barley accessions (line) under normal growth conditions. Growth conditions are specified in the experimental procedure section. "Corr ID" = correlation vector identification.

TABLE 12

Measured parameters of correlation IDs in Barley accessions) under low nitrogen conditions (set 2)

| Line/Corr. ID | Line-1 | Line-2 | Line-3 | Line-4 | Line-5 | Line-6 | Line-7 | Line-8 |
|---|---|---|---|---|---|---|---|---|
| 1 | 6.00 | 6.00 | 6.00 | 6.00 | 6.00 | 2.00 | 6.00 | 2.00 |
| 2 | 0.69 | 1.08 | 0.77 | 0.38 | 0.83 | 0.42 | 0.29 | 0.57 |
| 3 | 11.40 | 13.40 | 13.70 | 10.60 | 11.30 | 15.10 | 11.60 | 12.20 |
| 4 | 10.80 | 9.00 | 12.20 | 8.40 | 7.80 | 14.50 | 8.40 | 15.00 |
| 5 | 16.00 | 14.60 | 16.20 | 14.00 | 12.50 | 18.80 | 11.60 | 21.20 |
| 6 | 17.40 | 17.80 | 8.20 | 7.30 | 13.20 | 11.30 | 8.90 | 14.20 |
| 7 | 0.250 | 0.251 | 0.255 | 0.235 | 0.249 | 0.227 | 0.227 | 0.205 |
| 8 | 0.90 | 0.92 | 0.93 | 0.82 | 0.86 | 0.76 | 0.83 | 0.74 |
| 9 | 2.28 | 2.33 | 2.28 | 2.08 | 2.13 | 1.96 | 2.09 | 1.88 |
| 10 | 0.351 | 0.346 | 0.349 | 0.364 | 0.366 | 0.381 | 0.347 | 0.355 |
| 11 | 0.39 | 0.42 | 1.25 | 0.69 | 0.43 | 0.87 | 0.77 | 0.53 |
| 12 | 153.20 | 164.60 | 230.20 | 125.00 | 100.00 | 222.60 | 159.40 | 219.20 |
| 13 | 1.34 | 1.46 | 1.95 | 1.26 | 1.13 | 1.95 | 1.28 | 1.47 |
| 14 | 6.68 | 7.31 | 9.76 | 6.29 | 5.67 | 9.74 | 6.40 | 7.35 |
| 15 | 68.70 | 61.80 | 76.90 | 59.60 | 65.60 | 79.80 | 73.80 | 71.00 |
| 16 | 75.20 | 82.00 | 41.00 | 44.60 | 65.80 | 47.80 | 60.60 | 53.80 |
| 17 | 39.90 | 26.20 | 17.30 | 32.90 | 33.90 | 83.80 | 29.60 | 37.20 |

Table 12: Provided are the values of each of the parameters (as described above) measured in Barley accessions (line) under low N growth conditions. Growth conditions are specified in the experimental procedure section. "Corr ID" = correlation vector identification.

TABLE 13

Additional measured parameters of correlation IDs in Barley accessions) under low nitrogen conditions (set 2)

| Line/Corr. ID | Line-9 | Line-10 | Line-11 | Line-12 | Line-13 | Line-14 | Line-15 |
|---|---|---|---|---|---|---|---|
| 1 | 2.00 | 5.20 | 6.00 | 6.00 | 6.00 | 2.00 | 2.00 |
| 2 | 0.60 | 0.55 | 2.88 | 1.36 | 0.89 | 2.49 | 0.40 |
| 3 | 11.60 | 8.80 | 9.20 | 12.40 | 12.20 | 5.70 | 5.00 |
| 4 | 25.00 | 7.00 | 11.60 | 7.60 | 5.40 | 16.40 | 12.00 |
| 5 | 23.50 | 11.00 | 16.00 | 10.80 | 6.80 | 35.00 | |
| 6 | 15.70 | 6.40 | 55.90 | 11.50 | 10.90 | 58.90 | 17.10 |
| 7 | 0.24 | 0.20 | 0.22 | 0.23 | 0.19 | 0.19 | 0.17 |
| 8 | 0.86 | 0.73 | 0.81 | 0.85 | 0.68 | 0.81 | 0.79 |
| 9 | 2.19 | 1.88 | 2.03 | 2.11 | 1.77 | 2.00 | 1.90 |
| 10 | 0.345 | 0.349 | 0.348 | 0.348 | 0.360 | 0.295 | 0.275 |

TABLE 13-continued

Additional measured parameters of correlation IDs in Barley accessions) under low nitrogen conditions (set 2)

| Line/Corr. ID | Line-9 | Line-10 | Line-11 | Line-12 | Line-13 | Line-14 | Line-15 |
|---|---|---|---|---|---|---|---|
| 11 | 0.34 | 0.87 | 0.15 | 0.58 | 0.76 | 0.05 | 0.07 |
| 12 | 133.60 | 134.40 | 88.20 | 174.20 | 201.80 | 86.70 | 61.60 |
| 13 | 0.98 | 1.16 | 0.92 | 1.33 | 1.57 | 0.29 | 0.22 |
| 14 | 5.06 | 5.43 | 4.62 | 6.67 | 7.83 | 1.44 | 1.12 |
| 15 | 95.80 | 64.90 | 68.80 | 74.20 | 81.40 | 37.10 | |
| 16 | 59.40 | 56.40 | 61.40 | 65.60 | 81.80 | 69.00 | 57.40 |
| 17 | 44.40 | 14.50 | 41.50 | 23.70 | 20.90 | 49.70 | 54.00 |

Table 13: Provided are the values of each of the parameters (as described above) measured in Barley accessions (line) under low N growth conditions. Growth conditions are specified in the experimental procedure section. "Corr ID" = correlation vector identification.

TABLE 14

Measured parameters of correlation IDs in Barley accessions (1-8) under drought and recovery conditions

| Line/Corr. ID | Line-1 | Line-2 | Line-3 | Line-4 | Line-5 | Line-6 | Line-7 | Line-8 |
|---|---|---|---|---|---|---|---|---|
| 1 | 0.47 | 0.66 | 0.53 | 0.69 | 0.53 | 0.69 | 0.69 | 0.75 |
| 2 | 0.22 | 0.21 | | | | 0.17 | | |
| 3 | 80.60 | 53.40 | 55.90 | | 43.20 | 69.80 | 45.50 | 76.50 |
| 4 | 75.00 | 71.00 | 65.00 | | 66.80 | 90.00 | 90.00 | |
| 5 | 0.013 | 0.012 | 0.008 | 0.006 | 0.025 | 0.020 | 0.008 | 0.008 |
| 6 | 0.27 | 0.86 | 0.73 | 0.88 | 0.40 | 0.94 | 0.70 | 0.71 |
| 7 | 0.087 | −0.123 | 0.001 | 0.010 | 0.037 | −0.072 | 0.013 | 0.003 |
| 8 | 0.07 | 0.10 | 0.06 | 0.07 | 0.16 | 0.06 | 0.10 | 0.05 |
| 9 | 170.00 | 267.50 | 111.00 | 205.30 | 153.60 | 252.50 | 288.40 | 274.50 |
| 10 | 5.55 | 9.80 | 3.55 | 7.20 | 5.28 | 7.75 | 9.92 | 10.25 |
| 11 | 46.00 | 52.80 | 35.00 | 38.00 | 45.20 | 48.00 | 37.70 | 41.20 |
| 12 | 4.20 | 4.36 | 7.60 | 8.44 | 4.92 | 3.43 | 6.90 | 5.80 |
| 13 | 16.70 | 16.80 | 13.30 | 13.50 | 14.20 | 15.60 | 15.70 | 17.50 |
| 14 | 8.64 | 9.07 | 7.82 | 7.32 | 8.74 | 7.62 | 6.98 | 8.05 |
| 15 | 17.70 | 24.20 | 18.20 | 18.00 | 19.50 | 15.00 | 23.40 | 28.20 |
| 16 | 11.70 | 9.00 | 10.90 | 10.20 | 10.30 | 8.80 | 13.00 | 7.40 |
| 17 | 6.15 | 5.05 | 3.20 | 3.28 | 4.76 | 3.55 | 4.52 | 3.38 |
| 18 | 77.50 | 60.20 | 27.10 | 18.60 | 117.40 | 70.70 | 37.30 | 25.60 |
| 19 | 21.70 | 20.30 | 22.00 | 24.00 | 20.70 | 18.30 | 21.00 | 20.30 |
| 20 | 8.33 | 8.67 | 7.33 | 7.67 | 6.67 | 6.67 | 7.67 | 6.67 |
| 21 | 2.07 | 1.48 | 1.12 | 1.87 | 1.67 | 1.68 | 1.62 | 0.85 |
| 22 | 2.00 | 2.00 | 1.67 | 1.67 | 2.00 | 1.67 | 2.33 | 1.00 |
| 23 | 41.30 | 33.60 | 36.60 | 40.50 | 45.10 | 39.70 | 38.30 | 36.20 |
| 24 | 33.30 | 27.00 | 31.30 | 34.20 | 31.30 | 30.30 | 28.70 | 38.70 |
| 25 | 1.90 | 1.52 | 1.17 | 1.95 | 1.90 | 1.22 | 1.75 | 1.58 |

Table 14: Provided are the values of each of the parameters (as described above) measured in Barley accessions (line) under drought and recovery growth conditions. Growth conditions are specified in the experimental procedure section.
"Corr ID" = correlation vector identification.

TABLE 15

Measured parameters of correlation IDs in Barley accessions under drought and recovery conditions additional lines (9-15)

| Line/Corr. ID | Line-9 | Line-10 | Line-11 | Line-12 | Line-13 | Line-14 | Line-15 |
|---|---|---|---|---|---|---|---|
| 1 | 0.60 | 0.81 | 0.87 | 0.29 | 0.44 | 0.78 | 0.41 |
| 2 | 0.25 | | | 0.13 | 0.19 | 0.22 | |
| 3 | 87.40 | | | 58.30 | 80.60 | 73.10 | |
| 4 | 90.00 | | | 90.00 | 81.60 | 90.00 | |
| 5 | 0.012 | 0.007 | 0.016 | 0.023 | 0.012 | 0.012 | 0.026 |
| 6 | 0.77 | 0.80 | 0.92 | 0.39 | 0.88 | −0.13 | 0.20 |
| 7 | −0.063 | 0.035 | 0.050 | −0.004 | −0.072 | 0.025 | −0.063 |
| 8 | 0.10 | 0.06 | 0.06 | 0.18 | 0.15 | 0.02 | 0.44 |
| 9 | 348.50 | 358.00 | 521.40 | 71.50 | 160.10 | 376.70 | 105.00 |
| 10 | 8.50 | 14.03 | 17.52 | 2.05 | 5.38 | 11.00 | 2.56 |

TABLE 15-continued

Measured parameters of correlation IDs in Barley accessions under drought and recovery conditions additional lines (9-15)

| Line/Corr. ID | Line-9 | Line-10 | Line-11 | Line-12 | Line-13 | Line-14 | Line-15 |
|---|---|---|---|---|---|---|---|
| 11 | 40.80 | 49.90 | 43.00 | 47.40 | 64.80 | 52.60 | 32.00 |
| 12 | 8.55 | 9.67 | 5.42 | 3.05 | 4.07 | 3.72 | 3.21 |
| 13 | 16.00 | 18.30 | 17.40 | 14.20 | 14.80 | 16.50 | 12.70 |
| 14 | 6.06 | 6.72 | 9.55 | 7.84 | 7.81 | 8.35 | 5.47 |
| 15 | 22.00 | 33.00 | 34.80 | 11.70 | 18.80 | 21.00 | 9.90 |
| 16 | 13.90 | 11.00 | 6.80 | 8.40 | 9.20 | 5.10 | 16.10 |
| 17 | 5.67 | 3.31 | 2.65 | 5.12 | 6.86 | 3.11 | 3.74 |
| 18 | 66.20 | 22.10 | 41.10 | 117.00 | 84.10 | 37.50 | 98.90 |
| 19 | 21.70 | 19.70 | 16.70 | 17.00 | 15.20 | 27.00 | 15.00 |
| 20 | 6.00 | 8.67 | 7.67 | 6.33 | 7.00 | 7.00 | 6.67 |
| 21 | 1.45 | 1.38 | 0.82 | 0.58 | 0.63 | 1.07 | 0.70 |
| 22 | 2.33 | 3.00 | 1.00 | 1.00 | 1.00 | 1.00 | 1.00 |
| 23 | 42.10 | 31.80 | 33.50 | 42.40 | 42.30 | 36.80 | 40.60 |
| 24 | 33.70 | 28.40 | 27.50 | 25.00 | 27.00 | 31.00 | 22.30 |
| 25 | 1.88 | 1.73 | 1.00 | 0.90 | 0.90 | 1.43 | 0.83 |

Table 15: Provided are the values of each of the parameters (as described above) measured in Barley accessions (line) under drought and recovery growth conditions. Growth conditions are specified in the experimental procedure section.
"Corr ID" = correlation vector identification.

TABLE 16

Measured parameters of correlation IDs in Barley accessions for maintenance of performance under drought conditions

| Line/Corr. ID | Line-1 | Line-2 | Line-3 | Line-4 | Line-5 | Line-6 | Line-7 | Line-8 |
|---|---|---|---|---|---|---|---|---|
| 1 | 0.12 | 0.22 | 0.11 | 0.19 | 0.17 | 0.21 | 0.22 | 0.24 |
| 2 | 0.08 | 0.17 | 0.06 | 0.14 | 0.15 | 0.14 | 0.15 | 0.20 |
| 3 | 0.51 | 0.61 | 0.67 | 0.72 | 0.61 | 0.59 | 0.70 | 0.63 |
| 3 | 0.51 | 0.61 | 0.67 | 0.72 | 0.61 | 0.59 | 0.70 | 0.63 |
| 4 | 0.73 | 0.96 | 1.11 | 1.30 | 0.83 | 0.62 | 0.87 | 1.12 |
| 5 | 0.83 | 0.82 | 0.86 | 0.77 | 0.78 | 0.94 | 0.83 | 0.89 |
| 6 | 0.75 | 0.77 | 0.68 | 0.67 | 0.87 | 0.66 | 0.75 | 0.74 |
| 7 | 0.16 | 0.23 | 0.19 | 0.23 | 0.25 | 0.18 | 0.23 | 0.34 |
| 8 | 1.87 | 1.57 | 1.72 | 1.80 | 1.60 | 1.61 | 1.63 | 1.59 |
| 8 | 1.87 | 1.57 | 1.72 | 1.80 | 1.60 | 1.61 | 1.63 | 1.59 |
| 9 | 0.61 | 0.45 | 0.59 | 0.67 | 0.41 | 0.54 | 0.75 | 0.65 |
| 10 | 0.94 | 0.44 | 0.66 | 0.37 | 0.71 | 1.06 | 0.50 | 0.62 |
| 11 | 0.66 | 0.74 | 1.16 | 0.78 | 0.76 | 0.76 | 0.68 | 0.77 |
| 12 | 1.09 | 0.74 | 0.79 | 0.88 | 0.71 | 0.65 | 0.85 | 0.77 |
| 13 | 1.10 | 1.00 | 1.02 | 1.67 | 0.80 | 0.81 | 1.13 | 0.34 |
| 14 | 0.98 | 0.72 | 1.30 | 1.06 | 1.03 | 0.95 | 0.82 | 0.93 |
| 15 | 0.60 | 0.50 | 0.47 | 0.68 | 0.46 | 0.47 | 0.58 | 0.62 |
| 16 | 0.93 | 0.71 | 0.00 | 0.00 | 0.00 | 0.65 | 0.00 | 0.92 |
| 17 | 0.78 | 0.58 | 0.90 | 0.00 | 0.65 | 0.56 | 0.78 | 0.83 |
| 18 | 0.54 | 0.79 | 0.58 | 0.75 | 0.70 | 0.77 | 0.75 | 0.83 |
| 19 | 0.00 | 1.12 | 1.30 | 0.00 | 1.00 | 1.06 | 1.37 | 1.22 |
| 20 | 1.55 | 0.97 | 1.12 | 0.56 | 1.72 | 1.97 | 0.67 | 0.96 |

Table 16: Provided are the values of each of the parameters (as described above) measured in Barley accessions (line) for maintenance of performance under drought (calculated as % of change under drought vs. normal growth conditions). Growth conditions are specified in the experimental procedure section.
"Corr ID" = correlation vector identification.

TABLE 17

Additional measured parameters of correlation IDs in Barley accessions for maintenance of performance under drought conditions

| Line/Corr. ID | Line-9 | Line-10 | Line-11 | Line-12 | Line-13 | Line-14 | Line-15 |
|---|---|---|---|---|---|---|---|
| 1 | 0.25 | 0.58 | 0.43 | 0.10 | 0.10 | 0.28 | 0.43 |
| 2 | 0.14 | 0.47 | 0.32 | 0.07 | 0.07 | 0.20 | 0.32 |
| 3 | 0.66 | 0.87 | 0.86 | 0.64 | 0.79 | 0.56 | 0.51 |
| 3 | 0.66 | 0.87 | 0.86 | 0.64 | 0.79 | 0.56 | 0.51 |
| 4 | 1.09 | 1.09 | 0.92 | 0.49 | 0.65 | 0.99 | 0.52 |
| 5 | 0.78 | 0.94 | 0.88 | 0.77 | 0.86 | 0.97 | 0.78 |
| 6 | 0.74 | 0.86 | 0.85 | 0.79 | 0.72 | 0.72 | 0.88 |
| 7 | 0.22 | 0.68 | 0.55 | 0.18 | 0.18 | 0.27 | 0.25 |
| 8 | 1.75 | 1.33 | 1.62 | 1.33 | 1.40 | 1.22 | 1.96 |
| 8 | 1.75 | 1.33 | 1.62 | 1.33 | 1.40 | 1.22 | 1.96 |
| 9 | 0.77 | 0.80 | 0.68 | 0.42 | 0.65 | 0.52 | 0.46 |
| 10 | 0.88 | 0.87 | 0.94 | 0.77 | 0.85 | 1.06 | 0.68 |

TABLE 17-continued

Additional measured parameters of correlation IDs in Barley accessions for maintenance of performance under drought conditions

| Line/Corr. ID | Line-9 | Line-10 | Line-11 | Line-12 | Line-13 | Line-14 | Line-15 |
|---|---|---|---|---|---|---|---|
| 11 | 1.12 | 0.56 | 0.42 | 0.82 | 0.43 | 0.71 | 0.80 |
| 12 | 0.58 | 0.96 | 0.88 | 0.95 | 0.78 | 0.66 | 0.87 |
| 13 | 0.85 | 0.58 | 0.07 | 1.06 | 0.30 | 0.44 | 0.93 |
| 14 | 0.93 | 0.80 | 0.94 | 0.96 | 1.01 | 0.93 | 1.03 |
| 15 | 0.74 |  | 0.81 | 0.72 | 0.37 | 0.40 |  |
| 16 | 1.01 | 0.00 | 0.00 | 0.94 | 0.00 | 0.70 | 0.00 |
| 17 | 0.50 |  | 0.00 | 0.00 | 0.78 | 0.55 |  |
| 18 | 0.67 | 0.92 | 0.93 | 0.41 | 0.50 | 0.87 | 0.82 |
| 19 | 0.00 |  |  | 1.20 | 1.00 |  |  |
| 20 | 1.14 | 1.08 | 1.38 | 1.84 | 1.31 | 2.06 | 1.46 |

Table 17: Provided are the values of each of the parameters (as described above) measured in Barley accessions (line) for maintenance of performance under drought (calculated as % of change under drought vs. normal growth conditions). Growth conditions are specified in the experimental procedure section.
"Corr ID" = correlation vector identification.

TABLE 18

Correlation between the expression level of selected genes of some embodiments of the invention in various tissues and the phenotypic performance under low nitrogen and normal conditions across Barley accessions (set 1)

| Gene Name | R | P value | Exp. set | Corr. ID | Gene Name | R | P value | Exp. set | Corr. ID |
|---|---|---|---|---|---|---|---|---|---|
| LBY235 | 0.80 | 1.77E−02 | 6 | 34 | LBY235 | 0.83 | 9.90E−03 | 6 | 30 |
| LBY236 | 0.85 | 7.71E−03 | 4 | 24 | LBY237 | 0.72 | 4.22E−02 | 6 | 31 |
| LBY237 | 0.71 | 3.17E−02 | 2 | 20 | LBY237 | 0.70 | 3.48E−02 | 2 | 19 |
| LBY240 | 0.76 | 1.68E−02 | 1 | 15 | LBY240 | 0.70 | 3.48E−02 | 2 | 20 |
| LBY242 | 0.76 | 1.85E−02 | 3 | 9 | LBY261 | 0.78 | 2.15E−02 | 6 | 35 |
| LBY261 | 0.73 | 3.92E−02 | 4 | 31 | LBY261 | 0.70 | 3.48E−02 | 2 | 20 |
| LBY261 | 0.83 | 5.72E−03 | 2 | 31 | LBY261 | 0.73 | 2.68E−02 | 2 | 19 |
| LBY262 | 0.78 | 2.23E−02 | 6 | 29 | LBY262 | 0.77 | 2.43E−02 | 6 | 24 |
| LBY263 | 0.71 | 3.04E−02 | 1 | 9 | LBY263 | 0.90 | 3.97E−04 | 5 | 3 |
| LBY263 | 0.80 | 4.97E−03 | 5 | 2 | LBY263 | 0.90 | 4.46E−04 | 5 | 8 |
| LBY263 | 0.76 | 1.64E−02 | 2 | 21 | LBY289 | 0.74 | 2.32E−02 | 1 | 3 |
| LBY289 | 0.76 | 1.78E−02 | 1 | 2 | LBY289 | 0.88 | 1.71E−03 | 1 | 8 |
| LBY312 | 0.74 | 3.68E−02 | 6 | 21 | LBY363 | 0.75 | 3.39E−02 | 4 | 37 |
| LBY364 | 0.71 | 4.66E−02 | 6 | 31 | LBY364 | 0.72 | 2.80E−02 | 1 | 5 |
| LBY364 | 0.80 | 1.62E−02 | 4 | 30 | LBY364 | 0.73 | 2.65E−02 | 2 | 31 |
| LBY408 | 0.70 | 5.31E−02 | 6 | 36 | LBY408 | 0.73 | 4.15E−02 | 6 | 33 |
| LBY408 | 0.75 | 3.09E−02 | 4 | 22 | LBY408 | 0.79 | 2.05E−02 | 4 | 20 |
| LBY408 | 0.76 | 2.87E−02 | 4 | 19 | LBY408 | 0.74 | 1.36E−02 | 5 | 10 |
| LBY408 | 0.72 | 2.85E−02 | 3 | 2 | MGP46 | 0.82 | 7.20E−03 | 1 | 2 |
| MGP46 | 0.77 | 1.43E−02 | 1 | 3 | MGP46 | 0.86 | 6.50E−03 | 4 | 32 |
| MGP46 | 0.71 | 4.72E−02 | 4 | 28 | MGP46 | 0.78 | 2.36E−02 | 4 | 27 |
| MGP46 | 0.89 | 2.70E−03 | 4 | 29 | MGP46 | 0.81 | 8.66E−03 | 2 | 30 |
| MGP46 | 0.93 | 6.68E−04 | 4 | 33 | MGP46 | 0.76 | 1.71E−02 | 3 | 10 |
| MGP46 | 0.79 | 1.16E−02 | 3 | 3 | MGP46 | 0.78 | 1.32E−02 | 3 | 8 |
| MGP46 | 0.87 | 2.31E−03 | 3 | 2 | MGP62 | 0.74 | 2.24E−02 | 1 | 10 |
| MGP47 | 0.71 | 4.65E−02 | 4 | 23 | MGP91 | 0.85 | 7.52E−03 | 6 | 32 |
| MGP62 | 0.82 | 7.14E−03 | 2 | 26 | MGP91 | 0.82 | 6.89E−03 | 3 | 1 |
| MGP91 | 0.81 | 1.40E−02 | 6 | 30 | MGP91 | 0.80 | 9.05E−03 | 3 | 8 |
| MGP91 | 0.74 | 2.31E−02 | 3 | 9 | MGP91 | 0.93 | 3.12E−04 | 3 | 15 |
| MGP91 | 0.72 | 2.87E−02 | 3 | 17 |  |  |  |  |  |

Table 18: Provided are the correlations (R) between the expression levels of the genes of some embodiments of the invention and their homologs in various tissues [Expression (Exp) set 1, Table 1] and the phenotypic performance (yield, biomass, growth rate and/or vigor components) according to the Correlation (corr.) vectors specified in Table 4 under normal and low nitrogen conditions across barley varieties.
P = p value.

TABLE 19

Correlation between the expression level of selected genes of some embodiments of the invention in various tissues and the phenotypic performance under low nitrogen and normal growth conditions across Barley accessions (set 2)

| Gene Name | R | P value | Exp. set | Corr. ID | Gene Name | R | P value | Exp. set | Corr. ID |
|---|---|---|---|---|---|---|---|---|---|
| LBY235 | 0.76 | 1.11E−02 | 5 | 16 | LBY235 | 0.78 | 8.40E−03 | 1 | 16 |
| LBY236 | 0.72 | 1.94E−02 | 6 | 17 | LBY236 | 0.76 | 1.13E−02 | 6 | 6 |
| LBY238 | 0.70 | 2.41E−02 | 2 | 2 | LBY238 | 0.73 | 1.63E−02 | 2 | 16 |
| LBY238 | 0.74 | 1.52E−02 | 3 | 13 | LBY238 | 0.85 | 1.71E−03 | 3 | 12 |
| LBY238 | 0.75 | 1.31E−02 | 3 | 3 | LBY238 | 0.75 | 1.22E−02 | 3 | 14 |
| LBY238 | 0.75 | 1.33E−02 | 6 | 4 | LBY238 | 0.74 | 1.52E−02 | 6 | 6 |

TABLE 19-continued

Correlation between the expression level of selected genes of some embodiments of the invention in various tissues and the phenotypic performance under low nitrogen and normal growth conditions across Barley accessions (set 2)

| Gene Name | R | P value | Exp. set | Corr. ID | Gene Name | R | P value | Exp. set | Corr. ID |
|---|---|---|---|---|---|---|---|---|---|
| LBY238 | 0.80 | 5.24E−03 | 5 | 5 | LBY238 | 0.82 | 3.49E−03 | 5 | 4 |
| LBY238 | 0.71 | 2.14E−02 | 4 | 2 | LBY238 | 0.88 | 9.01E−04 | 1 | 16 |
| LBY240 | 0.86 | 1.24E−03 | 6 | 4 | LBY240 | 0.77 | 9.47E−03 | 5 | 5 |
| LBY240 | 0.83 | 3.25E−03 | 5 | 4 | LBY240 | 0.82 | 3.80E−03 | 1 | 2 |
| LBY242 | 0.71 | 2.02E−02 | 2 | 12 | LBY261 | 0.87 | 1.17E−03 | 3 | 17 |
| LBY261 | 0.75 | 1.22E−02 | 3 | 10 | LBY261 | 0.73 | 1.60E−02 | 5 | 2 |
| LBY262 | 0.72 | 1.79E−02 | 4 | 4 | LBY263 | 0.74 | 1.35E−02 | 2 | 4 |
| LBY289 | 0.82 | 3.72E−03 | 5 | 2 | LBY289 | 0.72 | 1.98E−02 | 4 | 10 |
| LBY312 | 0.77 | 8.88E−03 | 2 | 3 | LBY312 | 0.75 | 1.33E−02 | 3 | 5 |
| LBY312 | 0.76 | 1.13E−02 | 4 | 13 | LBY312 | 0.71 | 2.14E−02 | 4 | 11 |
| LBY312 | 0.74 | 1.41E−02 | 4 | 3 | LBY312 | 0.74 | 1.48E−02 | 4 | 14 |
| LBY363 | 0.71 | 2.13E−02 | 4 | 4 | LBY364 | 0.76 | 1.06E−02 | 3 | 13 |
| LBY364 | 0.72 | 1.84E−02 | 3 | 3 | LBY364 | 0.76 | 1.02E−02 | 3 | 14 |
| LBY364 | 0.77 | 8.51E−03 | 3 | 10 | LBY364 | 0.85 | 1.95E−03 | 5 | 13 |
| LBY364 | 0.81 | 4.82E−03 | 5 | 3 | LBY364 | 0.87 | 1.10E−03 | 5 | 14 |
| LBY364 | 0.85 | 1.73E−03 | 1 | 3 | LBY408 | 0.78 | 7.59E−03 | 3 | 5 |
| LBY408 | 0.79 | 6.23E−03 | 1 | 15 | MGP45 | 0.78 | 8.22E−03 | 2 | 14 |
| MGP45 | 0.75 | 1.27E−02 | 2 | 13 | MGP46 | 0.72 | 1.90E−02 | 2 | 7 |
| MGP45 | 0.90 | 3.26E−04 | 1 | 15 | MGP46 | 0.70 | 2.42E−02 | 4 | 8 |
| MGP46 | 0.79 | 7.13E−03 | 2 | 4 | MGP47 | 0.71 | 2.20E−02 | 2 | 12 |
| MGP46 | 0.72 | 1.97E−02 | 4 | 9 | MGP47 | 0.70 | 2.37E−02 | 6 | 6 |
| MGP47 | 0.75 | 1.20E−02 | 3 | 17 | MGP47 | 0.89 | 5.16E−04 | 5 | 4 |
| MGP47 | 0.79 | 6.11E−03 | 5 | 5 | MGP62 | 0.72 | 1.95E−02 | 2 | 12 |
| MGP47 | 0.71 | 2.16E−02 | 4 | 4 | MGP91 | 0.79 | 6.56E−03 | 5 | 5 |
| MGP91 | 0.76 | 1.09E−02 | 2 | 4 | MGP91 | 0.85 | 3.58E−03 | 4 | 15 |
| MGP91 | 0.72 | 1.98E−02 | 5 | 4 | | | | | |

Table 19: Correlations (R) between the expression levels of the genes of some embodiments of the invention and their homologs in various tissues (expression set 2, Table 2) and the phenotypic performance (yield, biomass, growth rate and/or vigor components) according to the Correlation (corr.) vectors specified in Table 5 under normal and low nitrogen conditions across barley varieties.
"Exp. Set"— Expression set.
"R" = Pearson correlation coefficient;
"P" = p value.

TABLE 20

Correlation between the expression level of selected genes of some embodiments of the invention in various tissues and the phenotypic performance under drought stress conditions across Barley accessions

| Gene Name | R | P value | Exp. set | Corr. ID | Gene Name | R | P value | Exp. set | Corr. ID |
|---|---|---|---|---|---|---|---|---|---|
| LBY235 | 0.83 | 4.03E−02 | 1 | 11 | LBY235 | 0.87 | 2.44E−02 | 1 | 15 |
| LBY235 | 0.88 | 1.92E−02 | 1 | 13 | LBY235 | 0.70 | 1.18E−01 | 1 | 10 |
| LBY235 | 0.80 | 1.60E−02 | 3 | 17 | LBY235 | 0.75 | 3.25E−02 | 3 | 18 |
| LBY235 | 0.80 | 3.17E−02 | 6 | 4 | LBY235 | 0.71 | 7.64E−02 | 4 | 3 |
| LBY236 | 0.91 | 1.22E−02 | 1 | 11 | LBY236 | 0.83 | 3.88E−02 | 1 | 15 |
| LBY236 | 0.79 | 5.99E−02 | 1 | 13 | LBY236 | 0.71 | 7.25E−02 | 2 | 19 |
| LBY236 | 0.73 | 3.81E−02 | 5 | 15 | LBY236 | 0.74 | 3.78E−02 | 5 | 10 |
| LBY236 | 0.80 | 1.75E−02 | 5 | 1 | LBY237 | 0.85 | 3.23E−02 | 1 | 20 |
| LBY237 | 0.92 | 1.03E−02 | 1 | 7 | LBY238 | 0.74 | 2.17E−02 | 6 | 19 |
| LBY238 | 0.85 | 3.51E−03 | 6 | 21 | LBY238 | 0.84 | 1.74E−02 | 2 | 24 |
| LBY238 | 0.77 | 2.47E−02 | 5 | 9 | LBY238 | 0.73 | 2.55E−02 | 4 | 25 |
| LBY238 | 0.76 | 1.80E−02 | 4 | 16 | LBY238 | 0.78 | 1.38E−02 | 4 | 7 |
| LBY238 | 0.83 | 5.78E−03 | 4 | 24 | LBY240 | 0.92 | 8.97E−03 | 1 | 11 |
| LBY240 | 0.89 | 1.64E−02 | 1 | 15 | LBY240 | 0.80 | 5.58E−02 | 1 | 13 |
| LBY240 | 0.73 | 1.02E−01 | 1 | 10 | LBY240 | 0.72 | 6.89E−02 | 1 | 11 |
| LBY242 | 0.96 | 2.44E−03 | 1 | 11 | LBY242 | 0.92 | 8.72E−03 | 1 | 15 |
| LBY242 | 0.86 | 2.65E−02 | 1 | 13 | LBY242 | 0.83 | 4.14E−02 | 1 | 10 |
| LBY242 | 0.80 | 5.65E−02 | 1 | 1 | LBY242 | 0.72 | 2.92E−02 | 6 | 11 |
| LBY242 | 0.74 | 2.40E−02 | 6 | 8 | LBY242 | 0.77 | 4.36E−02 | 2 | 13 |
| LBY261 | 0.86 | 5.95E−03 | 3 | 15 | LBY261 | 0.79 | 1.98E−02 | 3 | 10 |
| LBY261 | 0.77 | 2.46E−02 | 3 | 22 | LBY261 | 0.80 | 1.61E−02 | 3 | 1 |
| LBY262 | 0.92 | 9.67E−03 | 1 | 5 | LBY262 | 0.83 | 3.97E−02 | 1 | 17 |
| LBY262 | 0.92 | 9.66E−03 | 1 | 18 | LBY262 | 0.74 | 3.41E−02 | 3 | 24 |
| LBY262 | 0.79 | 1.12E−02 | 6 | 10 | LBY262 | 0.89 | 1.38E−03 | 6 | 1 |
| LBY262 | 0.74 | 2.13E−02 | 6 | 9 | LBY262 | 0.75 | 5.16E−02 | 2 | 19 |
| LBY262 | 0.92 | 4.58E−04 | 4 | 7 | LBY289 | 0.88 | 1.98E−02 | 1 | 11 |
| LBY289 | 0.94 | 5.99E−03 | 1 | 15 | LBY289 | 0.87 | 2.51E−02 | 1 | 13 |
| LBY289 | 0.77 | 7.36E−02 | 1 | 10 | LBY289 | 0.76 | 7.66E−02 | 1 | 1 |

TABLE 20-continued

Correlation between the expression level of selected genes of some embodiments of the invention in various tissues and the phenotypic performance under drought stress conditions across Barley accessions

| Gene Name | R | P value | Exp. set | Corr. ID | Gene Name | R | P value | Exp. set | Corr. ID |
|---|---|---|---|---|---|---|---|---|---|
| LBY289 | 0.76 | 4.64E−02 | 2 | 14 | LBY289 | 0.78 | 3.82E−02 | 2 | 10 |
| LBY289 | 0.81 | 2.60E−02 | 2 | 5 | LBY289 | 0.72 | 6.90E−02 | 2 | 6 |
| LBY289 | 0.79 | 3.28E−02 | 2 | 9 | LBY289 | 0.82 | 1.21E−02 | 5 | 11 |
| LBY312 | 0.93 | 7.53E−03 | 1 | 24 | LBY312 | 0.70 | 7.89E−02 | 2 | 19 |
| LBY363 | 0.72 | 1.07E−01 | 1 | 19 | LBY363 | 0.77 | 7.45E−02 | 1 | 23 |
| LBY363 | 0.73 | 4.09E−02 | 3 | 11 | LBY363 | 0.76 | 1.68E−02 | 6 | 21 |
| LBY363 | 0.78 | 3.79E−02 | 2 | 5 | LBY363 | 0.90 | 6.08E−03 | 2 | 18 |
| LBY363 | 0.85 | 3.65E−03 | 4 | 11 | LBY364 | 0.85 | 3.48E−03 | 4 | 14 |
| LBY408 | 0.74 | 9.48E−02 | 1 | 24 | LBY408 | 0.81 | 1.53E−02 | 3 | 15 |
| LBY408 | 0.79 | 2.04E−02 | 3 | 22 | LBY408 | 0.76 | 2.89E−02 | 3 | 12 |
| MGP45 | 0.88 | 2.08E−02 | 1 | 11 | MGP45 | 0.88 | 2.18E−02 | 1 | 15 |
| MGP45 | 0.76 | 8.26E−02 | 1 | 13 | MGP45 | 0.70 | 3.44E−02 | 6 | 25 |
| MGP45 | 0.71 | 7.23E−02 | 2 | 24 | MGP45 | 0.77 | 2.61E−02 | 5 | 25 |
| MGP45 | 0.77 | 2.58E−02 | 5 | 22 | MGP45 | 0.77 | 2.57E−02 | 5 | 12 |
| MGP45 | 0.73 | 6.38E−02 | 4 | 3 | MGP45 | 0.74 | 2.22E−02 | 4 | 17 |
| MGP45 | 0.78 | 1.41E−02 | 4 | 18 | MGP46 | 0.91 | 1.07E−02 | 1 | 20 |
| MGP46 | 0.76 | 8.06E−02 | 1 | 7 | MGP46 | 0.71 | 1.10E−01 | 1 | 1 |
| MGP46 | 0.83 | 2.18E−02 | 3 | 4 | MGP46 | 0.83 | 1.03E−02 | 3 | 15 |
| MGP46 | 0.84 | 9.15E−03 | 3 | 10 | MGP46 | 0.79 | 1.98E−02 | 3 | 22 |
| MGP46 | 0.79 | 1.94E−02 | 3 | 1 | MGP46 | 0.77 | 4.49E−02 | 2 | 20 |
| MGP47 | 0.76 | 7.65E−02 | 1 | 11 | MGP47 | 0.90 | 1.56E−02 | 1 | 15 |
| MGP47 | 0.86 | 2.91E−02 | 1 | 13 | MGP47 | 0.77 | 4.33E−02 | 2 | 24 |
| MGP47 | 0.78 | 6.68E−02 | 5 | 4 | MGP47 | 0.74 | 3.70E−02 | 5 | 13 |
| MGP47 | 0.72 | 4.46E−02 | 5 | 9 | MGP47 | 0.84 | 4.35E−03 | 4 | 25 |
| MGP47 | 0.85 | 3.77E−03 | 4 | 16 | MGP47 | 0.73 | 2.50E−02 | 4 | 22 |
| MGP62 | 0.78 | 3.87E−02 | 6 | 4 | MGP91 | 0.74 | 9.27E−02 | 1 | 19 |
| MGP91 | 0.95 | 4.19E−03 | 1 | 23 | MGP91 | 0.79 | 6.19E−02 | 1 | 1 |
| MGP91 | 0.76 | 2.83E−02 | 3 | 20 | MGP91 | 0.73 | 4.06E−02 | 3 | 15 |
| MGP91 | 0.86 | 1.38E−02 | 2 | 12 | MGP91 | 0.75 | 3.31E−02 | 5 | 17 |

Table 20: Provided are the correlations (R) between the expression levels of the genes of some embodiments of the invention and their homologs in various tissues [Expression (Exp) set 3, Table 3+ and the phenotypic performance (yield, biomass, growth rate and/or vigor components) according to the Correlation (Con.) vectors specified in Table 6 under drought conditions across barley varieties.
P = p value.

TABLE 21

Correlation between the expression level of selected genes of some embodiments of the invention in various tissues and the phenotypic performance of maintenance of performance under drought conditions across Barley accessions

| Gene Name | R | P value | Exp. set | Corr. ID | Gene Name | R | P value | Exp. set | Corr. ID |
|---|---|---|---|---|---|---|---|---|---|
| LBY235 | 0.72 | 1.08E−01 | 1 | 20 | LBY235 | 0.76 | 7.71E−02 | 1 | 7 |
| LBY235 | 0.75 | 8.73E−02 | 1 | 2 | LBY235 | 0.78 | 6.66E−02 | 1 | 1 |
| LBY235 | 0.87 | 2.37E−02 | 1 | 6 | LBY235 | 0.71 | 1.10E−01 | 1 | 5 |
| LBY235 | 0.87 | 2.42E−02 | 1 | 10 | LBY235 | 0.81 | 1.55E−02 | 5 | 20 |
| LBY235 | 0.71 | 3.26E−02 | 4 | 16 | LBY236 | 0.71 | 1.11E−01 | 1 | 20 |
| LBY236 | 0.88 | 2.21E−02 | 1 | 7 | LBY236 | 0.84 | 3.55E−02 | 1 | 2 |
| LBY236 | 0.85 | 3.25E−02 | 1 | 1 | LBY236 | 0.81 | 5.12E−02 | 1 | 6 |
| LBY236 | 0.72 | 1.04E−01 | 1 | 5 | LBY236 | 0.79 | 6.42E−02 | 1 | 10 |
| LBY236 | 0.81 | 8.81E−03 | 6 | 12 | LBY236 | 0.88 | 9.79E−03 | 2 | 4 |
| LBY236 | 0.75 | 5.01E−02 | 2 | 14 | LBY236 | 0.93 | 8.32E−04 | 5 | 7 |
| LBY236 | 0.92 | 1.22E−03 | 5 | 2 | LBY236 | 0.93 | 9.65E−04 | 5 | 1 |
| LBY236 | 0.72 | 4.19E−02 | 5 | 5 | LBY236 | 0.78 | 2.14E−02 | 5 | 18 |
| LBY237 | 0.91 | 1.28E−02 | 1 | 12 | LBY237 | 0.76 | 8.13E−02 | 1 | 7 |
| LBY237 | 0.71 | 1.14E−01 | 1 | 3 | LBY237 | 0.72 | 1.03E−01 | 1 | 5 |
| LBY238 | 0.76 | 8.25E−02 | 1 | 20 | LBY238 | 0.70 | 1.19E−01 | 1 | 10 |
| LBY238 | 0.83 | 9.93E−03 | 3 | 5 | LBY238 | 0.70 | 3.44E−02 | 6 | 13 |
| LBY238 | 0.91 | 4.59E−03 | 2 | 4 | LBY238 | 0.96 | 5.34E−04 | 5 | 15 |
| LBY238 | 0.79 | 1.98E−02 | 4 | 15 | LBY240 | 0.95 | 3.19E−03 | 1 | 7 |
| LBY240 | 0.91 | 1.11E−02 | 1 | 2 | LBY240 | 0.89 | 1.68E−02 | 1 | 1 |
| LBY240 | 0.85 | 3.17E−02 | 1 | 6 | LBY240 | 0.84 | 3.72E−02 | 1 | 5 |
| LBY240 | 0.73 | 9.80E−02 | 1 | 18 | LBY240 | 0.89 | 2.83E−03 | 3 | 5 |
| LBY240 | 0.72 | 2.81E−02 | 4 | 16 | LBY242 | 0.95 | 3.87E−03 | 1 | 7 |
| LBY242 | 0.94 | 5.97E−03 | 1 | 2 | LBY242 | 0.91 | 1.20E−02 | 1 | 1 |
| LBY242 | 0.85 | 3.36E−02 | 1 | 6 | LBY242 | 0.74 | 9.03E−02 | 1 | 5 |
| LBY242 | 0.85 | 3.14E−02 | 1 | 18 | LBY242 | 0.73 | 6.36E−02 | 2 | 16 |
| LBY261 | 0.85 | 7.12E−03 | 3 | 7 | LBY261 | 0.85 | 7.90E−03 | 3 | 2 |
| LBY261 | 0.82 | 1.17E−02 | 3 | 1 | LBY261 | 0.73 | 4.01E−02 | 3 | 6 |

TABLE 21-continued

Correlation between the expression level of selected genes of some embodiments of the invention in various tissues and the phenotypic performance of maintenance of performance under drought conditions across Barley accessions

| Gene Name | R | P value | Exp. set | Corr. ID | Gene Name | R | P value | Exp. set | Corr. ID |
|---|---|---|---|---|---|---|---|---|---|
| LBY261 | 0.79 | 2.10E−02 | 3 | 18 | LBY261 | 0.81 | 2.67E−02 | 2 | 4 |
| LBY261 | 0.77 | 2.63E−02 | 5 | 7 | LBY261 | 0.84 | 9.74E−03 | 5 | 2 |
| LBY261 | 0.82 | 1.36E−02 | 5 | 1 | LBY261 | 0.80 | 1.62E−02 | 5 | 5 |
| LBY261 | 0.71 | 4.78E−02 | 5 | 18 | LBY262 | 0.83 | 3.92E−02 | 1 | 14 |
| LBY262 | 0.73 | 3.86E−02 | 3 | 14 | LBY262 | 0.81 | 2.66E−02 | 3 | 15 |
| LBY262 | 0.82 | 6.96E−03 | 6 | 7 | LBY262 | 0.73 | 2.45E−02 | 6 | 2 |
| LBY262 | 0.77 | 1.54E−02 | 6 | 1 | LBY262 | 0.73 | 2.44E−02 | 6 | 3 |
| LBY262 | 0.83 | 5.23E−03 | 6 | 18 | LBY262 | 0.86 | 1.23E−02 | 2 | 4 |
| LBY262 | 0.74 | 5.61E−02 | 2 | 5 | LBY262 | 0.81 | 7.63E−03 | 4 | 12 |
| LBY263 | 0.71 | 7.18E−02 | 6 | 19 | LBY263 | 0.82 | 1.27E−02 | 5 | 14 |
| LBY263 | 0.84 | 4.59E−03 | 4 | 20 | LBY289 | 0.91 | 1.22E−02 | 1 | 7 |
| LBY289 | 0.87 | 2.38E−02 | 1 | 2 | LBY289 | 0.82 | 4.36E−02 | 1 | 1 |
| LBY289 | 0.80 | 5.36E−02 | 1 | 6 | LBY289 | 0.84 | 3.42E−02 | 1 | 5 |
| LBY289 | 0.81 | 4.93E−02 | 1 | 18 | LBY289 | 0.81 | 1.45E−02 | 3 | 7 |
| LBY289 | 0.75 | 3.27E−02 | 3 | 2 | LBY289 | 0.77 | 2.50E−02 | 3 | 6 |
| LBY312 | 0.83 | 2.21E−02 | 2 | 8 | LBY312 | 0.80 | 3.17E−02 | 2 | 14 |
| LBY363 | 0.73 | 1.03E−01 | 1 | 8 | LBY363 | 0.71 | 1.13E−01 | 1 | 4 |
| LBY364 | 0.76 | 2.98E−02 | 5 | 13 | LBY363 | 0.74 | 9.04E−02 | 2 | 15 |
| LBY408 | 0.91 | 1.52E−03 | 3 | 2 | LBY408 | 0.96 | 1.46E−04 | 3 | 7 |
| LBY408 | 0.76 | 2.74E−02 | 3 | 6 | LBY408 | 0.90 | 2.07E−03 | 3 | 1 |
| LBY408 | 0.90 | 1.48E−02 | 2 | 17 | LBY408 | 0.87 | 1.01E−02 | 2 | 11 |
| MGP45 | 0.85 | 3.02E−02 | 1 | 1 | MGP45 | 0.80 | 5.77E−02 | 1 | 6 |
| MGP45 | 0.88 | 2.22E−02 | 1 | 5 | MGP45 | 0.76 | 8.10E−02 | 1 | 18 |
| MGP45 | 0.85 | 7.48E−03 | 3 | 7 | MGP45 | 0.79 | 2.05E−02 | 3 | 2 |
| MGP45 | 0.78 | 2.21E−02 | 3 | 1 | MGP45 | 0.72 | 6.84E−02 | 2 | 4 |
| MGP45 | 0.72 | 4.47E−02 | 5 | 2 | MGP45 | 0.77 | 2.50E−02 | 5 | 1 |
| MGP45 | 0.78 | 3.71E−02 | 5 | 15 | MGP45 | 0.79 | 1.95E−02 | 5 | 9 |
| MGP45 | 0.78 | 1.31E−02 | 4 | 16 | MGP46 | 0.85 | 3.17E−02 | 1 | 12 |
| MGP46 | 0.80 | 5.71E−02 | 1 | 7 | MGP46 | 0.77 | 7.07E−02 | 1 | 2 |
| MGP46 | 0.73 | 9.78E−02 | 1 | 1 | MGP46 | 0.94 | 5.37E−03 | 1 | 3 |
| MGP46 | 0.71 | 1.17E−01 | 1 | 18 | MGP46 | 0.96 | 1.10E−04 | 3 | 7 |
| MGP46 | 0.93 | 6.68E−04 | 3 | 2 | MGP46 | 0.93 | 7.68E−04 | 3 | 1 |
| MGP46 | 0.74 | 3.46E−02 | 3 | 6 | MGP46 | 0.75 | 3.13E−02 | 3 | 18 |
| MGP46 | 0.71 | 7.33E−02 | 2 | 12 | MGP46 | 0.75 | 1.91E−02 | 4 | 7 |
| MGP46 | 0.81 | 8.16E−03 | 4 | 2 | MGP46 | 0.76 | 1.74E−02 | 4 | 1 |
| MGP47 | 0.78 | 6.46E−02 | 1 | 7 | MGP47 | 0.73 | 9.94E−02 | 1 | 2 |
| MGP47 | 0.72 | 1.06E−01 | 1 | 6 | MGP47 | 0.86 | 2.99E−02 | 1 | 5 |
| MGP47 | 0.89 | 7.94E−03 | 2 | 4 | MGP47 | 0.80 | 3.11E−02 | 2 | 14 |
| MGP47 | 0.80 | 3.07E−02 | 2 | 11 | MGP62 | 0.70 | 5.25E−02 | 3 | 2 |
| MGP62 | 0.94 | 4.54E−04 | 3 | 5 | MGP91 | 0.97 | 1.77E−03 | 1 | 8 |
| MGP91 | 0.78 | 6.85E−02 | 1 | 18 | MGP91 | 0.77 | 2.57E−02 | 3 | 6 |
| MGP91 | 0.75 | 3.05E−02 | 3 | 3 | MGP91 | 0.73 | 6.41E−02 | 2 | 14 |
| MGP91 | 0.71 | 4.98E−02 | 5 | 7 | | | | | |

Table 21: Correlations (R) between the expression levels of the genes of some embodiments of the invention and their homologs in various tissues (expression set 3, Table 3) and the phenotypic performance (yield, biomass, growth rate and/or vigor components) according to the Correlation (Corr.) vectors specified in Table 7.
"Exp. Set"— Expression set.
"R" = Pearson correlation coefficient;
"P" = p value.

Example 2

Production of Barley Transcriptome and High Throughput Correlation Analysis Using 60K Barley Oligonucleotide Micro-Array In order to produce a high throughput correlation analysis, the present inventors utilized a Barley oligonucleotide micro-array, produced by Agilent Technologies [chem. (dot) agilent (dot) com/Scripts/PDS (dot) asp?lPage=50879]. The array oligonucleotide represents about 33,777 Barley genes and transcripts. In order to define correlations between the levels of RNA expression and yield or vigor related parameters, various plant characteristics of 55 different Barley accessions were analyzed. Same accessions were subjected to RNA expression analysis. The correlation between the RNA levels and the characterized parameters was analyzed using Pearson correlation test [davidmlane (dot) com/hyperstat/A34739 (dot) html].

Experimental Procedures

Four tissues at different developmental stages [leaf, flag leaf, spike and peduncle], representing different plant characteristics, were sampled and RNA was extracted as described hereinabove under "GENERAL EXPERIMENTAL AND BIOINFORMATICS METHODS".

For convenience, each micro-array expression information tissue type has received a Set ID as summarized in Table 22 below.

TABLE 22

Barley transcriptome expression sets

| Expression Set | Set ID |
| --- | --- |
| Flag leaf at booting stage under normal conditions | 1 |
| Spike at grain filling stage under normal conditions | 2 |
| Spike at booting stage under normal conditions | 3 |
| Stem at booting stage under normal conditions | 4 |

Table 22: Provided are the identification (ID) letters of each of the Barley expression sets.

Barley yield components and vigor related parameters assessment—55 Barley accessions in 5 repetitive blocks (named A, B, C, D and E), each containing 48 plants per plot were grown in field. Plants were phenotyped on a daily basis. Harvest was conducted while 50% of the spikes were dry to avoid spontaneous release of the seeds. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]). Next, analyzed data was saved to text files and processed using the JMP statistical analysis software (SAS institute).

At the end of the experiment (50% of the spikes were dry) all spikes from plots within blocks A-E were collected, and the following measurements were performed:

% reproductive tiller percentage—The percentage of reproductive tillers at flowering calculated using Formula 26 above.

1000 grain weight (gr.)—At the end of the experiment all grains from all plots were collected and weighted and the weight of 1000 were calculated.

Avr. (average) seedling dry weight (gr.)—Weight of seedling after drying/number of plants.

Avr. (average) shoot dry weight (gr.)—Weight of Shoot at flowering stage after drying/number of plants.

Avr. (average) spike weight (gr.)—Calculate spikes dry weight after drying at 70° C. in oven for 48 hours, at harvest/num of spikes.

Spike weight—The biomass and spikes weight of each plot was separated, measured and divided by the number of plants.

Dry weight—total weight of the vegetative portion above ground (excluding roots) after drying at 70° C. in oven for 48 hours at two time points at the Vegetative growth (30 days after sowing) and at harvest.

Vegetative dry weight (gr.)—Total weight of the vegetative portion above ground (excluding roots) after drying at 70° C. in oven for 48 hours. The biomass weight of each plot was measured and divided by the number of plants.

Field spike length (cm)—Measure spike length without the Awns at harvest.

Grain Area ($cm^2$)—A sample of ~200 grains was weighted, photographed and images were processed using the below described image processing system. The grain area was measured from those images and was divided by the number of grains.

Grain Length and Grain width (cm)—A sample of ~200 grains was weighted, photographed and images were processed using the below described image processing system. The sum of grain lengths and width (longest axis) was measured from those images and was divided by the number of grains.

Grain Perimeter (cm)—A sample of ~200 grains was weighted, photographed and images were processed using the below described image processing system. The sum of grain perimeter was measured from those images and was divided by the number of grains.

Grains per spike—The total number of grains from 5 spikes that were manually threshed was counted. The average grain per spike was calculated by dividing the total grain number by the number of spikes.

Grain yield per plant (gr.)—The total grains from 5 spikes that were manually threshed was weighted. The grain yield was calculated by dividing the total weight by the plants number.

Grain yield per spike (gr.)—The total grains from 5 spikes that were manually threshed was weighted. The grain yield was calculated by dividing the total weight by the spike number.

Growth habit scoring—At growth stage 10 (booting), each of the plants was scored for its growth habit nature. The scale that was used was "1" for prostate nature till "9" for erect.

Harvest Index (for barley)—The harvest index was calculated using Formula 18 above.

Number of days to anthesis—Calculated as the number of days from sowing till 50% of the plot reach anthesis.

Number of days to maturity—Calculated as the number of days from sowing till 50% of the plot reach maturity.

Plant height—At harvest stage (50% of spikes were dry), each of the plants was measured for its height using measuring tape. Height was measured from ground level to top of the longest spike excluding awns.

Reproductive period—Calculated number of days from booting to maturity.

Reproductive tillers number—Number of Reproductive tillers with flag leaf at flowering.

Relative Growth Rate (RGR) of vegetative dry weight was performed using Formula 7 above.

Spike area ($cm^2$)—At the end of the growing period 5 'spikes' were, photographed and images were processed using the below described image processing system. The 'spike' area was measured from those images and was divided by the number of 'spikes'.

Spike length and width analysis—At the end of the experiment the length and width of five chosen spikes per plant were measured using measuring tape excluding the awns.

Spike max width—Measured by imaging the max width of 10-15 spikes randomly distributed within a pre-defined 0.5 $m^2$ of a plot. Measurements were carried out at the middle of the spike.

Spikes Index—The Spikes index was calculated using Formula 27 above.

Spike number analysis—The spikes per plant were counted at harvest.

No. of tillering—tillers were counted per plant at heading stage (mean per plot).

Total dry mater per plant—Calculated as Vegetative portion above ground plus all the spikes dry weight per plant.

TABLE 23

Barley correlated parameters (vectors)

| Correlated parameter with | Correlation ID |
|---|---|
| % reproductive tiller percentage (%) | 1 |
| 1000 grain weight (gr.) | 2 |
| Avr. seedling dry weight (gr.) | 3 |
| Avr. shoot dry weight (F) (gr.) | 4 |
| Avr. spike weight (H) (gr.) | 5 |
| Avr. spike dry weight per plant (H) (gr.) | 6 |
| Avr. vegetative dry weight per plant (H) (gr.) | 7 |
| Field spike length (cm) | 8 |
| Grain Area (cm$^2$) | 9 |
| Grain Length (cm) | 10 |
| Grain Perimeter (cm) | 11 |
| Grain width (cm) | 12 |
| Grains per spike (number) | 13 |
| Grain yield per plant (gr.) | 14 |
| Grain yield per spike (gr.) | 15 |
| Growth habit (scores 1-9) | 16 |
| Harvest Index (value) | 17 |
| Number days to anthesis (days) | 18 |
| Number days to maturity (days) | 19 |
| Plant height (cm) | 20 |
| Reproductive period (days) | 21 |
| Reproductive tillers number (F) (number) | 22 |
| RGR | 23 |
| Spike area (cm$^2$) | 24 |
| Spike length (cm) | 25 |
| Spike max width (cm) | 26 |
| Spike width (cm) | 27 |
| Spike index (cm) | 28 |
| Spikes per plant (numbers) | 29 |
| Tillering (Heading) (number) | 30 |
| Total dry matter per plant (kg) | 31 |

Table 23. Provided are the Barley correlated parameters (vectors).

Experimental Results 55 different Barley accessions were grown and characterized for 31 parameters as described above. Among the 55 lines and ecotypes, 27 are *Hordeum spontaneum* and 19 are *Hordeum vulgare*. The average for each of the measured parameters was calculated using the JMP software and values are summarized in Tables 24-38 below. Subsequent correlation analysis between the various transcriptome expression sets (Table 22) and the average parameters was conducted. Correlations were calculated across all 55 lines and ecotypes. The phenotypic data of all 55 lines and ecotypes are summarized in Tables 24-31. The correlation data of all 55 lines and ecotypes are summarized in Table 39. The phenotypic data of *Hordeum spontaneum* lines and ecotypes are summarized in Tables 32-35. The correlation data of *Hordeum spontaneum* lines and ecotypes are summarized in Table 40. The phenotypic data of *Hordeum vulgare* lines and ecotypes are summarized in Tables 36-38. The correlation data of *Hordeum vulgare* lines and ecotypes are summarized in Table 41.

TABLE 24

Measured parameters of correlation IDs in Barley accessions (1-7)

| Line/Corr. ID | Line-1 | Line-2 | Line-3 | Line-4 | Line-5 | Line-6 | Line-7 |
|---|---|---|---|---|---|---|---|
| 1 | 4.30 | 18.30 | 9.20 | 40.20 | 33.20 | NA | 7.90 |
| 2 | 50.10 | 50.00 | 31.80 | 52.40 | 47.20 | 49.30 | 53.00 |
| 3 | 0.05 | 0.06 | 0.04 | 0.05 | 0.05 | 0.05 | 0.07 |
| 4 | 11.30 | 52.60 | 48.30 | 126.90 | 60.60 | NA | 31.40 |
| 5 | 3.33 | 1.56 | 2.37 | 3.11 | 3.18 | 2.85 | 3.37 |
| 6 | 80.90 | 60.50 | 36.40 | 69.40 | 61.00 | 63.20 | 88.30 |
| 7 | 46.30 | 85.00 | 82.70 | 127.40 | 79.50 | 83.00 | 68.90 |
| 8 | 9.57 | NA | 7.66 | 7.93 | 8.13 | NA | 7.21 |
| 9 | 0.30 | 0.28 | 0.24 | 0.30 | 0.29 | 0.29 | 0.30 |
| 10 | 1.09 | 0.97 | 0.92 | 1.07 | 1.09 | 1.07 | 1.05 |
| 11 | 2.62 | 2.41 | 2.31 | 2.67 | 2.62 | 2.59 | 2.59 |
| 12 | 0.40 | 0.41 | 0.35 | 0.41 | 0.39 | 0.39 | 0.41 |
| 13 | 56.50 | 21.10 | 45.20 | 44.40 | 47.10 | 43.50 | 55.90 |
| 14 | 65.00 | 37.50 | NA | 51.70 | 49.10 | 46.40 | NA |
| 15 | 2.91 | 1.02 | 1.37 | 2.33 | 2.23 | 2.14 | 2.85 |
| 16 | 4.20 | 1.00 | 1.40 | 2.60 | 2.60 | 1.00 | 2.60 |
| 17 | 0.51 | 0.25 | NA | 0.26 | 0.35 | 0.32 | NA |
| 18 | 90.80 | 124.40 | 122.00 | NA | 122.00 | NA | 102.60 |
| 19 | 148.00 | 170.00 | 157.00 | 170.00 | 167.40 | 170.00 | 158.80 |
| 20 | 84.00 | 79.90 | 99.00 | 122.50 | 108.00 | 87.00 | 97.00 |
| 21 | 57.20 | 45.60 | 35.00 | NA | 48.00 | NA | 56.20 |
| 22 | 1.00 | 9.20 | 5.00 | 19.20 | 14.62 | NA | 2.80 |
| 23 | 2.45 | 3.96 | 3.91 | 4.75 | 4.12 | NA | 3.24 |
| 24 | 9.90 | 7.82 | 9.68 | 11.07 | 10.17 | 9.98 | 9.94 |
| 25 | 9.49 | 10.26 | 7.88 | 7.97 | 8.42 | 8.12 | 7.61 |
| 26 | 1.41 | 1.05 | 1.59 | 1.79 | 1.60 | 1.61 | 1.70 |
| 27 | 1.23 | 0.87 | 1.44 | 1.68 | 1.47 | 1.51 | 1.57 |
| 28 | 0.64 | 0.42 | 0.30 | 0.35 | 0.44 | 0.43 | 0.56 |
| 29 | 45.30 | 56.30 | 31.50 | 32.40 | 35.40 | 36.70 | 36.90 |
| 30 | 24.00 | 48.70 | 52.00 | 47.60 | 45.00 | NA | 35.20 |
| 31 | 127.20 | 145.50 | 119.20 | 196.80 | 140.50 | 146.20 | 157.20 |

Table 24: Provided are the values of each of the parameters measured in Barley accessions (1-7) according to the correlation identifications (see Table 23). "NA" = not available.

TABLE 25

Barley accessions (8-14), additional measured parameters

| Line/Corr. ID | Line-8 | Line-9 | Line-10 | Line-11 | Line-12 | Line-13 | Line-14 |
|---|---|---|---|---|---|---|---|
| 1 | 16.70 | 5.60 | 5.30 | 18.30 | 4.00 | 8.80 | 4.80 |
| 2 | 61.30 | 50.00 | 51.70 | 56.50 | 54.00 | 50.40 | 56.80 |
| 3 | 0.05 | 0.06 | 0.05 | 0.06 | 0.06 | 0.06 | 0.05 |
| 4 | 44.60 | 9.70 | 38.20 | 46.70 | 42.30 | 11.60 | 9.30 |
| 5 | 4.13 | 3.47 | 3.15 | 1.88 | 3.35 | 3.60 | 3.24 |
| 6 | 91.90 | 99.10 | 67.00 | 60.20 | 87.60 | 71.80 | 76.70 |
| 7 | 82.90 | 56.80 | 64.10 | 54.20 | 73.20 | 49.50 | 47.60 |
| 8 | 5.65 | 7.94 | 8.55 | 10.59 | 7.44 | 7.36 | 9.60 |
| 9 | 0.33 | 0.29 | 0.30 | 0.28 | 0.30 | 0.28 | 0.32 |
| 10 | 1.15 | 1.09 | 1.08 | 0.88 | 1.03 | 0.96 | 1.12 |
| 11 | 2.78 | 2.66 | 2.63 | 2.28 | 2.54 | 2.37 | 2.71 |
| 12 | 0.42 | 0.40 | 0.39 | 0.45 | 0.42 | 0.41 | 0.41 |
| 13 | 58.30 | 56.00 | 59.10 | 27.30 | 55.90 | 61.50 | 50.80 |
| 14 | 78.20 | 79.90 | 54.30 | 46.40 | 71.90 | 56.20 | 61.60 |
| 15 | 3.47 | 2.60 | 2.84 | 1.51 | 2.84 | 2.98 | 2.85 |
| 16 | 1.00 | 5.00 | 3.00 | 1.00 | 1.00 | 2.20 | 3.00 |
| 17 | 0.45 | 0.51 | 0.41 | 0.40 | 0.45 | 0.48 | 0.50 |
| 18 | 111.60 | 86.80 | 106.20 | 117.80 | 111.60 | 85.40 | 90.00 |
| 19 | 156.20 | 159.60 | 157.00 | 162.20 | 159.60 | 157.00 | 150.50 |
| 20 | 104.00 | 70.80 | 98.10 | 57.90 | 94.50 | 73.20 | 78.70 |
| 21 | 44.60 | 72.80 | 50.80 | 44.40 | 46.00 | 71.60 | 61.50 |
| 22 | 6.30 | 1.20 | 2.10 | 10.00 | 2.60 | 1.62 | 1.00 |
| 23 | 3.82 | 2.30 | 3.60 | 3.83 | 3.63 | 2.43 | 2.26 |
| 24 | 9.89 | 9.58 | 11.19 | 8.76 | 10.49 | 10.83 | 11.23 |
| 25 | 6.39 | 7.73 | 8.45 | 10.55 | 7.60 | 7.87 | 9.42 |
| 26 | 1.93 | 1.59 | 1.71 | 1.17 | 1.75 | 1.72 | 1.58 |
| 27 | 1.83 | 1.50 | 1.57 | 0.96 | 1.63 | 1.63 | 1.43 |
| 28 | 0.52 | 0.64 | 0.51 | 0.53 | 0.55 | 0.61 | 0.62 |
| 29 | 32.10 | 48.50 | 29.80 | 50.80 | 32.40 | 26.80 | 42.40 |
| 30 | 38.50 | 21.50 | 36.10 | 57.20 | 42.20 | 19.10 | 21.60 |
| 31 | 178.60 | 155.90 | 131.10 | 114.50 | 160.80 | 121.30 | 124.30 |

Table 25: Provided are the values of each of the parameters measured in Barley accessions (8-14) according to the correlation identifications (see Table 23).

TABLE 26

Barley accessions (15-21), additional measured parameters

| Line/Corr. ID | Line-15 | Line-16 | Line-17 | Line-18 | Line-19 | Line-20 | Line-21 |
|---|---|---|---|---|---|---|---|
| 1 | 29.50 | 5.00 | 3.70 | 11.40 | 5.10 | 4.10 | 6.60 |
| 2 | 58.00 | 51.40 | 58.10 | 53.40 | 48.70 | 39.50 | 42.00 |
| 3 | 0.05 | 0.04 | 0.05 | 0.04 | 0.06 | 0.05 | 0.05 |
| 4 | 47.60 | 30.90 | NA | 35.50 | 38.40 | NA | 41.60 |
| 5 | 3.12 | 1.69 | 1.66 | 3.50 | 1.16 | 2.95 | 1.36 |
| 6 | 81.10 | 77.90 | 68.20 | 70.70 | 54.10 | 48.70 | 64.50 |
| 7 | 66.50 | 77.50 | 81.60 | 67.90 | 81.10 | 66.70 | 91.80 |
| 8 | 6.23 | NA | NA | 8.57 | NA | 6.26 | NA |
| 9 | 0.34 | 0.27 | 0.30 | 0.30 | 0.26 | 0.24 | 0.24 |
| 10 | 1.22 | 0.89 | 0.96 | 1.08 | 0.83 | 0.85 | 0.94 |
| 11 | 2.90 | 2.28 | 2.42 | 2.65 | 2.16 | 2.16 | 2.45 |
| 12 | 0.41 | 0.42 | 0.44 | 0.40 | 0.42 | 0.39 | 0.36 |
| 13 | 45.50 | 24.80 | 21.10 | 59.70 | 17.50 | 63.20 | 19.90 |
| 14 | 64.80 | 56.40 | 49.70 | 55.00 | 40.30 | NA | NA |
| 15 | 2.39 | 1.21 | 1.18 | 2.93 | 0.83 | 2.38 | 0.78 |
| 16 | 1.00 | 1.00 | 3.80 | 3.80 | 1.00 | 3.40 | 1.00 |
| 17 | 0.44 | 0.36 | 0.33 | 0.40 | 0.29 | NA | NA |
| 18 | 113.20 | 113.40 | 98.50 | 109.60 | 119.40 | 98.80 | 119.40 |
| 19 | 158.00 | 170.00 | 170.00 | 155.20 | 170.00 | 156.20 | 170.00 |
| 20 | 90.70 | 64.30 | 82.70 | 94.10 | 63.50 | 102.10 | 94.80 |
| 21 | 44.80 | 56.60 | 71.50 | 45.60 | 50.60 | 57.40 | 50.60 |
| 22 | 17.00 | 3.00 | 1.00 | 3.80 | 4.20 | 1.00 | 4.62 |
| 23 | 3.89 | 3.46 | NA | 3.60 | 3.64 | NA | 3.74 |
| 24 | 7.89 | 9.15 | 8.57 | 11.30 | 7.04 | 8.37 | 7.28 |
| 25 | 6.68 | 12.05 | 10.74 | 8.60 | 8.94 | 6.03 | 10.99 |
| 26 | 1.52 | 1.03 | 1.10 | 1.72 | 1.08 | 1.75 | 0.90 |
| 27 | 1.45 | 0.88 | 0.92 | 1.56 | 0.92 | 1.67 | 0.76 |
| 28 | 0.55 | 0.50 | 0.45 | 0.51 | 0.39 | 0.42 | 0.41 |
| 29 | 39.70 | 71.30 | 65.40 | 33.30 | 82.50 | 32.90 | 73.10 |
| 30 | 59.80 | 62.50 | 31.20 | 34.00 | 78.90 | 26.50 | 69.90 |
| 31 | 147.70 | 155.40 | 149.80 | 138.60 | 135.20 | 115.50 | 156.30 |

Table 26: Provided are the values of each of the parameters measured in Barley accessions (15- 21) according to the correlation identifications (see Table 23).

TABLE 27

Barley accessions (22-28), additional measured parameters

| Line/Corr. ID | Line-22 | Line-23 | Line-24 | Line-25 | Line-26 | Line-27 | Line-28 |
|---|---|---|---|---|---|---|---|
| 1 | 3.50 | 7.30 | 31.10 | NA | NA | 11.10 | 21.70 |
| 2 | 18.60 | 42.60 | 39.70 | 24.40 | 28.40 | 28.40 | 23.50 |
| 3 | 0.03 | 0.06 | 0.05 | 0.05 | 0.04 | 0.05 | 0.05 |
| 4 | 174.80 | 8.40 | 51.80 | NA | NA | 38.50 | 38.80 |
| 5 | 0.90 | 3.09 | 1.22 | 0.91 | 0.92 | 1.08 | 0.95 |
| 6 | 33.60 | 33.20 | 52.10 | 33.30 | 47.70 | 52.80 | 52.50 |
| 7 | 50.20 | 45.20 | 67.20 | 43.40 | 79.50 | 61.10 | 59.70 |
| 8 | 9.74 | 9.06 | 8.69 | 8.90 | 10.13 | 10.61 | 9.60 |
| 9 | 0.25 | 0.25 | 0.25 | 0.27 | 0.25 | 0.25 | 0.24 |
| 10 | 1.11 | 0.88 | 0.96 | 1.20 | 1.07 | 1.08 | 1.11 |
| 11 | 2.65 | 2.19 | 2.44 | 2.90 | 2.62 | 2.66 | 2.68 |
| 12 | 0.31 | 0.39 | 0.37 | 0.32 | 0.32 | 0.33 | 0.31 |
| 13 | 16.30 | 60.50 | 17.50 | 12.00 | 20.00 | 20.00 | 17.00 |
| 14 | NA | NA | NA | NA | NA | NA | NA |
| 15 | 0.31 | 2.43 | 0.67 | 0.31 | 0.56 | 0.56 | 0.38 |
| 16 | 1.00 | 3.00 | 1.00 | 1.00 | 1.00 | 1.00 | 1.00 |
| 17 | NA | NA | NA | NA | NA | NA | NA |
| 18 | 95.60 | 90.00 | 111.00 | 83.60 | 122.00 | 111.40 | 109.20 |
| 19 | 133.00 | 161.40 | 145.80 | 140.20 | 153.00 | 143.00 | 140.40 |
| 20 | 90.50 | 88.50 | 90.10 | 92.50 | 99.10 | 91.70 | 94.70 |
| 21 | 37.40 | 71.40 | 34.80 | 56.60 | 31.00 | 31.60 | 31.20 |
| 22 | 1.88 | 1.00 | 15.50 | NA | NA | 7.10 | 15.70 |
| 23 | 5.01 | 2.12 | 3.97 | NA | NA | 3.67 | 3.68 |
| 24 | 4.98 | 11.56 | 6.52 | 5.39 | 8.16 | 8.08 | 5.73 |
| 25 | 8.58 | 9.02 | 8.63 | 7.96 | 10.20 | 10.52 | 8.35 |
| 26 | 0.79 | 1.68 | 1.01 | 0.88 | 1.05 | 1.01 | 0.90 |
| 27 | 0.68 | 1.53 | 0.88 | 0.81 | 0.97 | 0.92 | 0.78 |
| 28 | 0.41 | 0.42 | 0.44 | 0.44 | 0.38 | 0.46 | 0.47 |
| 29 | 88.10 | 20.50 | 48.50 | 51.30 | 65.80 | 55.80 | 65.60 |
| 30 | 55.20 | 14.00 | 48.50 | NA | NA | 69.00 | 76.40 |
| 31 | 83.80 | 78.40 | 119.30 | 76.70 | 127.20 | 113.90 | 112.20 |

Table 27: Provided are the values of each of the parameters measured in Barley accessions (22-28) according to the correlation identifications (see Table 23).

TABLE 28

Barley accessions (29-35), additional measured parameters

| Line/Corr. ID | Line-29 | Line-30 | Line-31 | Line-32 | Line-33 | Line-34 | Line-35 |
|---|---|---|---|---|---|---|---|
| 1 | 3.90 | 16.50 | 3.20 | 10.50 | 26.50 | 15.10 | 4.30 |
| 2 | 45.70 | 26.50 | 23.10 | 27.60 | 29.40 | 27.70 | 42.10 |
| 3 | 0.05 | 0.04 | 0.04 | 0.05 | 0.04 | 0.06 | 0.05 |
| 4 | 10.60 | 29.60 | 14.30 | 37.70 | 39.20 | 34.50 | 41.20 |
| 5 | 2.99 | 0.85 | 0.85 | 0.89 | 1.10 | 1.09 | 2.93 |
| 6 | 84.00 | 47.00 | 48.90 | 47.30 | 48.80 | 46.60 | 89.20 |
| 7 | 45.40 | 60.40 | 67.40 | 67.10 | 61.30 | 59.00 | 71.30 |
| 8 | 7.97 | 8.24 | 9.14 | 8.71 | 9.82 | 10.00 | 8.47 |
| 9 | 0.30 | 0.25 | 0.24 | 0.29 | 0.33 | 0.29 | 0.30 |
| 10 | 1.13 | 1.09 | 1.06 | 1.23 | 1.33 | 1.27 | 1.16 |
| 11 | 2.77 | 2.66 | 2.57 | 2.93 | 3.16 | 2.99 | 2.97 |
| 12 | 0.39 | 0.32 | 0.32 | 0.34 | 0.34 | 0.32 | 0.39 |
| 13 | 56.80 | 18.20 | 13.50 | 12.80 | 14.50 | 13.70 | 54.80 |
| 14 | NA | NA | NA | NA | NA | NA | NA |
| 15 | 2.63 | 0.46 | 0.31 | 0.37 | 0.43 | 0.39 | 2.14 |
| 16 | 2.20 | 1.00 | 1.00 | 1.00 | 1.00 | 1.00 | 1.00 |
| 17 | NA | NA | NA | NA | NA | NA | NA |
| 18 | 89.20 | 104.00 | 89.20 | 97.80 | 113.60 | 109.20 | 110.40 |
| 19 | 151.60 | 140.20 | 140.40 | 140.40 | 145.80 | 143.00 | 156.20 |
| 20 | 66.70 | 105.80 | 112.20 | 103.80 | 105.70 | 107.40 | 100.60 |
| 21 | 62.40 | 36.20 | 51.20 | 42.60 | 32.20 | 33.80 | 45.80 |
| 22 | 1.00 | 12.30 | 1.10 | 8.50 | 18.67 | 11.00 | 2.50 |
| 23 | 2.37 | 3.42 | 2.67 | 3.64 | 3.65 | 3.51 | 3.74 |
| 24 | 8.94 | 4.69 | 5.47 | 5.92 | 6.16 | 6.88 | 11.03 |
| 25 | 7.75 | 6.85 | 8.51 | 8.32 | 9.80 | 9.28 | 8.77 |
| 26 | 1.52 | 0.91 | 0.85 | 0.96 | 0.82 | 0.94 | 1.60 |
| 27 | 1.37 | 0.81 | 0.75 | 0.83 | 0.74 | 0.88 | 1.53 |
| 28 | 0.65 | 0.44 | 0.42 | 0.41 | 0.41 | 0.44 | 0.56 |
| 29 | 44.90 | 77.10 | 85.00 | 67.50 | 50.90 | 55.70 | 38.60 |
| 30 | 26.50 | 76.60 | 35.30 | 75.30 | 68.50 | 66.80 | 55.80 |
| 31 | 129.30 | 107.40 | 116.30 | 114.40 | 104.50 | 105.60 | 160.50 |

Table 28: Provided are the values of each of the parameters measured in Barley accessions (29-35) according to the correlation identifications (see Table 23).

TABLE 29

Barley accessions (36-42), additional measured parameters

| Line/Corr. ID | Line-36 | Line-37 | Line-38 | Line-39 | Line-40 | Line-41 | Line-42 |
|---|---|---|---|---|---|---|---|
| 1 | 9.50 | 4.70 | NA | 4.60 | 21.50 | 21.20 | 14.50 |
| 2 | 26.40 | 19.80 | 31.00 | 47.80 | 32.60 | 36.90 | 24.20 |
| 3 | 0.06 | 0.03 | 0.04 | 0.06 | 0.05 | NA | 0.06 |
| 4 | 23.80 | 11.90 | NA | 8.30 | 55.40 | 55.90 | 31.30 |
| 5 | 0.74 | 1.15 | 1.32 | 3.51 | 1.45 | 1.40 | 0.93 |
| 6 | 43.50 | 27.40 | 44.60 | 69.90 | 44.20 | 50.50 | 44.00 |
| 7 | 48.60 | 31.50 | 59.30 | 43.10 | 72.40 | 91.80 | 63.40 |
| 8 | 8.36 | 12.49 | 11.03 | 8.21 | 7.97 | 10.44 | 8.66 |
| 9 | 0.30 | 0.26 | 0.26 | 0.32 | 0.23 | 0.28 | 0.30 |
| 10 | 1.30 | 1.11 | 1.10 | 1.21 | 0.95 | 1.09 | 1.28 |
| 11 | 3.17 | 2.74 | 2.69 | 2.93 | 2.38 | 2.67 | 3.05 |
| 12 | 0.31 | 0.32 | 0.33 | 0.39 | 0.33 | 0.30 | 0.33 |
| 13 | 11.30 | 16.10 | 21.70 | 58.20 | 34.20 | 20.80 | 11.50 |
| 14 | NA | NA | NA | NA | NA | NA | NA |
| 15 | 0.24 | 0.32 | 0.66 | 2.82 | 0.94 | 0.75 | 0.31 |
| 16 | 1.00 | 1.00 | 1.00 | 3.80 | 1.00 | 1.40 | 1.00 |

TABLE 29-continued

Barley accessions (36-42), additional measured parameters

| Line/Corr. ID | Line-36 | Line-37 | Line-38 | Line-39 | Line-40 | Line-41 | Line-42 |
|---|---|---|---|---|---|---|---|
| 17 | NA | NA | NA | NA | NA | NA | NA |
| 18 | 108.40 | 91.60 | 115.60 | 84.20 | 118.00 | 116.80 | 111.00 |
| 19 | 140.40 | 133.00 | 145.80 | 148.00 | 153.80 | 144.20 | 140.20 |
| 20 | 106.30 | 78.30 | 107.60 | 77.60 | 93.90 | 126.10 | 107.10 |
| 21 | 32.00 | 41.40 | 30.20 | 63.80 | 36.00 | 27.40 | 29.20 |
| 22 | 7.40 | 1.50 | NA | 0.81 | 14.80 | 15.50 | 10.70 |
| 23 | 3.17 | 2.50 | NA | 2.12 | 4.03 | NA | 3.44 |
| 24 | 5.17 | 7.72 | 8.37 | 7.41 | 7.83 | 8.38 | 5.09 |
| 25 | 7.81 | 11.96 | 11.32 | 7.52 | 8.33 | 10.12 | 8.27 |
| 26 | 0.91 | 0.92 | 0.94 | 1.31 | 1.24 | 1.06 | 0.82 |
| 27 | 0.79 | 0.75 | 0.86 | 1.16 | 1.15 | 0.99 | 0.72 |
| 28 | 0.47 | 0.48 | 0.43 | 0.62 | 0.37 | 0.36 | 0.41 |
| 29 | 64.70 | 50.90 | 48.40 | 32.00 | 43.40 | 45.80 | 73.50 |
| 30 | 69.30 | 32.20 | NA | 15.80 | 66.40 | 75.10 | 71.20 |
| 31 | 92.00 | 58.80 | 110.90 | 113.10 | 116.60 | 149.90 | 107.40 |

Table 29: Provided are the values of each of the parameters measured in Barley accessions (36-42) according to the correlation identifications (see Table 23).

TABLE 30

Barley accessions (43-49), additional measured parameters

| Line/Corr. ID | Line-43 | Line-44 | Line-45 | Line-46 | Line-47 | Line-48 | Line-49 |
|---|---|---|---|---|---|---|---|
| 1 | 17.00 | 12.50 | 9.90 | 10.80 | 10.80 | 15.00 | 16.10 |
| 2 | 27.80 | 23.30 | 31.80 | 27.40 | 25.70 | 24.90 | 26.30 |
| 3 | 0.04 | 0.03 | 0.05 | 0.05 | 0.04 | 0.07 | 0.05 |
| 4 | 32.90 | 36.00 | 42.60 | 19.50 | 26.20 | 39.20 | 49.90 |
| 5 | 0.96 | 0.82 | 1.34 | 1.16 | 1.18 | 0.94 | 1.05 |
| 6 | 50.10 | 40.40 | 55.90 | 33.60 | 31.70 | 50.70 | 44.60 |
| 7 | 69.40 | 58.50 | 61.60 | 42.30 | 41.20 | 71.40 | 73.00 |
| 8 | 9.91 | 8.51 | 10.18 | 11.82 | 10.58 | 9.42 | 10.04 |
| 9 | 0.26 | 0.29 | 0.33 | 0.30 | 0.27 | 0.24 | 0.29 |
| 10 | 1.14 | 1.25 | 1.32 | 1.25 | 1.13 | 1.06 | 1.25 |
| 11 | 2.77 | 2.94 | 3.18 | 3.06 | 2.75 | 2.62 | 2.99 |
| 12 | 0.33 | 0.32 | 0.36 | 0.34 | 0.32 | 0.32 | 0.33 |
| 13 | 17.60 | 10.70 | 16.00 | 14.60 | 17.40 | 18.90 | 14.60 |
| 14 | NA | NA | NA | NA | NA | NA | NA |
| 15 | 0.47 | 0.25 | 0.53 | 0.43 | 0.45 | 0.47 | 0.40 |
| 16 | 1.00 | 1.00 | 1.00 | 1.00 | 1.00 | 1.00 | 1.00 |
| 17 | NA | NA | NA | NA | NA | NA | NA |
| 18 | 111.00 | 111.00 | 111.00 | 99.20 | 105.80 | 111.00 | 117.20 |
| 19 | 146.00 | 140.20 | 143.00 | 133.00 | 133.00 | 143.00 | 148.20 |
| 20 | 106.70 | 96.30 | 99.80 | 91.80 | 80.80 | 105.60 | 101.90 |
| 21 | 35.00 | 29.20 | 32.00 | 33.80 | 27.20 | 32.00 | 31.00 |
| 22 | 15.00 | 11.70 | 6.90 | 5.50 | 10.30 | 12.40 | 13.33 |
| 23 | 3.52 | 3.60 | 3.75 | 2.94 | 3.29 | 3.68 | 3.84 |
| 24 | 5.03 | 4.88 | 8.33 | 7.43 | 6.71 | 6.61 | 7.10 |
| 25 | 8.45 | 7.95 | 10.21 | 11.52 | 10.17 | 9.09 | 9.79 |
| 26 | 0.76 | 0.82 | 1.04 | 0.91 | 0.92 | 0.97 | 0.95 |
| 27 | 0.65 | 0.72 | 0.96 | 0.76 | 0.77 | 0.94 | 0.85 |
| 28 | 0.42 | 0.41 | 0.48 | 0.44 | 0.46 | 0.42 | 0.38 |
| 29 | 79.30 | 61.70 | 49.10 | 55.10 | 56.70 | 62.20 | 70.90 |
| 30 | 86.70 | 90.70 | 71.40 | 58.50 | 90.90 | 87.50 | 108.50 |
| 31 | 119.50 | 98.90 | 117.50 | 75.80 | 73.00 | 122.10 | 117.60 |

Table 30: Provided are the values of each of the parameters measured in Barley accessions (43-49) according to the correlation identifications (see Table 23).

TABLE 31

Barley accessions (50-55), additional measured parameters

| Line/Corr. ID | Line-50 | Line-51 | Line-52 | Line-53 | Line-54 | Line-55 |
|---|---|---|---|---|---|---|
| 1 | 31.10 | NA | 15.50 | 6.90 | 7.10 | 6.70 |
| 2 | 30.10 | 24.80 | 26.50 | 21.50 | 43.70 | 47.90 |
| 3 | NA | 0.04 | 0.04 | 0.05 | 0.05 | 0.05 |
| 4 | 37.90 | NA | 38.70 | 29.90 | 14.60 | 67.50 |
| 5 | 1.01 | 1.01 | 0.84 | 0.75 | 3.71 | 2.78 |
| 6 | 36.90 | 26.20 | 57.50 | 47.80 | 43.70 | 68.60 |
| 7 | 50.70 | 52.90 | 73.30 | 65.80 | 56.30 | NA |
| 8 | 9.40 | 11.67 | 10.60 | 9.72 | 8.26 | 9.22 |
| 9 | 0.31 | 0.33 | 0.26 | 0.25 | 0.25 | 0.28 |
| 10 | 1.26 | 1.36 | 1.17 | 1.10 | 0.88 | 1.05 |
| 11 | 3.06 | 3.24 | 2.90 | 2.65 | 2.24 | 2.56 |
| 12 | 0.35 | 0.33 | 0.33 | 0.32 | 0.40 | 0.38 |
| 13 | 13.60 | 13.10 | 19.80 | 17.20 | 65.40 | 43.80 |
| 14 | NA | NA | NA | NA | 34.60 | 54.00 |
| 15 | 0.40 | 0.32 | 0.50 | 0.38 | 2.64 | 2.06 |
| 16 | 1.00 | 1.00 | 1.00 | 1.00 | 5.00 | 1.80 |
| 17 | NA | NA | NA | NA | 0.35 | NA |
| 18 | 113.00 | 122.60 | 111.00 | 107.60 | 88.40 | 128.00 |
| 19 | 143.60 | 152.00 | 142.40 | 140.40 | 157.00 | 170.00 |
| 20 | 95.30 | 80.30 | 105.00 | 98.40 | 93.80 | 90.30 |
| 21 | 30.60 | 29.40 | 31.40 | 32.80 | 68.60 | 42.00 |
| 22 | 20.20 | NA | 18.30 | 6.60 | 2.50 | 3.10 |
| 23 | NA | NA | 3.66 | 3.41 | 2.18 | 4.23 |
| 24 | 6.86 | 8.62 | 7.16 | 5.75 | 10.74 | 10.04 |
| 25 | 9.38 | 11.73 | 10.01 | 8.78 | 8.54 | 8.59 |
| 26 | 0.94 | 0.97 | 0.94 | 0.89 | 1.68 | 1.57 |
| 27 | 0.87 | 0.87 | 0.86 | 0.77 | 1.49 | 1.45 |
| 28 | 0.42 | 0.33 | 0.44 | 0.42 | 0.44 | NA |
| 29 | 39.30 | 45.00 | 74.60 | 74.50 | 20.80 | 38.00 |
| 30 | 64.60 | NA | 113.50 | 95.60 | 15.60 | 43.20 |
| 31 | 87.70 | 79.10 | 130.80 | 113.60 | 100.00 | NA |

Table 31: Provided are the values of each of the parameters measured in Barley accessions (50-55) according to the correlation identifications (see Table 23).

TABLE 32

Measured parameters of correlation Ids in Barley Hordeum spontaneum accessions

| Line/Corr. ID | Line-21 | Line-22 | Line-24 | Line-25 | Line-26 | Line-27 | Line-28 |
|---|---|---|---|---|---|---|---|
| 1 | 6.60 | 3.50 | 31.10 | NA | NA | 11.10 | 21.70 |
| 2 | 42.00 | 18.60 | 39.70 | 24.40 | 28.40 | 28.40 | 23.50 |
| 3 | 0.05 | 0.03 | 0.05 | 0.05 | 0.04 | 0.05 | 0.05 |
| 4 | 41.60 | 174.80 | 51.80 | NA | NA | 38.50 | 38.80 |
| 5 | 1.36 | 0.90 | 1.22 | 0.91 | 0.92 | 1.08 | 0.95 |
| 6 | 64.50 | 33.60 | 52.10 | 33.30 | 47.70 | 52.80 | 52.50 |
| 7 | 91.80 | 50.20 | 67.20 | 43.40 | 79.50 | 61.10 | 59.70 |
| 8 | NA | 9.74 | 8.69 | 8.90 | 10.13 | 10.61 | 9.60 |
| 9 | 0.24 | 0.25 | 0.25 | 0.27 | 0.25 | 0.25 | 0.24 |
| 10 | 0.94 | 1.11 | 0.96 | 1.20 | 1.07 | 1.08 | 1.11 |
| 11 | 2.45 | 2.65 | 2.44 | 2.90 | 2.62 | 2.66 | 2.68 |
| 12 | 0.36 | 0.31 | 0.37 | 0.32 | 0.32 | 0.33 | 0.31 |
| 13 | 19.90 | 16.30 | 17.50 | 12.00 | 20.00 | 20.00 | 17.00 |
| 14 | NA | NA | NA | NA | NA | NA | NA |
| 15 | 0.78 | 0.31 | 0.67 | 0.31 | 0.56 | 0.56 | 0.38 |
| 16 | 1.00 | 1.00 | 1.00 | 1.00 | 1.00 | 1.00 | 1.00 |
| 17 | NA | NA | NA | NA | NA | NA | NA |
| 18 | 119.40 | 95.60 | 111.00 | 83.60 | 122.00 | 111.40 | 109.20 |
| 19 | 170.00 | 133.00 | 145.80 | 140.20 | 153.00 | 143.00 | 140.40 |
| 20 | 94.80 | 90.50 | 90.10 | 92.50 | 99.10 | 91.70 | 94.70 |
| 21 | 50.60 | 37.40 | 34.80 | 56.60 | 31.00 | 31.60 | 31.20 |
| 22 | 4.62 | 1.88 | 15.50 | NA | NA | 7.10 | 15.70 |
| 23 | 3.74 | 5.01 | 3.97 | NA | NA | 3.67 | 3.68 |
| 24 | 7.28 | 4.98 | 6.52 | 5.39 | 8.16 | 8.08 | 5.73 |
| 25 | 10.99 | 8.58 | 8.63 | 7.96 | 10.20 | 10.52 | 8.35 |
| 26 | 0.90 | 0.79 | 1.01 | 0.88 | 1.05 | 1.01 | 0.90 |
| 27 | 0.76 | 0.68 | 0.88 | 0.81 | 0.97 | 0.92 | 0.78 |
| 28 | 0.41 | 0.41 | 0.44 | 0.44 | 0.38 | 0.46 | 0.47 |
| 29 | 73.10 | 88.10 | 48.50 | 51.30 | 65.80 | 55.80 | 65.60 |

TABLE 32-continued

Measured parameters of correlation Ids in Barley Hordeum spontaneum accessions

| Line/Corr. ID | Line-21 | Line-22 | Line-24 | Line-25 | Line-26 | Line-27 | Line-28 |
|---|---|---|---|---|---|---|---|
| 30 | 69.90 | 55.20 | 48.50 | NA | NA | 69.00 | 76.40 |
| 31 | 156.30 | 83.80 | 119.30 | 76.70 | 127.20 | 113.90 | 112.20 |

Table 32: Provided are the values of each of the parameters measured in Barley Hordeum spontaneum accessions (21-22, 24-28) according to the correlation identifications (see Table 23).

TABLE 33

Measured parameters of correlation Ids in Barley Hordeum spontaneum accessions

| Line/Corr. ID | Line30 | Line-31 | Line-32 | Line-33 | Line-34 | Line-36 | Line-37 |
|---|---|---|---|---|---|---|---|
| 1 | 16.50 | 3.20 | 10.50 | 26.50 | 15.10 | 9.50 | 4.70 |
| 2 | 26.50 | 23.10 | 27.60 | 29.40 | 27.70 | 26.40 | 19.80 |
| 3 | 0.04 | 0.04 | 0.05 | 0.04 | 0.06 | 0.06 | 0.03 |
| 4 | 29.60 | 14.30 | 37.70 | 39.20 | 34.50 | 23.80 | 11.90 |
| 5 | 0.85 | 0.85 | 0.89 | 1.10 | 1.09 | 0.74 | 1.15 |
| 6 | 47.00 | 48.90 | 47.30 | 48.80 | 46.60 | 43.50 | 27.40 |
| 7 | 60.40 | 67.40 | 67.10 | 61.30 | 59.00 | 48.60 | 31.50 |
| 8 | 8.24 | 9.14 | 8.71 | 9.82 | 10.00 | 8.36 | 12.49 |
| 9 | 0.25 | 0.24 | 0.29 | 0.33 | 0.29 | 0.30 | 0.26 |
| 10 | 1.09 | 1.06 | 1.23 | 1.33 | 1.27 | 1.30 | 1.11 |
| 11 | 2.66 | 2.57 | 2.93 | 3.16 | 2.99 | 3.17 | 2.74 |
| 12 | 0.32 | 0.32 | 0.34 | 0.34 | 0.32 | 0.31 | 0.32 |
| 13 | 18.20 | 13.50 | 12.80 | 14.50 | 13.70 | 11.30 | 16.10 |
| 14 | NA | NA | NA | NA | NA | NA | NA |
| 15 | 0.46 | 0.31 | 0.37 | 0.43 | 0.39 | 0.24 | 0.32 |
| 16 | 1.00 | 1.00 | 1.00 | 1.00 | 1.00 | 1.00 | 1.00 |
| 17 | NA | NA | NA | NA | NA | NA | NA |
| 18 | 104.00 | 89.20 | 97.80 | 113.60 | 109.20 | 108.40 | 91.60 |
| 19 | 140.20 | 140.40 | 140.40 | 145.80 | 143.00 | 140.40 | 133.00 |
| 20 | 105.80 | 112.20 | 103.80 | 105.70 | 107.40 | 106.30 | 78.30 |
| 21 | 36.20 | 51.20 | 42.60 | 32.20 | 33.80 | 32.00 | 41.40 |
| 22 | 12.30 | 1.10 | 8.50 | 18.67 | 11.00 | 7.40 | 1.50 |
| 23 | 3.42 | 2.67 | 3.64 | 3.65 | 3.51 | 3.17 | 2.50 |
| 24 | 4.69 | 5.47 | 5.92 | 6.16 | 6.88 | 5.17 | 7.72 |
| 25 | 6.85 | 8.51 | 8.32 | 9.80 | 9.28 | 7.81 | 11.96 |
| 26 | 0.91 | 0.85 | 0.96 | 0.83 | 0.94 | 0.91 | 0.93 |
| 27 | 0.81 | 0.75 | 0.83 | 0.74 | 0.88 | 0.79 | 0.76 |
| 28 | 0.44 | 0.42 | 0.41 | 0.41 | 0.44 | 0.47 | 0.48 |
| 29 | 77.10 | 85.00 | 67.50 | 50.90 | 55.70 | 64.70 | 50.90 |
| 30 | 76.60 | 35.30 | 75.30 | 68.50 | 66.80 | 69.30 | 32.20 |
| 31 | 107.40 | 116.30 | 114.40 | 104.50 | 105.60 | 92.00 | 58.80 |

Table 33: Provided are the values of each of the parameters measured in Barley Hordeum spontaneum accessions (30-34, 36-37) according to the correlation identifications (see Table 23).

TABLE 34

Measured parameters of correlation Ids in Barley Hordeum spontaneum accessions

| Line/Corr. ID | Line-38 | Line-41 | Line-42 | Line-43 | Line-44 | Line-45 | Line-46 |
|---|---|---|---|---|---|---|---|
| 1 | NA | 21.20 | 14.50 | 17.00 | 12.50 | 9.90 | 10.80 |
| 2 | 31.00 | 36.90 | 24.20 | 27.80 | 23.30 | 31.80 | 27.40 |
| 3 | 0.04 | NA | 0.06 | 0.04 | 0.03 | 0.05 | 0.05 |
| 4 | NA | 55.90 | 31.30 | 32.90 | 36.00 | 42.60 | 19.50 |
| 5 | 1.32 | 1.40 | 0.93 | 0.96 | 0.82 | 1.34 | 1.16 |
| 6 | 44.60 | 50.50 | 44.00 | 50.10 | 40.40 | 55.90 | 33.60 |
| 7 | 59.30 | 91.80 | 63.40 | 69.40 | 58.50 | 61.60 | 42.30 |
| 8 | 11.03 | 10.44 | 8.66 | 9.91 | 8.51 | 10.18 | 11.82 |
| 9 | 0.26 | 0.28 | 0.30 | 0.26 | 0.29 | 0.33 | 0.30 |
| 10 | 1.10 | 1.09 | 1.28 | 1.14 | 1.25 | 1.32 | 1.25 |
| 11 | 2.69 | 2.67 | 3.05 | 2.77 | 2.94 | 3.18 | 3.06 |
| 12 | 0.33 | 0.36 | 0.33 | 0.33 | 0.32 | 0.36 | 0.34 |
| 13 | 21.70 | 20.80 | 11.50 | 17.60 | 10.70 | 16.00 | 14.60 |
| 14 | NA | NA | NA | NA | NA | NA | NA |
| 15 | 0.66 | 0.75 | 0.31 | 0.47 | 0.25 | 0.53 | 0.43 |
| 16 | 1.00 | 1.40 | 1.00 | 1.00 | 1.00 | 1.00 | 1.00 |
| 17 | NA | NA | NA | NA | NA | NA | NA |
| 18 | 115.60 | 116.80 | 111.00 | 111.00 | 111.00 | 111.00 | 99.20 |
| 19 | 145.80 | 144.20 | 140.20 | 146.00 | 140.20 | 143.00 | 133.00 |
| 20 | 107.60 | 126.10 | 107.10 | 106.70 | 96.30 | 99.80 | 91.80 |
| 21 | 30.20 | 27.40 | 29.20 | 35.00 | 29.20 | 32.00 | 33.80 |
| 22 | NA | 15.50 | 10.70 | 15.00 | 11.70 | 6.90 | 5.50 |
| 23 | NA | NA | 3.44 | 3.52 | 3.60 | 3.75 | 2.94 |
| 24 | 8.37 | 8.38 | 5.09 | 5.03 | 4.88 | 8.33 | 7.43 |
| 25 | 11.32 | 10.12 | 8.27 | 8.45 | 7.95 | 10.21 | 11.52 |
| 26 | 0.94 | 1.06 | 0.82 | 0.76 | 0.82 | 1.04 | 0.91 |
| 27 | 0.86 | 0.99 | 0.72 | 0.65 | 0.72 | 0.97 | 0.76 |
| 28 | 0.43 | 0.36 | 0.41 | 0.42 | 0.41 | 0.48 | 0.44 |
| 29 | 48.40 | 45.80 | 73.50 | 79.30 | 61.70 | 49.10 | 55.10 |
| 30 | NA | 75.10 | 71.20 | 86.70 | 90.70 | 71.40 | 58.50 |
| 31 | 110.90 | 149.90 | 107.40 | 119.50 | 98.90 | 117.50 | 75.80 |

Table 34: Provided are the values of each of the parameters measured in Barley Hordeum spontaneum accessions (38, 41-46) according to the correlation identifications (see Table 23).

TABLE 35

Measured parameters of correlation Ids in Barley Hordeum spontaneum accessions

| Line/Corr. ID | Line-47 | Line-48 | Line-49 | Line-51 | Line-52 | Line-53 |
|---|---|---|---|---|---|---|
| 1 | 10.80 | 15.00 | 16.10 | NA | 15.50 | 6.90 |
| 2 | 25.70 | 24.90 | 26.30 | 24.80 | 26.50 | 21.50 |
| 3 | 0.04 | 0.07 | 0.05 | 0.04 | 0.04 | 0.05 |
| 4 | 26.20 | 39.20 | 49.90 | NA | 38.70 | 29.90 |
| 5 | 1.18 | 0.94 | 1.05 | 1.01 | 0.84 | 0.75 |
| 6 | 31.70 | 50.70 | 44.60 | 26.20 | 57.50 | 47.80 |
| 7 | 41.20 | 71.40 | 73.00 | 52.90 | 73.30 | 65.80 |
| 8 | 10.58 | 9.42 | 10.04 | 11.67 | 10.60 | 9.72 |
| 9 | 0.27 | 0.24 | 0.29 | 0.33 | 0.26 | 0.25 |
| 10 | 1.13 | 1.06 | 1.25 | 1.36 | 1.17 | 1.10 |
| 11 | 2.75 | 2.62 | 2.99 | 3.24 | 2.90 | 2.65 |
| 12 | 0.32 | 0.32 | 0.33 | 0.33 | 0.33 | 0.32 |
| 13 | 17.40 | 18.90 | 14.60 | 13.10 | 19.80 | 17.20 |
| 14 | NA | NA | NA | NA | NA | NA |
| 15 | 0.45 | 0.47 | 0.40 | 0.32 | 0.50 | 0.38 |
| 16 | 1.00 | 1.00 | 1.00 | 1.00 | 1.00 | 1.00 |
| 17 | NA | NA | NA | NA | NA | NA |
| 18 | 105.80 | 111.00 | 117.20 | 122.60 | 111.00 | 107.60 |
| 19 | 133.00 | 143.00 | 148.20 | 152.00 | 142.40 | 140.40 |
| 20 | 80.80 | 105.60 | 101.90 | 80.30 | 105.00 | 98.40 |
| 21 | 27.20 | 32.00 | 31.00 | 29.40 | 31.40 | 32.80 |
| 22 | 10.30 | 12.40 | 13.33 | NA | 18.30 | 6.60 |
| 23 | 3.29 | 3.68 | 3.84 | NA | 3.66 | 3.41 |
| 24 | 6.71 | 6.61 | 7.10 | 8.62 | 7.16 | 5.75 |
| 25 | 10.17 | 9.09 | 9.79 | 11.73 | 10.01 | 8.78 |
| 26 | 0.92 | 0.97 | 0.95 | 0.97 | 0.94 | 0.90 |
| 27 | 0.77 | 0.94 | 0.85 | 0.87 | 0.86 | 0.78 |
| 28 | 0.46 | 0.42 | 0.38 | 0.33 | 0.44 | 0.42 |
| 29 | 56.70 | 62.20 | 70.90 | 45.00 | 74.60 | 74.50 |

TABLE 35-continued

Measured parameters of correlation Ids in Barley *Hordeum spontaneum* accessions

| Line/Corr. ID | Line-47 | Line-48 | Line-49 | Line-51 | Line-52 | Line-53 |
|---|---|---|---|---|---|---|
| 30 | 90.90 | 87.50 | 108.50 | NA | 113.50 | 95.60 |
| 31 | 73.00 | 122.10 | 117.60 | 79.10 | 130.80 | 113.60 |

Table 35: Provided are the values of each of the parameters measured in Barley *Hordeum spontaneum* accessions (47-49, 51-53) according to the correlation identifications (see Table 23).

TABLE 36

Measured parameters of correlation Ids in Barley *Hordeum vulgare* accessions

| Line/Corr. ID | Line-1 | Line-2 | Line-4 | Line-5 | Line-6 | Line-8 | Line-9 |
|---|---|---|---|---|---|---|---|
| 1 | 4.30 | 18.30 | 40.20 | 33.20 | NA | 16.70 | 5.60 |
| 2 | 50.10 | 50.00 | 52.40 | 47.20 | 49.30 | 61.30 | 50.00 |
| 3 | 0.053 | 0.059 | 0.051 | 0.053 | 0.047 | 0.052 | 0.062 |
| 4 | 11.30 | 52.60 | 126.90 | 60.60 | NA | 44.60 | 9.70 |
| 5 | 3.33 | 1.56 | 3.11 | 3.18 | 2.85 | 4.13 | 3.47 |
| 6 | 80.90 | 60.50 | 69.40 | 61.00 | 63.20 | 91.90 | 99.10 |
| 7 | 46.30 | 85.00 | 127.40 | 79.50 | 83.00 | 82.90 | 56.80 |
| 8 | 9.57 | NA | 7.93 | 8.13 | NA | 5.65 | 7.94 |
| 9 | 0.30 | 0.28 | 0.30 | 0.29 | 0.29 | 0.33 | 0.29 |
| 10 | 1.09 | 0.97 | 1.07 | 1.09 | 1.07 | 1.15 | 1.09 |
| 11 | 2.62 | 2.41 | 2.67 | 2.62 | 2.59 | 2.78 | 2.66 |
| 12 | 0.40 | 0.41 | 0.41 | 0.39 | 0.39 | 0.42 | 0.40 |
| 13 | 56.50 | 21.10 | 44.40 | 47.10 | 43.50 | 58.30 | 56.00 |
| 14 | 65.00 | 37.50 | 51.70 | 49.10 | 46.40 | 78.20 | 79.90 |
| 15 | 2.91 | 1.02 | 2.33 | 2.23 | 2.14 | 3.47 | 2.60 |
| 16 | 4.20 | 1.00 | 2.60 | 2.60 | 1.00 | 1.00 | 5.00 |
| 17 | 0.51 | 0.25 | 0.26 | 0.35 | 0.32 | 0.45 | 0.51 |
| 18 | 90.80 | 124.40 | NA | 122.00 | NA | 111.60 | 86.80 |
| 19 | 148.00 | 170.00 | 170.00 | 167.40 | 170.00 | 156.20 | 159.60 |
| 20 | 84.00 | 79.90 | 122.50 | 108.00 | 87.00 | 104.00 | 70.80 |
| 21 | 57.20 | 45.60 | NA | 48.00 | NA | 44.60 | 72.80 |
| 22 | 1.00 | 9.20 | 19.20 | 14.62 | NA | 6.30 | 1.20 |
| 23 | 2.45 | 3.96 | 4.75 | 4.12 | NA | 3.82 | 2.30 |
| 24 | 9.90 | 7.82 | 11.07 | 10.17 | 9.98 | 9.89 | 9.58 |
| 25 | 9.49 | 10.26 | 7.97 | 8.42 | 8.12 | 6.39 | 7.73 |
| 26 | 1.41 | 1.05 | 1.79 | 1.60 | 1.61 | 1.93 | 1.59 |
| 27 | 1.23 | 0.87 | 1.68 | 1.47 | 1.51 | 1.83 | 1.50 |
| 28 | 0.64 | 0.42 | 0.35 | 0.44 | 0.43 | 0.52 | 0.64 |
| 29 | 45.30 | 56.30 | 32.40 | 35.40 | 36.70 | 32.10 | 48.50 |
| 30 | 24.00 | 48.70 | 47.60 | 45.00 | NA | 38.50 | 21.50 |
| 31 | 127.20 | 145.50 | 196.80 | 140.50 | 146.20 | 178.60 | 155.90 |

Table 36: Provided are the values of each of the parameters measured in Barley *Hordeum vulgare* accessions (1-2, 4-6, 8-9) according to the correlation identifications (see Table 23).

TABLE 37

Measured parameters of correlation Ids in Barley *Hordeum vulgare* accessions

| Line/Corr. ID | Line-10 | Line-11 | Line-12 | Line-13 | Line-14 | Line-15 | Line-16 |
|---|---|---|---|---|---|---|---|
| 1 | 5.30 | 18.30 | 4.00 | 8.80 | 4.80 | 29.50 | 5.00 |
| 2 | 51.70 | 56.50 | 54.00 | 50.40 | 56.80 | 58.00 | 51.40 |
| 3 | 0.051 | 0.062 | 0.060 | 0.056 | 0.046 | 0.051 | 0.037 |
| 4 | 38.20 | 46.70 | 42.30 | 11.60 | 9.30 | 47.60 | 30.90 |
| 5 | 3.15 | 1.88 | 3.35 | 3.60 | 3.24 | 3.12 | 1.69 |
| 6 | 67.00 | 60.20 | 87.60 | 71.80 | 76.70 | 81.10 | 77.90 |
| 7 | 64.10 | 54.20 | 73.20 | 49.50 | 47.60 | 66.50 | 77.50 |
| 8 | 8.55 | 10.59 | 7.44 | 7.36 | 9.60 | 6.23 | NA |
| 9 | 0.30 | 0.28 | 0.30 | 0.28 | 0.32 | 0.34 | 0.27 |
| 10 | 1.08 | 0.88 | 1.03 | 0.96 | 1.12 | 1.22 | 0.89 |
| 11 | 2.63 | 2.28 | 2.54 | 2.37 | 2.71 | 2.90 | 2.28 |
| 12 | 0.39 | 0.45 | 0.42 | 0.41 | 0.41 | 0.41 | 0.42 |
| 13 | 59.10 | 27.30 | 55.90 | 61.50 | 50.80 | 45.50 | 24.80 |
| 14 | 54.30 | 46.40 | 71.90 | 56.20 | 61.60 | 64.80 | 56.40 |
| 15 | 2.84 | 1.51 | 2.84 | 2.98 | 2.85 | 2.39 | 1.21 |
| 16 | 3.00 | 1.00 | 1.00 | 2.20 | 3.00 | 1.00 | 1.00 |
| 17 | 0.41 | 0.40 | 0.45 | 0.48 | 0.50 | 0.44 | 0.36 |
| 18 | 106.20 | 117.80 | 111.60 | 85.40 | 90.00 | 113.20 | 113.40 |
| 19 | 157.00 | 162.20 | 159.60 | 157.00 | 150.50 | 158.00 | 170.00 |
| 20 | 98.10 | 57.90 | 94.50 | 73.20 | 78.70 | 90.70 | 64.30 |
| 21 | 50.80 | 44.40 | 46.00 | 71.60 | 61.50 | 44.80 | 56.60 |
| 22 | 2.10 | 10.00 | 2.60 | 1.62 | 1.00 | 17.00 | 3.00 |
| 23 | 3.60 | 3.83 | 3.63 | 2.43 | 2.26 | 3.89 | 3.46 |
| 24 | 11.19 | 8.76 | 10.49 | 10.83 | 11.23 | 7.89 | 9.15 |
| 25 | 8.45 | 10.55 | 7.60 | 7.87 | 9.42 | 6.68 | 12.05 |
| 26 | 1.71 | 1.17 | 1.75 | 1.72 | 1.58 | 1.52 | 1.03 |
| 27 | 1.57 | 0.96 | 1.63 | 1.63 | 1.43 | 1.45 | 0.88 |
| 28 | 0.51 | 0.53 | 0.55 | 0.61 | 0.62 | 0.55 | 0.50 |
| 29 | 29.80 | 50.80 | 32.40 | 26.80 | 42.40 | 39.70 | 71.30 |
| 30 | 36.10 | 57.20 | 42.20 | 19.10 | 21.60 | 59.80 | 62.50 |
| 31 | 131.10 | 114.50 | 160.80 | 121.30 | 124.30 | 147.70 | 155.40 |

Table 37: Provided are the values of each of the parameters measured in Barley *Hordeum vulgare* accessions (10-16) according to the correlation identifications (see Table 23).

TABLE 38

Measured parameters of correlation Ids in Barley Hordeum vulgare accessions

| Line/Corr. ID | Line-17 | Line-18 | Line-19 | Line-54 | Line-55 |
|---|---|---|---|---|---|
| 1 | 3.70 | 11.40 | 5.10 | 7.10 | 6.70 |
| 2 | 58.10 | 53.40 | 48.70 | 43.70 | 47.90 |
| 3 | 0.047 | 0.043 | 0.056 | 0.053 | 0.054 |
| 4 | NA | 35.50 | 38.40 | 14.60 | 67.50 |
| 5 | 1.66 | 3.50 | 1.16 | 3.71 | 2.78 |
| 6 | 68.20 | 70.70 | 54.10 | 43.70 | 68.60 |
| 7 | 81.60 | 67.90 | 81.10 | 56.30 | NA |
| 8 | NA | 8.57 | NA | 8.26 | 9.22 |
| 9 | 0.30 | 0.30 | 0.26 | 0.25 | 0.28 |
| 10 | 0.96 | 1.08 | 0.83 | 0.88 | 1.05 |
| 11 | 2.42 | 2.65 | 2.16 | 2.24 | 2.56 |
| 12 | 0.44 | 0.40 | 0.42 | 0.40 | 0.38 |
| 13 | 21.10 | 59.70 | 17.50 | 65.40 | 43.80 |
| 14 | 49.70 | 55.00 | 40.30 | 34.60 | 54.00 |
| 15 | 1.18 | 2.93 | 0.83 | 2.64 | 2.06 |
| 16 | 3.80 | 3.80 | 1.00 | 5.00 | 1.80 |
| 17 | 0.33 | 0.40 | 0.29 | 0.35 | NA |
| 18 | 98.50 | 109.60 | 119.40 | 88.40 | 128.00 |
| 19 | 170.00 | 155.20 | 170.00 | 157.00 | 170.00 |
| 20 | 82.70 | 94.10 | 63.50 | 93.80 | 90.30 |
| 21 | 71.50 | 45.60 | 50.60 | 68.60 | 42.00 |
| 22 | 1.00 | 3.80 | 4.20 | 2.50 | 3.10 |
| 23 | NA | 3.60 | 3.64 | 2.18 | 4.23 |
| 24 | 8.57 | 11.30 | 7.04 | 10.74 | 10.04 |
| 25 | 10.74 | 8.60 | 8.94 | 8.54 | 8.59 |
| 26 | 1.10 | 1.72 | 1.08 | 1.68 | 1.57 |
| 27 | 0.92 | 1.56 | 0.92 | 1.49 | 1.45 |
| 28 | 0.45 | 0.51 | 0.39 | 0.44 | NA |
| 29 | 65.40 | 33.30 | 82.50 | 20.80 | 38.00 |
| 30 | 31.20 | 34.00 | 78.90 | 15.60 | 43.20 |
| 31 | 149.80 | 138.60 | 135.20 | 100.00 | NA |

Table 38: Provided are the values of each of the parameters measured in Barley Hordeum vulgare accessions (17-19, 54-55) according to the correlation identifications (see Table 23).

TABLE 39

Correlation between the expression level of the selected polynucleotides of the invention and their homologues in specific tissues or developmental stages and the phenotypic performance across all 55 Barley accessions

| Gene Name | R | P value | Exp. set | Corr. ID |
|---|---|---|---|---|
| MGP46 | 0.80 | 5.64E−05 | 1 | 14 |

Table 39. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components according to the Corr. ID (correlation vector) specified in Table 23;
Exp. Set = expression set specified in Table 22.

TABLE 40

Correlation between the expression level of the selected polynucleotides of the invention and their homologues in specific tissues or developmental stages and the phenotypic performance across 27 Barley Hordeum spontaneum accessions

| Gene Name | R | P value | Exp. set | Corr. ID |
|---|---|---|---|---|
| LBY263 | 0.70 | 1.28E−04 | 3 | 2 |
| LBY263 | 0.86 | 8.97E−08 | 3 | 19 |
| MGP46 | 0.71 | 4.96E−04 | 3 | 30 |

Table 40. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components according to the Corr. ID (correlation vector) specified in Table 23;
Exp. Set = expression set specified in Table 22.

TABLE 41

Correlation between the expression level of the selected polynucleotides of the invention and their homologues in specific tissues or developmental stages and the phenotypic performance across 19 Barley Hordeum vulgare accessions

| Gene Name | R | P value | Exp. set | Corr. ID |
|---|---|---|---|---|
| LBY263 | 0.76 | 3.61E−04 | 1 | 7 |
| LBY263 | 0.78 | 3.84E−04 | 1 | 4 |
| LBY363 | 0.74 | 1.05E−03 | 1 | 4 |

Table 41: Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components according to the Corr. ID (correlation vector) specified in Table 23;
Exp. Set = expression set specified in Table 22.

Example 3

Production of Arabidopsis Transcriptome and High Throughput Correlation Analysis of Yield, Biomass and/or Vigor Related Parameters Using 44K Arabidopsis Full Genome Oligonucleotide Micro-Array To produce a high throughput correlation analysis, the present inventors utilized an Arabidopsis thaliana oligonucleotide micro-array, produced by Agilent Technologies [chem. (dot) agilent (dot) com/Scripts/PDS (dot) asp?lPage=50879]. The array oligonucleotide represents about 40,000 A. thaliana genes and transcripts designed based on data from the TIGR ATH1 v. 5 database and Arabidopsis MPSS (University of Delaware) databases. To define correlations between the levels of RNA expression and yield, biomass components or vigor related parameters, various plant characteristics of 15 different Arabidopsis ecotypes were analyzed. Among them, nine ecotypes encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

The Arabidopsis plants were grown in a greenhouse under normal (standard) and controlled growth conditions which included a temperature of 22° C., and a fertilizer [N:P:K fertilizer (20:20:20; weight ratios) of nitrogen (N), phosphorus (P) and potassium (K)].

Analyzed Arabidopsis tissues—Five tissues at different developmental stages including root, leaf, flower at anthesis, seed at 5 days after flowering (DAF) and seed at 12 DAF, representing different plant characteristics, were sampled and RNA was extracted as described as described hereinabove under "GENERAL EXPERIMENTAL AND BIOINFORMATICS METHODS". For convenience, each microarray expression information tissue type has received a Set ID as summarized in Table 42 below.

TABLE 42

Tissues used for Arabidopsis transcriptome expression sets

| Expression Set | Set ID |
|---|---|
| Leaf | 1 |
| Root | 2 |

TABLE 42-continued

Tissues used for *Arabidopsis* transcriptome expression sets

| Expression Set | Set ID |
|---|---|
| Seed 5 DAF | 3 |
| Flower | 4 |
| Seed 12 DAF | 5 |

Table 42: Provided are the identification (ID) digits of each of the *Arabidopsis* expression sets (1-5).
DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled normal growth conditions in 22° C., and the N:P:K [nitrogen (N), phosphorus (P) and potassium (K)] fertilizer (20:20:20; weight ratios) was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture (seedling assay)—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S. National Institutes of Health and is freely available on the internet at rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of root coverage was calculated according to Formula 28 above.

Vegetative growth rate analysis—was calculated according to Formula 7 above. The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra—Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The vegetative portion above ground was separated from the seeds. The total weight of the vegetative portion above ground and the seed weight of each plot were measured and divided by the number of plants.

Dry weight (vegetative biomass)=total weight of the vegetative portion above ground (excluding roots) after drying at 30° C. in a drying chamber; all the above ground biomass that is not seed yield.

Seed yield per plant=total seed weight per plant (gr.).

Oil yield—The oil yield was calculated using Formula 29 above.

Harvest Index (seed)—The harvest index was calculated using Formula 15 (described above).

Experimental Results

Nine different *Arabidopsis* ecotypes were grown and characterized for 18 parameters (named as vectors).

TABLE 43

Arabidopsis correlated parameters (vectors)

| Correlated parameter with | Corr. ID |
|---|---|
| Seeds per Pod [num], under Normal growth conditions | 1 |
| Harvest index, under Normal growth conditions | 2 |
| Seed yield per plant [gr.], under Normal growth conditions | 3 |
| Dry matter per plant [gr.], under Normal growth conditions | 4 |
| Total leaf area per plant [$cm^2$], under Normal growth conditions | 5 |
| Oil % per seed [%], under Normal growth conditions | 6 |
| Oil yield per plant [mg], under Normal growth conditions | 7 |
| Relative root length growth day 13 [cm/day], under Normal growth conditions | 8 |
| Root length day 7 [cm], under Normal growth conditions | 9 |
| Root length day 13 [cm], under Normal growth conditions | 10 |
| Fresh weight per plant at bolting stage [gr.], under Normal growth conditions | 11 |
| 1000 Seed weight [gr.], under Normal growth conditions | 12 |
| Vegetative growth rate till 8 true leaves [$cm^2$/day], under Normal growth conditions | 13 |
| Lamina length [cm], under Normal growth conditions | 14 |
| Lamina width [cm], under Normal growth conditions | 15 |
| Leaf width/length [cm/cm], under Normal growth conditions | 16 |
| Blade circularity [ratio], under Normal growth conditions | 17 |
| Silique length [cm], under Normal growth conditions | 18 |

Table 43. Provided are the *Arabidopsis* correlated parameters (correlation ID Nos. 1-18) Abbreviations:
Cm = centimeter(s);
gr. = gram(s);
mg = milligram(s).

The characterized values are summarized in Table 44. Correlation analysis is provided in Table 45 below.

TABLE 44

Measured parameters in Arabidopsis ecotypes

| Line/Corr. ID | Line-1 | Line-2 | Line-3 | Line-4 | Line-5 | Line-6 | Line-7 | Line-8 | Line-9 |
|---|---|---|---|---|---|---|---|---|---|
| 1 | 45.40 | 53.50 | 58.50 | 35.30 | 48.60 | 37.00 | 39.40 | 40.50 | 25.50 |
| 2 | 0.53 | 0.35 | 0.56 | 0.33 | 0.37 | 0.32 | 0.45 | 0.51 | 0.41 |
| 3 | 0.34 | 0.44 | 0.59 | 0.42 | 0.61 | 0.43 | 0.36 | 0.62 | 0.55 |
| 4 | 0.64 | 1.27 | 1.05 | 1.28 | 1.69 | 1.34 | 0.81 | 1.21 | 1.35 |
| 5 | 46.90 | 109.90 | 58.40 | 56.80 | 114.70 | 110.80 | 88.50 | 121.80 | 93.00 |
| 6 | 34.40 | 31.20 | 38.00 | 27.80 | 35.50 | 32.90 | 31.60 | 30.80 | 34.00 |
| 7 | 118.60 | 138.70 | 224.10 | 116.30 | 218.30 | 142.10 | 114.20 | 190.10 | 187.60 |
| 8 | 0.63 | 0.66 | 1.18 | 1.09 | 0.91 | 0.77 | 0.61 | 0.70 | 0.78 |
| 9 | 0.94 | 1.76 | 0.70 | 0.73 | 0.99 | 1.16 | 1.28 | 1.41 | 1.25 |
| 10 | 4.42 | 8.53 | 5.62 | 4.83 | 5.96 | 6.37 | 5.65 | 7.06 | 7.04 |
| 11 | 1.51 | 3.61 | 1.94 | 2.08 | 3.56 | 4.34 | 3.47 | 3.48 | 3.71 |
| 12 | 0.02 | 0.02 | 0.03 | 0.03 | 0.02 | 0.03 | 0.02 | 0.02 | 0.02 |
| 13 | 0.31 | 0.38 | 0.48 | 0.47 | 0.43 | 0.65 | 0.43 | 0.38 | 0.47 |
| 14 | 2.77 | 3.54 | 3.27 | 3.78 | 3.69 | 4.60 | 3.88 | 3.72 | 4.15 |
| 15 | 1.38 | 1.70 | 1.46 | 1.37 | 1.83 | 1.65 | 1.51 | 1.82 | 1.67 |
| 16 | 0.35 | 0.29 | 0.32 | 0.26 | 0.36 | 0.27 | 0.31 | 0.34 | 0.31 |
| 17 | 0.51 | 0.48 | 0.45 | 0.37 | 0.50 | 0.38 | 0.39 | 0.49 | 0.41 |
| 18 | 1.06 | 1.26 | 1.31 | 1.47 | 1.24 | 1.09 | 1.18 | 1.18 | 1.00 |

Table 44: Provided are the values of each of the parameters measured in *Arabidopsis* ecotypes.

TABLE 45

Correlation between the expression level of selected genes of some embodiments of the invention in various tissues and the phenotypic performance under normal conditions across Arabidopsis accessions

| Gene Name | R | P value | Exp. set | Corr. ID |
|---|---|---|---|---|
| LBY311 | 0.75 | 3.25E−02 | 5 | 11 |
| LBY311 | 0.74 | 3.45E−02 | 5 | 14 |
| LBY362 | 0.91 | 3.91E−03 | 3 | 4 |
| LBY362 | 0.84 | 1.75E−02 | 3 | 5 |
| LBY362 | 0.93 | 2.01E−03 | 3 | 15 |
| LBY362 | 0.72 | 4.33E−02 | 1 | 16 |
| LBY362 | 0.76 | 2.93E−02 | 1 | 17 |
| MGP92 | 0.72 | 6.93E−02 | 3 | 7 |
| MGP92 | 0.74 | 3.76E−02 | 5 | 10 |
| MGP92 | 0.80 | 1.73E−02 | 4 | 13 |
| MGP92 | 0.72 | 4.34E−02 | 4 | 14 |

Table 45: Provided are the correlations (R) between the expression levels of yield improving genes and their homologues in tissues [leaf, flower, seed and root; Expression sets (Exp)] and the phenotypic performance in various yield, biomass, growth rate and/or vigor components [Correlation (corr.) vector ID] under normal conditions across *Arabidopsis* accessions.

"Corr. ID"—correlation ID according to the correlated parameters specified in Table 43.

"Exp. Set"—Expression set specified in Table 42.

"R" = Pearson correlation coefficient;

"P" = p value.

Example 4

Production of *Arabidopsis* Transcriptome and High Throughput Correlation Analysis of Normal and Nitrogen Limiting Conditions Using 44K *Arabidopsis* Oligonucleotide Micro-Array In order to produce a high throughput correlation analysis, the present inventors utilized an *Arabidopsis* oligonucleotide micro-array, produced by Agilent Technologies [chem (dot) agilent (dot) com/Scripts/PDS (dot) asp?l-Page=50879]. The array oligonucleotide represents about 44,000 Arabidopsis genes and transcripts. To define correlations between the levels of RNA expression with NUE, ABST, yield components or vigor related parameters various plant characteristics of 14 different Arabidopsis ecotypes were analyzed. Among them, ten ecotypes encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Two tissues of plants [leaves and stems] growing at two different nitrogen fertilization levels (1.5 mM Nitrogen or 6 mM Nitrogen) were sampled and RNA was extracted as described hereinabove under "GENERAL EXPERIMENTAL AND BIOINFORMATICS METHODS". For convenience, each micro-array expression information tissue type has received a Set ID as summarized in Table 46 below.

TABLE 46

Tissues used for Arabidopsis transcriptome expression sets

| Expression Set | Set ID |
| --- | --- |
| Leaves at 6 mM Nitrogen fertilization | 1 |
| Leaves at 1.5 mM Nitrogen fertilization | 2 |
| Stems at 1.5 mM Nitrogen fertilization | 3 |
| Stems at 6 mM Nitrogen fertilization | 4 |

Table 46: Provided are the identification (ID) digits of each of the Arabidopsis expression sets.

Assessment of Arabidopsis yield components and vigor related parameters under different nitrogen fertilization levels—10 Arabidopsis accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Data parameters collected are summarized in Table 47, hereinbelow.

TABLE 47

Arabidopsis correlated parameters (vectors)

| Correlated parameter with | Correlation ID |
| --- | --- |
| N 6 mM; Seed Yield [gr./plant] | 1 |
| N 6 mM; Harvest Index (ratio) | 2 |
| N 6 mM; 1000 Seeds weight [gr.] | 3 |
| N 6 mM; seed yield/rosette area day at day 10 [gr./cm$^2$] | 4 |
| N 6 mM; seed yield/leaf blade [gr./cm$^2$] | 5 |
| N 1.5 mM; Rosette Area at day 8 [cm$^2$] | 6 |
| N 1.5 mM; Rosette Area at day 10 [cm$^2$] | 7 |
| N 1.5 mM; Leaf Number at day 10 (number) | 8 |
| N 1.5 mM; Leaf Blade Area at day 10 [cm$^2$] | 9 |
| N 1.5 mM; RGR of Rosette Area at day 3 [cm$^2$/day] | 10 |
| N 1.5 mM; t50 Flowering [day] | 11 |
| N 1.5 mM; Dry Weight [gr./plant] | 12 |
| N 1.5 mM; Seed Yield [gr./plant] | 13 |
| N 1.5 mM; Harvest Index (ratio) | 14 |
| N 1.5 mM; 1000 Seeds weight [gr.] | 15 |
| N 1.5 mM; seed yield/rosette area at day 10 [gr./cm$^2$] | 16 |
| N 1.5 mM; seed yield/leaf blade [gr./cm$^2$] | 17 |
| N 1.5 mM; % Seed yield reduction compared to N 6 mM | 18 |
| N 1.5 mM; % Biomass reduction compared to N 6 mM | 19 |
| N 6 mM; Rosette Area at day 8 [cm$^2$] | 20 |
| N 6 mM; Rosette Area at day 10 [cm$^2$] | 21 |
| N 6 mM; Leaf Number at day 10 (number) | 22 |
| N 6 mM; Leaf Blade Area at day 10 (cm$^2$) | 23 |
| N 6 mM; RGR of Rosette Area at day 3 [cm$^2$/gr.] | 24 |
| N 6 mM; t50 Flowering [day] | 25 |
| N 6 mM; Dry Weight [gr./plant] | 26 |
| N 6 mM; N level/FW | 27 |
| N 6 mM; DW/N level [gr./SPAD unit] | 28 |
| N 6 mM; N level/DW (SPAD unit/gr. plant) | 29 |
| N 6 mM; Seed yield/N unit [gr./SPAD unit] | 30 |
| N 1.5 mM; N level/FW [SPAD unit/gr.] | 31 |
| N 1.5 mM; N level/DW [SPAD unit/gr.] | 32 |
| N 1.5 mM; DW/N level [gr/SPAD unit] | 33 |
| N 1.5 mM; seed yield/N level [gr/SPAD unit] | 34 |

Table 47. Provided are the Arabidopsis correlated parameters (vectors).
"N" = Nitrogen at the noted concentrations;
"gr." = grams;
"SPAD" = chlorophyll levels;
"t50" = time where 50% of plants flowered;
"gr./SPAD unit" = plant biomass expressed in grams per unit of nitrogen in plant measured by SPAD.
"DW" = Plant Dry Weight;
"FW" = Plant Fresh weight;
"N level/DW" = plant Nitrogen level measured in SPAD unit per plant biomass [gr.];
"DW/N level" = plant biomass per plant [gr.]/SPAD unit;
Rosette Area (measured using digital analysis);
Plot Coverage at the indicated day [%] (calculated by the dividing the total plant area with the total plot area);
Leaf Blade Area at the indicated day [cm$^2$] (measured using digital analysis);
RGR (relative growth rate) of Rosette Area at the indicated day [cm$^2$/day];
t50 Flowering [day] (the day in which 50% of plant flower);
seed yield/rosette area at day 10 [gr./cm$^2$] (calculated);
seed yield/leaf blade [gr./cm$^2$] (calculated); seed yield/N level [gr./SPAD unit] (calculated).

Assessment of NUE, yield components and vigor-related parameters—Ten Arabidopsis ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process was repeated every 2-3 days starting at day 9-12 till day 16-19 (respectively) from transplanting.

An image analysis system was used, which consists of a personal desktop computer (Intel P4 3.0 GHz processor) and a public domain program—ImageJ 1.37, Java based image processing program, which was developed at the U.S National Institutes of Health and is freely available at rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, leaf blade area, plot coverage, Rosette diameter and Rosette area.

Relative growth rate area: The relative growth rate area of the rosette and the leaves was calculated according to Formulas 9 and 13, respectively, above.

Seed yield and 1000 seeds weight—At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The vegetative portion above ground was separated from the seeds. The total weight of the vegetative portion above ground and the seed weight of each plot were measured and divided by the number of plants.

Dry weight (vegetative biomass)=total weight of the vegetative portion above ground (excluding roots) after drying at 30° C. in a drying chamber; all the above ground biomass that is not seed yield.

Seed yield per plant=total seed weight per plant (gr.).

Harvest Index (seed)—The harvest index was calculated using Formula 15 as described above.

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of seed yield reduction—measures the amount of seeds obtained in plants when grown under nitrogen-limiting conditions compared to seed yield produced at normal nitrogen levels expressed in percentages (%).

Experimental Results 10 different *Arabidopsis* accessions (ecotypes) were grown and characterized for 34 parameters as described above. The average for each of the measured parameters was calculated using the JMP software (Table 48 below). Subsequent correlation analysis between the various transcriptome sets (Table 46) and the average parameters conducted (Table 49 below).

TABLE 48

Measured parameters in *Arabidopsis* accessions

| Line/Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 0.116 | 0.165 | 0.108 | 0.082 | 0.119 | 0.139 | 0.107 | 0.138 | 0.095 | 0.068 |
| 2 | 0.28 | 0.309 | 0.284 | 0.158 | 0.206 | 0.276 | 0.171 | 0.212 | 0.166 | 0.136 |
| 3 | 0.0147 | 0.0169 | 0.0178 | 0.0121 | 0.0155 | 0.0154 | 0.014 | 0.0166 | 0.0161 | 0.016 |
| 4 | 0.0824 | 0.1058 | 0.0405 | 0.0339 | 0.0556 | 0.057 | 0.0554 | 0.0507 | 0.0582 | 0.0307 |
| 5 | 0.339 | 0.526 | 0.207 | 0.183 | 0.277 | 0.281 | 0.252 | 0.271 | 0.235 | 0.158 |
| 6 | 0.76 | 0.709 | 1.061 | 1.157 | 1.00 | 0.91 | 0.942 | 1.118 | 0.638 | 0.996 |
| 7 | 1.43 | 1.33 | 1.77 | 1.97 | 1.83 | 1.82 | 1.64 | 2.00 | 1.15 | 1.75 |
| 8 | 6.88 | 7.31 | 7.31 | 7.88 | 7.75 | 7.62 | 7.19 | 8.62 | 5.93 | 7.94 |
| 9 | 0.335 | 0.266 | 0.374 | 0.387 | 0.37 | 0.386 | 0.35 | 0.379 | 0.307 | 0.373 |
| 10 | 0.631 | 0.793 | 0.502 | 0.491 | 0.72 | 0.825 | 0.646 | 0.668 | 0.636 | 0.605 |
| 11 | 16.00 | 21.00 | 14.80 | 24.70 | 23.70 | 18.10 | 19.50 | 23.60 | 21.90 | 23.60 |
| 12 | 0.164 | 0.124 | 0.082 | 0.113 | 0.124 | 0.134 | 0.106 | 0.148 | 0.171 | 0.184 |
| 13 | 0.0318 | 0.0253 | 0.023 | 0.0098 | 0.0088 | 0.0323 | 0.0193 | 0.012 | 0.0135 | 0.0055 |
| 14 | 0.192 | 0.203 | 0.295 | 0.085 | 0.071 | 0.241 | 0.179 | 0.081 | 0.079 | 0.031 |
| 15 | 0.0165 | 0.0158 | 0.0175 | 0.0143 | 0.0224 | 0.0148 | 0.0136 | 0.0217 | 0.0186 | 0.0183 |
| 16 | 0.0221 | 0.019 | 0.0136 | 0.0052 | 0.005 | 0.0178 | 0.0127 | 0.0068 | 0.0118 | 0.0032 |
| 17 | 0.0948 | 0.0946 | 0.0634 | 0.0264 | 0.0242 | 0.0836 | 0.0589 | 0.0343 | 0.044 | 0.0149 |
| 18 | 72.60 | 84.70 | 78.80 | 88.00 | 92.60 | 76.70 | 81.90 | 91.30 | 85.80 | 91.80 |
| 19 | 60.7 | 76.7 | 78.6 | 78.1 | 78.6 | 73.2 | 83.1 | 77.2 | 70.1 | 63 |
| 20 | 0.76 | 0.86 | 1.48 | 1.28 | 1.10 | 1.24 | 1.09 | 1.41 | 0.89 | 1.22 |
| 21 | 1.41 | 1.57 | 2.67 | 2.42 | 2.14 | 2.47 | 1.97 | 2.72 | 1.64 | 2.21 |
| 22 | 6.25 | 7.31 | 8.06 | 8.75 | 8.75 | 8.38 | 7.12 | 9.44 | 6.31 | 8.06 |
| 23 | 0.342 | 0.315 | 0.523 | 0.449 | 0.43 | 0.497 | 0.428 | 0.509 | 0.405 | 0.43 |
| 24 | 0.689 | 1.024 | 0.614 | 0.601 | 0.651 | 0.676 | 0.584 | 0.613 | 0.515 | 0.477 |
| 25 | 16.40 | 20.50 | 14.60 | 24.00 | 23.60 | 15.00 | 19.70 | 22.90 | 18.80 | 23.40 |
| 26 | 0.419 | 0.531 | 0.382 | 0.517 | 0.579 | 0.501 | 0.627 | 0.649 | 0.573 | 0.496 |
| 27 | 22.50 | | | 28.30 | | 33.30 | | | 39.00 | 17.60 |

TABLE 48-continued

Measured parameters in Arabidopsis accessions

| Line/ Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 28 | 0.0186 | | | 0.0183 | | 0.015 | | | 0.0147 | 0.0281 |
| 29 | 53.70 | | | 54.60 | | 66.50 | | | 68.10 | 35.50 |
| 30 | 0.0042 | | | 0.003 | | 0.0053 | | | 0.0033 | 0.0023 |
| 31 | 45.60 | | | 42.10 | | 53.10 | | | 67.00 | 28.10 |
| 32 | 167.30 | | | 241.10 | | 195.00 | | | 169.30 | 157.80 |
| 33 | 0.006 | | | 0.0041 | | 0.0051 | | | 0.0059 | 0.0063 |
| 34 | 0.0012 | | | 0.0004 | | 0.0012 | | | 0.0005 | 0.0002 |

Table 48: Provided are the measured parameters under various treatments in various ecotypes (Arabidopsis accessions).

TABLE 49

Correlation between the expression level of selected genes of some embodiments of the invention in various tissues and the phenotypic performance under normal or abiotic stress conditions across Arabidopsis accessions

| Gene Name | R | P value | Exp. set | Corr. Set ID | Gene Name | R | P value | Exp. set | Corr. Set ID |
|---|---|---|---|---|---|---|---|---|---|
| LBY311 | 0.85 | 3.46E−03 | 4 | 4 | LBY311 | 0.72 | 2.77E−02 | 4 | 17 |
| LBY311 | 0.75 | 2.03E−02 | 4 | 1 | LBY311 | 0.83 | 5.46E−03 | 4 | 5 |
| LBY311 | 0.76 | 1.81E−02 | 4 | 24 | LBY311 | 0.72 | 1.89E−02 | 3 | 19 |

Table 49. Provided are the correlations (R) between the expression levels of yield improving genes and their homologues in tissues [Leaves or stems; Expression sets (Exp)] and the phenotypic performance in various yield, biomass, growth rate and/or vigor components [Correlation vector (corr.)] under nitrogen limiting conditions or normal conditions across Arabidopsis accessions.
"Corr. ID"—correlation set ID according to the correlated parameters specified in Table 47.
"Exp. Set"—Expression set specified in Table 46.
"R" = Pearson correlation coefficient;
"P" = p value.

Example 5

Production of Sorghum Transcriptome and High Throughput Correlation Analysis with Yield and Drought Related Parameters Measured in Fields Using 65K Sorghum Oligonucleotide Micro-Arrays In order to produce a high throughput correlation analysis between plant phenotype and gene expression level, the present inventors utilized a sorghum oligonucleotide microarray, produced by Agilent Technologies [chem(dot)agilent(dot)com/Scripts/PDS(dot)asp?lPage=50879]. The array oligonucleotide represents about 65,000 sorghum genes and transcripts. In order to define correlations between the levels of RNA expression with ABST, drought tolerance and yield components or vigor related parameters, various plant characteristics of 12 different sorghum hybrids were analyzed. Among them, 8 hybrids encompassing the observed variance were selected for RNA expression analysis. The correlation between the RNA levels and the characterized parameters was analyzed using Pearson correlation test [davidmlane(dot)com/hyperstat/A34739(dot)html].

Experimental Procedures

12 Sorghum varieties were grown in 6 repetitive plots, in field. Briefly, the growing protocol was as follows:

1. Regular growth conditions: sorghum plants were grown in the field using commercial fertilization and irrigation protocols, which include 452 m$^3$ water per dunam (1000 square meters) per entire growth period and fertilization of 14 units nitrogen per dunam per entire growth period (normal conditions). The nitrogen can be obtained using URAN® 21% (Nitrogen Fertilizer Solution; PCS Sales, Northbrook, Ill., USA).

2. Drought conditions: sorghum seeds were sown in soil and grown under normal condition until flowering stage (59 days from sowing), drought treatment was imposed by irrigating plants with 50% water relative to the normal treatment from this stage [309 m$^3$ water per dunam (1000 square meters) per the entire growth period)], with normal fertilization (i.e., 14 units nitrogen per dunam).

Analyzed Sorghum tissues—All 12 selected Sorghum hybrids were sampled per each treatment. Tissues [Basal and distal head, flag leaf and upper stem] representing different plant characteristics, from plants growing under normal conditions and drought stress conditions were sampled and RNA was extracted as described above. Each micro-array expression information tissue type has received a Set ID as summarized in Tables 50-51 below.

TABLE 50

Sorghum transcriptome expression sets in field experiment under normal conditions

| Expression Set | Set ID |
|---|---|
| Basal head at grain filling stage under normal conditions | 1 |
| Distal head at grain filling stage under normal conditions | 2 |
| Flag leaf at flowering stage under normal conditions | 3 |
| Flag leaf at grain filling stage under normal conditions | 4 |
| Up stem at flowering stage under normal conditions | 5 |
| Up stem at grain filling stage under normal conditions | 6 |

Table 50: Provided are the sorghum transcriptome expression sets under normal conditions.
Flag leaf = the leaf below the flower.

TABLE 51

*Sorghum* transcriptome expression sets in field experiment under drought conditions

| Expression Set | Set ID |
|---|---|
| Basal head at grain filling stage under drought conditions | 1 |
| Distal head at grain filling stage under drought conditions | 2 |
| Flag leaf at flowering stage under drought conditions | 3 |
| Flag leaf at grain filling stage under drought conditions | 4 |
| Up stem at flowering stage under drought conditions | 5 |
| Up stem at grain filling stage under drought conditions | 6 |

Table 51: Provided are the *sorghum* transcriptome expression sets under drought conditions.
Flag leaf = the leaf below the flower.

Sorghum Yield Components and Vigor Related Parameters Assessment

Plants were phenotyped as shown in Tables 52-53 below. Some of the following parameters were collected using digital imaging system:

Grains yield per plant (gr.)—At the end of the growing period heads were collected (harvest stage). Selected heads were separately threshed and grains were weighted. The average grain weight per plant was calculated by dividing the total grain weight by the number of selected plants.

Heads weight per plant (RP) (kg)—At the end of the growing period heads of selected plants were collected (harvest stage) from the rest of the plants in the plot. Heads were weighted after oven dry (dry weight), and average head weight per plant was calculated.

Grains num (SP) (number)—was calculated by dividing seed yield from selected plants by a single seed weight.

1000 grain (seed) weight (gr.)—was calculated based on Formula 14.

Grain area ($cm^2$)—At the end of the growing period the grains were separated from the Plant 'Head'. A sample of ~200 grains were weighted, photographed and images were processed using the below described image processing system. The grain area was measured from those images and was divided by the number of grains.

Grain Circularity—The circularity of the grains was calculated based on Formula 19.

Main Head Area ($cm^2$)—At the end of the growing period selected "Main Heads" were photographed and images were processed using the below described image processing system. The "Main Head" area was measured from those images and was divided by the number of "Main Heads".

Main Head length (cm)—At the end of the growing period selected "Main Heads" were photographed and images were processed using the below described image processing system. The "Main Head" length (longest axis) was measured from those images and was divided by the number of "Main Heads".

Main Head Width (cm)—At the end of the growing period selected "Main Heads" were photographed and images were processed using the below described image processing system. The "Main Head" width (longest axis) was measured from those images and was divided by the number of "Main Heads".

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling selected plants in a plot or by measuring the parameter across all the plants within the plot.

All Heads Area ($cm^2$)—At the end of the growing period (harvest) selected plants main and secondary heads were photographed and images were processed using the above described image processing system. All heads area was measured from those images and was divided by the number of plants.

All Heads length (cm)—At the end of the growing period (harvest) selected plants main and secondary heads were photographed and images were processed using the above described image processing system. All heads length (longest axis) was measured from those images and was divided by the number of plants.

All Heads Width (cm)—At the end of the growing period main and secondary heads were photographed and images were processed using the above described image processing system. All heads width (longest axis) was measured from those images and was divided by the number of plants.

Head weight per plant (RP)/water until maturity (gr./lit)—At the end of the growing period heads were collected (harvest stage) from the rest of the plants in the plot. Heads were weighted after oven dry (dry weight), and average head weight per plant was calculated. Head weight per plant was then divided by the average water volume used for irrigation until maturity.

Harvest index (SP)—was calculated based on Formula 16 above.

Heads index (RP)—was calculated based on Formula 46 above.

Head dry weight (GF) (gr.)—selected heads per plot were collected at the grain filling stage (R2-R3) and weighted after oven dry (dry weight).

Heads per plant (RP) (number)—At the end of the growing period total number of rest of plot heads were counted and divided by the total number of rest of plot plants.

Leaves temperature 2° C.—leaf temperature was measured using Fluke IR thermometer 568 device. Measurements were done on opened leaves at grain filling stage.

Leaves temperature 6° C.—leaf temperature was measured using Fluke IR thermometer 568 device. Measurements were done on opened leaves at late grain filling stage.

Stomatal conductance (F) (mmol $m^{-2}$ $s^{-1}$)—plants were evaluated for their stomata conductance using SC-1 Leaf Porometer (Decagon devices) at flowering (F) stage. Stomata conductance readings were done on fully developed leaf, for 2 leaves and 2 plants per plot.

Stomatal conductance (GF) (mmol $m^{-2}$ $s^{-1}$)—plants were evaluated for their stomata conductance using SC-1 Leaf Porometer (Decagon devices) at grain filling (GF) stage. Stomata conductance readings were done on fully developed leaf, for 2 leaves and 2 plants per plot.

Relative water content 2 (RWC, %)—was calculated based on Formula 1 at grain filling.

Specific leaf area (SLA) (GF)—was calculated based on Formula 37 above.

Waxy leaf blade—was defined by view of leaf blades % of Normal and % of grayish (powdered coating/frosted appearance). Plants were scored for their waxiness according to the scale 0=normal, 1=intermediate, 2=grayish.

SPAD 2 (SPAD unit)—Chlorophyll content was determined using a Minolta SPAD 502 chlorophyll meter and measurement was performed at flowering. SPAD meter readings were done on fully developed leaf. Three measurements per leaf were taken per plant.

SPAD 3 (SPAD unit)—Chlorophyll content was determined using a Minolta SPAD 502 chlorophyll meter and measurement was performed at grain filling. SPAD meter readings were done on fully developed leaf. Three measurements per leaf were taken per plant.

% yellow leaves number (F) (percentage)—At flowering stage, leaves of selected plants were collected. Yellow and green leaves were separately counted. Percent of yellow leaves at flowering was calculated for each plant by dividing yellow leaves number per plant by the overall number of leaves per plant and multiplying by 100.

% yellow leaves number (H) (percentage)—At harvest stage, leaves of selected plants were collected. Yellow and green leaves were separately counted. Percent of yellow leaves at flowering was calculated for each plant by dividing yellow leaves number per plant by the overall number of leaves per plant and multiplying by 100.

% Canopy coverage (GF)—was calculated based on Formula 32 above.

LAI LP-80 (GF)—Leaf area index values were determined using an AccuPAR Centrometer Model LP-80 and measurements were performed at grain filling stage with three measurements per plot.

Leaves area per plant (GF) ($cm^2$)—total leaf area of selected plants in a plot. This parameter was measured using a Leaf area-meter at the grain filling period (GF).

Plant height (H) (cm)—Plants were characterized for height at harvest. Plants were measured for their height using a measuring tape. Height was measured from ground level to top of the longest leaf.

Relative growth rate of Plant height (cm/day)—was calculated based on Formula 3 above.

Number days to Heading (number)—Calculated as the number of days from sowing till 50% of the plot arrives to heading.

Number days to Maturity (number)—Calculated as the number of days from sowing till 50% of the plot arrives to seed maturation.

Vegetative DW per plant (gr.)—At the end of the growing period all vegetative material (excluding roots) from plots were collected and weighted after oven dry (dry weight). The biomass per plant was calculated by dividing total biomass by the number of plants.

Lower Stem dry density (F) (gr./$cm^3$)—measured at flowering. Lower internodes from selected plants per plot were separated from the plants and weighted (dry weight). To obtain stem density, internode dry weight was divided by the internode volume.

Lower Stem dry density (H) (gr./$cm^3$)—measured at harvest. Lower internodes from selected plants per plot were separated from the plant and weighted (dry weight). To obtain stem density, internode dry weight was divided by the internode volume.

Lower Stem fresh density (F) (gr./$cm^3$)—measured at flowering. Lower internodes from selected plants per plot were separated from the plants and weighted (fresh weight). To obtain stem density, internodes fresh weight was divided by the stem volume.

Lower Stem fresh density (H) (gr./$cm^3$)—measured at harvest. Lower internodes from selected plants per plot were separated from the plants and weighted (fresh weight). To obtain stem density, internodes fresh weight was divided by the stem volume.

Lower Stem length (F) (cm)—Lower internodes from selected plants per plot were separated from the plants at flowering (F). Internodes were measured for their length using a ruler.

Lower Stem length (H) (cm)—Lower internodes from selected plants per plot were separated from the plant at harvest (H). Internodes were measured for their length using a ruler.

Lower Stem width (F) (cm)—Lower internodes from selected plants per plot were separated from the plant at flowering (F). Internodes were measured for their width using a caliber.

Lower Stem width (GF) (cm)—Lower internodes from selected plants per plot were separated from the plant at grain filling (GF). Internodes were measured for their width using a caliber.

Lower Stem width (H) (cm)—Lower internodes from selected plants per plot were separated from the plant at harvest (H). Internodes were measured for their width using a caliber.

Upper Stem dry density (F) (gr./$cm^3$)—measured at flowering (F). Upper internodes from selected plants per plot were separated from the plant and weighted (dry weight). To obtain stem density, stem dry weight was divided by the stem volume.

Upper Stem dry density (H) (gr./$cm^3$)—measured at harvest (H). Upper stems from selected plants per plot were separated from the plant and weighted (dry weight). To obtain stem density, stem dry weight was divided by the stem volume.

Upper Stem fresh density (F) (gr./$cm^3$)—measured at flowering (F). Upper stems from selected plants per plot were separated from the plant and weighted (fresh weight). To obtain stem density, stem fresh weight was divided by the stem volume.

Upper Stem fresh density (H) (gr./$cm^3$)—measured at harvest (H). Upper stems from selected plants per plot were separated from the plant and weighted (fresh weight). To obtain stem density, stem fresh weight was divided by the stem volume.

Upper Stem length (F) (cm)—Upper stems from selected plants per plot were separated from the plant at flowering (F). Stems were measured for their length using a ruler.

Upper Stem length (H) (cm)—Upper stems from selected plants per plot were separated from the plant at harvest (H). Stems were measured for their length using a ruler.

Upper Stem width (F) (cm)—Upper stems from selected plants per plot were separated from the plant at flowering (F). Stems were measured for their width using a caliber.

Upper Stem width (H) (cm)—Upper stems from selected plants per plot were separated from the plant at harvest (H). Stems were measured for their width using a caliber.

Upper Stem volume (H)—was calculated based on Formula 50 above.

Data parameters collected are summarized in Tables 52 and 53 herein below

TABLE 52

*Sorghum* correlated parameters under normal growth conditions (vectors)

| Correlated parameter with | Correlation ID |
|---|---|
| Grains yield per plant [gr.] | 1 |
| Heads weight per plant (RP) [kg] | 2 |
| Grains num (SP) [number] | 3 |
| 1000 grain weight [gr.] | 4 |

TABLE 52-continued

Sorghum correlated parameters under normal growth conditions (vectors)

| Correlated parameter with | Correlation ID |
|---|---|
| Grain area [$cm^2$] | 5 |
| Grain Circularity [$cm^2/cm^2$] | 6 |
| Main Head Area [$cm^2$] | 7 |
| Main Head length [cm] | 8 |
| Main Head Width [cm] | 9 |
| All Heads Area [$cm^2$] | 10 |
| All Heads length [cm] | 11 |
| All Heads Width [cm] | 12 |
| Head weight per plant (RP)/water until maturity [gr./lit] | 13 |
| Harvest index (SP) | 14 |
| Heads index (RP) | 15 |
| Head DW (GF) [gr.] | 16 |
| Heads per plant (RP) [number] | 17 |
| Leaves temperature 2 [° C.] | 18 |
| Leaves temperature 6 [° C.] | 19 |
| Stomatal conductance (F) [mmol $m^{-2}$ $s^{-1}$] | 20 |
| Stomatal conductance (GF) [mmol $m^{-2}$ $s^{-1}$] | 21 |
| RWC 2 [%] | 22 |
| Specific leaf area (GF) [$cm^2/gr.$] | 23 |
| Waxy leaf blade [scoring 0-2] | 24 |
| SPAD 2 [SPAD unit] | 25 |
| SPAD 3 [SPAD unit] | 26 |
| % yellow leaves number (F) [%] | 27 |
| % yellow leaves number (H) [%] | 28 |
| % Canopy coverage (GF) [%] | 29 |
| LAI LP-80 (GF) | 30 |
| Leaves area per plant (GF) [$cm^2$] | 31 |
| Plant height (H) [cm] | 32 |
| Plant height growth [cm/day] | 33 |
| Num days to Heading [number] | 34 |
| Num days to Maturity [number] | 35 |
| Vegetative DW per plant [gr.] | 36 |
| Lower Stem dry density (F) [gr./$cm^3$] | 37 |
| Lower Stem dry density (H) [gr./$cm^3$] | 38 |
| Lower Stem fresh density (F) [gr./$cm^3$] | 39 |
| Lower Stem fresh density (H) [gr./$cm^3$] | 40 |
| Lower Stem length (F) [cm] | 41 |
| Lower Stem length (H) [cm] | 42 |
| Lower Stem width (F) [cm] | 43 |
| Lower Stem width (GF) [cm] | 44 |
| Lower Stem width (H) [cm] | 45 |
| Upper Stem dry density (F) [gr./$cm^3$] | 46 |
| Upper Stem dry density (H) [gr./$cm^3$] | 47 |
| Upper Stem fresh density (F) [gr./$cm^3$] | 48 |
| Upper Stem fresh density (H) [gr./$cm^3$] | 49 |
| Upper Stem length (F) [cm] | 50 |
| Upper Stem length (H) [cm] | 51 |
| Upper Stem width (F) [cm] | 52 |
| Upper Stem width (H) [cm] | 53 |
| Upper Stem volume (H) [$cm^3$] | 54 |

Table 52. Provided are the Sorghum correlated parameters (vectors).
"gr." = grams;
"kg" = kilograms";
"RP" = Rest of plot;
"SP" = Selected plants;
"num" = Number;
"lit" = Liter;
"SPAD" = chlorophyll levels;
"FW" = Plant Fresh weight;
"DW" = Plant Dry weight;
"GF" = Grain filling growth stage;
"F" = Flowering stage;
"H" = Harvest stage;
"cm" = Centimeter;
"mmol" = millimole.

TABLE 53

Sorghum correlated parameters under drought growth conditions (vectors)

| Correlated parameter with | Correlation ID |
|---|---|
| Heads weight per plant (RP) [kg] | 1 |
| Grains num (SP) [number] | 2 |
| 1000 grain weight [gr.] | 3 |
| Grains yield per plant [gr.] | 4 |
| Grain area [$cm^2$] | 5 |
| Grain Circularity [$cm^2/cm^2$] | 6 |
| Main Head Area [$cm^2$] | 7 |
| Main Head length [cm] | 8 |
| Main Head Width [cm] | 9 |
| All Heads Area [$cm^2$] | 10 |
| All Heads length [cm] | 11 |
| All Heads Width [cm] | 12 |
| Head weight per plant (RP)/water until maturity [gr./lit] | 13 |
| Harvest index (SP) | 14 |
| Heads index (RP) | 15 |
| Head DW (GF) [gr.] | 16 |
| Heads per plant (RP) [number] | 17 |
| Leaves temperature 2 [° C.] | 18 |
| Leaves temperature 6 [° C.] | 19 |
| Stomatal conductance (F) [mmol $m^{-2}$ $s^{-1}$] | 20 |
| Stomatal conductance (GF) [mmol $m^{-2}$ $s^{-1}$] | 21 |
| RWC 2 [%] | 22 |
| Specific leaf area (GF) [$cm^2/gr.$] | 23 |
| Waxy leaf blade [scoring 0-2] | 24 |
| SPAD 2 [SPAD unit] | 25 |
| SPAD 3 [SPAD unit] | 26 |
| % yellow leaves number (F) [%] | 27 |
| % yellow leaves number (H) [%] | 28 |
| % Canopy coverage (GF) [%] | 29 |
| LAI LP-80 (GF) | 30 |
| Leaves area per plant (GF) [$cm^2$] | 31 |
| Plant height (H) [cm] | 32 |
| Plant height growth [cm/day] | 33 |
| Num days to Heading [number] | 34 |
| Num days to Maturity [number] | 35 |
| Vegetative DW per plant [gr.] | 36 |
| Lower Stem dry density (F) [gr./$cm^3$] | 37 |
| Lower Stem dry density (H) [gr./$cm^3$] | 38 |
| Lower Stem fresh density (F) [gr./$cm^3$] | 39 |
| Lower Stem fresh density (H) [gr./$cm^3$] | 40 |
| Lower Stem length (F) [cm] | 41 |
| Lower Stem length (H) [cm] | 42 |
| Lower Stem width (H) [cm] | 43 |
| Upper Stem dry density (F) [gr./$cm^3$] | 44 |
| Upper Stem dry density (H) [gr./$cm^3$] | 45 |
| Upper Stem fresh density (F) [gr./$cm^3$] | 46 |
| Upper Stem fresh density (H) [gr./$cm^3$] | 47 |
| Upper Stem length (F) [cm] | 48 |
| Upper Stem length (H) [cm] | 49 |
| Upper Stem width (F) [cm] | 50 |
| Upper Stem width (H) [cm] | 51 |
| Upper Stem volume (H) [$cm^3$] | 52 |
| Lower Stem width (F) [cm] | 53 |
| Lower Stem width (GF) [cm] | 54 |

Table 53. Provided are the Sorghum correlated parameters (vectors).
"gr." = grams;
"kg" = kilograms";
"RP" = Rest of plot;
"SP" = Selected plants;
"num" = Number;
"lit" = Liter;
"SPAD" = chlorophyll levels;
"FW" = Plant Fresh weight;
"DW" = Plant Dry weight;
"GF" = Grain filling growth stage;
"F" = Flowering stage;
"H" = Harvest stage;
"cm" = Centimeter;
"mmol" = millimole.

Experimental Results

Twelve different sorghum hybrids were grown and characterized for different parameters (Tables 52-53). The average for each of the measured parameter was calculated using the JMP software (Tables 54-57) and a subsequent correlation analysis was performed (Tables 58-59). Results were then integrated to the database.

TABLE 54

Measured parameters in *Sorghum* accessions under normal conditions

| Line/Corr. ID | Line-1 | Line-2 | Line-3 | Line-4 | Line-5 | Line-6 |
|---|---|---|---|---|---|---|
| 1 | 43.90 | 18.00 | 8.50 | 33.20 | 44.30 | 60.20 |
| 2 | 0.057 | 0.037 | 0.031 | 0.045 | 0.041 | 0.066 |
| 3 | 12730 | 6281.9 | 4599.5 | 15183 | 12628 | 17505 |
| 4 | 27.60 | 22.80 | 14.90 | 18.50 | 28.50 | 27.10 |
| 5 | 0.154 | 0.119 | 0.098 | 0.122 | 0.154 | 0.149 |
| 6 | 0.87 | 0.87 | 0.87 | 0.88 | 0.87 | 0.89 |
| 7 | 114.50 | 80.80 | 77.90 | 79.70 | 219.00 | 112.10 |
| 8 | 27.70 | 21.60 | 17.80 | 23.70 | 32.20 | 20.70 |
| 9 | 5.54 | 4.99 | 6.20 | 4.56 | 9.99 | 7.19 |
| 10 | 114.50 | 79.70 | 77.90 | 79.70 | 219.00 | 100.10 |
| 11 | 27.70 | 21.40 | 17.80 | 23.70 | 32.20 | 19.40 |
| 12 | 5.54 | 4.93 | 6.2 | 4.56 | 9.99 | 6.55 |
| 13 | 0.248 | 0.163 | 0.136 | 0.197 | 0.178 | 0.285 |
| 14 | 0.218 | 0.185 | 0.054 | 0.253 | 0.261 | 0.375 |
| 15 | 0.343 | 0.402 | 0.241 | 0.338 | 0.361 | 0.532 |
| 16 | 29.30 | 12.90 | 27.90 | 41.30 | 38.90 | 15.20 |
| 17 | NA | 1.42 | 1.74 | 1.30 | 0.97 | 1.73 |
| 18 | 32.40 | 32.10 | 33.20 | 32.30 | 32.40 | 31.10 |
| 19 | 33.30 | 33.90 | 33.20 | 33.30 | 33.60 | 33.80 |
| 20 | 670.4 | 1017.6 | 584.4 | 640.6 | 350 | 553.5 |
| 21 | 382.9 | 809.4 | 468.7 | 486.9 | 421.5 | 633.1 |
| 22 | 72.10 | 91.70 | 79.50 | 86.70 | 74.00 | 90.60 |
| 23 | 80.20 | 170.30 | 54.30 | 76.90 | 51.40 | 163.10 |
| 24 | NA | 2.00 | NA | NA | NA | 1.06 |
| 25 | 47.80 | 49.30 | 44.70 | 49.10 | 41.70 | 47.20 |
| 26 | 47.70 | 35.40 | 45.80 | 42.10 | 41.40 | 33.40 |
| 27 | 0.611 | 0.853 | 0.548 | 0.314 | 0.713 | 0.573 |
| 28 | 0.406 | 0.111 | 0.37 | 0.126 | 0.485 | 0.149 |
| 29 | 95.00 | 69.20 | 97.50 | 83.60 | 92.80 | 84.30 |
| 30 | 6.27 | NA | 6.11 | 5.42 | 5.43 | NA |
| 31 | 2825.8 | 1911.2 | 2030 | 2866.8 | 1554.7 | 2342.6 |
| 32 | 182.10 | 104.60 | 143.80 | 99.00 | 173.60 | 170.10 |
| 33 | 2.87 | 1.85 | 2.55 | 1.65 | 3.12 | 2.73 |
| 34 | 89.40 | 65.70 | 88.20 | 74.00 | 84.00 | 71.50 |
| 35 | 126 | 107 | 115 | 107 | 107 | 92 |
| 36 | 0.125 | 0.05 | 0.122 | 0.076 | 0.097 | 0.062 |
| 37 | 1.57 | 1.37 | 2.81 | 2.17 | 2.35 | 1.4 |
| 38 | 1.83 | 2.03 | 3.48 | 2.53 | 3.05 | 1.80 |
| 39 | 10.47 | 10.64 | 8.55 | 10.85 | 11.32 | 10.04 |
| 40 | 9.79 | 10.38 | 10.52 | 10.49 | 11.28 | 7.29 |
| 41 | 7.79 | 3.50 | 14.90 | 3.41 | 11.12 | 8.16 |
| 42 | 7.99 | 4.83 | 12.87 | 3.12 | 10.76 | 8.30 |
| 43 | 19.50 | 16.70 | 14.70 | 17.90 | 14.80 | 16.00 |
| 44 | 20.00 | 20.90 | 14.70 | 18.80 | 15.30 | 15.90 |
| 45 | 19.10 | 15.50 | 14.40 | 20.30 | 15.20 | 15.10 |
| 46 | NA | 1.24 | NA | NA | 2.11 | 1.23 |
| 47 | 2.05 | 1.77 | 2.36 | 1.83 | 1.73 | 1.86 |
| 48 | NA | 9.79 | NA | NA | 10.44 | 9.38 |
| 49 | 6.61 | 8.92 | 6.43 | 8.25 | 7.24 | 4.64 |
| 50 | NA | 42.60 | NA | NA | NA | 9.20 |
| 51 | 38.80 | 45.00 | 24.50 | 52.50 | 38.40 | 34.00 |
| 52 | 2352.5 | 2169.1 | 968.8 | 2452.6 | 1997.7 | 2767.5 |
| 53 | 8.23 | 8.98 | 7.11 | 7.13 | 6.81 | 10.42 |
| 54 | 8.74 | 7.46 | 6.99 | 7.68 | 7.83 | 10.07 |

Table 54: Provided are the values of each of the parameters (as described above) measured in *Sorghum* accessions (Line) under normal conditions. Growth conditions are specified in the experimental procedure section. "NA" = not available.

TABLE 55

Measured parameters in additional *Sorghum* accessions under normal growth conditions

| Line/Corr. ID | Line-7 | Line-8 | Line-9 | Line-10 | Line-11 | Line-12 |
|---|---|---|---|---|---|---|
| 1 | 32.10 | 49.60 | 39.00 | 54.80 | 55.30 | 64.70 |
| 2 | 0.057 | 0.062 | 0.065 | 0.072 | 0.049 | 0.075 |
| 3 | 13888 | 21510 | 13139 | 16910 | 18205 | 24801 |
| 4 | 18.50 | 18.50 | 23.50 | 25.90 | 24.30 | 20.40 |
| 5 | 0.117 | 0.121 | 0.122 | 0.129 | 0.123 | 0.125 |
| 6 | 0.89 | 0.88 | 0.89 | 0.90 | 0.89 | 0.90 |
| 7 | 85.40 | 139.00 | 98.90 | 114.70 | 154.70 | 147.90 |
| 8 | 21.30 | 30.90 | 22.50 | 24.70 | 28.30 | 30.50 |
| 9 | 5.45 | 6.37 | 5.90 | 6.27 | 7.50 | 6.40 |
| 10 | 85.40 | 139.00 | 70.00 | 78.60 | 152.00 | 145.20 |
| 11 | 21.30 | 30.90 | 19.20 | 21.00 | 27.80 | 30.00 |
| 12 | 5.45 | 6.37 | 4.48 | 4.57 | 7.41 | 6.32 |
| 13 | 0.249 | 0.271 | 0.284 | 0.315 | 0.216 | 0.325 |
| 14 | 0.309 | 0.409 | 0.343 | 0.36 | 0.314 | 0.318 |
| 15 | 0.477 | 0.554 | 0.538 | 0.502 | 0.471 | 0.478 |
| 16 | 10.20 | 27.60 | 31.60 | 25.80 | 21.30 | 74.50 |
| 17 | 1.37 | 1.08 | 2.20 | 1.52 | 1.17 | 1.01 |
| 18 | 32.90 | 33.00 | 31.60 | 32.40 | 32.70 | 32.70 |
| 19 | 33.60 | 33.90 | 32.30 | 32.90 | 32.40 | 33.30 |
| 20 | 473.8 | 796.9 | 879 | 810.3 | 889 | 607.2 |
| 21 | 485.7 | 886 | 730.6 | 886.6 | 785 | 384.5 |
| 22 | 88.80 | 90.20 | 90.80 | 88.50 | 86.70 | 82.00 |
| 23 | 194.10 | 213.70 | 212.00 | 214.60 | 157.40 | 67.70 |
| 24 | 1.13 | 1.44 | 1.00 | 1.75 | 1.00 | NA |
| 25 | 52.10 | 53.70 | 52.60 | 53.90 | 51.80 | 44.10 |
| 26 | 50.20 | 41.90 | 46.80 | 46.80 | 48.60 | 40.10 |
| 27 | 0.584 | 0.544 | 0.208 | 0.484 | 0.351 | 0.574 |
| 28 | 0.076 | 0.022 | 0.018 | 0.129 | 0.096 | 0.424 |
| 29 | 80.60 | 75.70 | 80.20 | 79.70 | 65.90 | 89.60 |
| 30 | NA | NA | NA | NA | NA | 5.79 |
| 31 | 2008.9 | 2212 | 1495.5 | 1997.8 | 2692.1 | 2647.7 |
| 32 | 54.90 | 94.80 | 101.60 | 113.00 | 88.30 | 163.80 |
| 33 | 0.88 | 1.57 | 1.73 | 1.91 | 1.59 | 2.87 |
| 34 | 67.70 | 63.70 | 56.00 | 59.00 | 56.00 | 75.30 |
| 35 | 107 | 92 | 107 | 107 | 107 | 107 |
| 36 | 0.045 | 0.045 | 0.046 | 0.063 | 0.086 | 0.099 |
| 37 | 1.97 | 2.05 | 2.29 | 1.87 | 1.71 | 2.14 |
| 38 | 2.93 | 2.47 | 2.56 | 2.48 | 2.74 | 1.64 |
| 39 | 10.71 | 10.82 | 10.84 | 10.84 | 10.7 | 10.55 |
| 40 | 10.09 | 10.85 | 11 | 11.2 | 7.36 | 8.62 |
| 41 | 2.83 | 3.22 | 4.02 | 4.88 | 2.82 | 8.79 |
| 42 | 2.97 | 3.72 | 5.90 | 5.07 | 3.78 | 9.98 |
| 43 | 17.80 | 18.70 | 13.50 | 15.00 | 14.70 | 16.40 |
| 44 | 21.50 | 21.00 | 19.50 | 16.50 | 19.90 | 19.40 |
| 45 | 17.40 | 16.30 | 13.30 | 15.00 | 16.40 | 18.70 |
| 46 | 1.26 | 1.50 | 1.94 | 1.92 | 1.96 | NA |
| 47 | 1.76 | 1.75 | 1.79 | 1.66 | 1.87 | 1.67 |
| 48 | 10.22 | 9.69 | 9.98 | 10.74 | 10.33 | NA |
| 49 | 7.23 | 7.31 | 7.92 | 7.06 | 5.40 | 4.82 |
| 50 | 26.60 | 60.40 | 53.60 | 55.00 | 44.60 | NA |
| 51 | 28.80 | 59.70 | 52.00 | 54.80 | 45.50 | 48.50 |
| 52 | 1607.7 | 3510.7 | 2907.8 | 3639.5 | 3045.6 | 3301.8 |
| 53 | 9.43 | 9.54 | 8.04 | 8.85 | 7.91 | 8.07 |
| 54 | 8.42 | 8.61 | 8.51 | 9.19 | 9.14 | 9.31 |

Table 55: Provided are the values of each of the parameters (as described above) measured in *Sorghum* accessions (Line) under normal conditions. Growth conditions are specified in the experimental procedure section. "NA" = not available.

TABLE 56

Measured parameters in *Sorghum* accessions under drought growth conditions

| Line/Corr. ID | Line-1 | Line-2 | Line-3 | Line-4 | Line-5 | Line-6 |
|---|---|---|---|---|---|---|
| 1 | 0.023 | 0.019 | 0.006 | 0.019 | 0.012 | 0.024 |
| 2 | 6967.7 | 5451.7 | 3960.3 | 9838.5 | 6481.7 | 12403 |
| 3 | 24.20 | 19.80 | 14.20 | 14.60 | 25.50 | 20.80 |
| 4 | 23.80 | 13.70 | 7.00 | 18.20 | 20.70 | 34.40 |
| 5 | 0.142 | 0.114 | 0.095 | 0.112 | 0.144 | 0.131 |
| 6 | 0.87 | 0.87 | 0.86 | 0.88 | 0.87 | 0.89 |
| 7 | 72.40 | 96.60 | 32.80 | 55.30 | 131.20 | 85.90 |
| 8 | 22.30 | 24.80 | 12.40 | 19.90 | 27.60 | 19.40 |

TABLE 56-continued

Measured parameters in Sorghum accessions under drought growth conditions

| Line/Corr. ID | Line-1 | Line-2 | Line-3 | Line-4 | Line-5 | Line-6 |
|---|---|---|---|---|---|---|
| 9 | 4.27 | 5.53 | 3.70 | 3.72 | 7.00 | 5.81 |
| 10 | 72.40 | 93.80 | 30.80 | 55.30 | 131.20 | 76.50 |
| 11 | 22.30 | 24.40 | 12.20 | 19.90 | 27.60 | 18.20 |
| 12 | 4.27 | 5.39 | 3.51 | 3.72 | 7.00 | 5.27 |
| 13 | 0.11 | 0.094 | 0.03 | 0.094 | 0.056 | 0.116 |
| 14 | 0.135 | 0.158 | 0.065 | 0.187 | 0.255 | 0.291 |
| 15 | 0.157 | 0.359 | 0.071 | 0.244 | 0.056 | 0.511 |
| 16 | NA | 12.10 | 24.80 | 37.00 | 23.30 | 11.70 |
| 17 | NA | 2.02 | 1.00 | 1.04 | NA | 1.06 |
| 18 | 36.10 | 35.80 | 35.50 | 36.60 | 35.90 | 33.80 |
| 19 | 35.80 | 36.00 | 36.50 | 38.40 | 35.90 | 36.50 |
| 20 | 30.4 | 774.8 | 61.8 | 68.3 | 31.2 | 330.5 |
| 21 | 135.1 | 561.2 | 94.4 | 276.2 | 64.1 | 217.2 |
| 22 | 65.60 | 78.50 | 83.80 | 54.90 | 69.70 | 74.50 |
| 23 | 75.90 | 143.30 | 62.90 | 44.40 | 61.40 | 106.10 |
| 24 | NA | 2.00 | NA | NA | NA | 1.00 |
| 25 | 45.80 | 47.00 | 38.80 | 38.20 | 35.90 | 43.40 |
| 26 | 43.50 | 27.00 | 36.00 | 34.10 | 27.30 | 25.80 |
| 27 | 0.371 | 0.728 | 0.407 | 0.695 | 0.425 | 0.878 |
| 28 | 0.286 | 0.424 | 0.256 | 0.478 | 0.366 | 0.394 |
| 29 | 86.90 | 61.30 | 75.00 | 77.80 | 75.50 | 80.40 |
| 30 | 3.58 | NA | 2.64 | 3.43 | 2.81 | NA |
| 31 | 3308.1 | 1206 | 2464.6 | 1142.9 | 2116.3 | 1550 |
| 32 | 104.6 | 83.2 | 113 | 69 | 104.2 | 133.5 |
| 33 | 1.59 | 1.56 | 1.83 | 1.28 | 1.8 | 2.02 |
| 34 | 91.50 | 66.30 | 88.00 | 74.70 | 90.00 | 71.00 |
| 35 | 115.00 | 92.00 | 115.00 | 107.00 | 107.00 | 107.00 |
| 36 | 0.082 | 0.039 | 0.086 | 0.062 | 0.017 | 0.048 |
| 37 | 1.76 | 1.46 | 2.27 | 2.78 | 2.39 | 1.28 |
| 38 | 1.96 | 1.6 | 2.27 | 2.49 | 3.56 | 1.25 |
| 39 | 9.62 | 10.46 | 7.49 | 10.79 | 10.25 | 9.66 |
| 40 | 9.68 | 8.31 | 7.38 | 10.11 | 10.72 | 5.51 |
| 41 | 7.79 | 4.03 | 16.46 | 3.29 | 10.83 | 10.82 |
| 42 | 7.06 | 4.51 | 16.23 | 3.31 | 9.88 | 10.5 |
| 43 | 20.10 | 16.10 | 14.40 | 18.50 | 15.50 | 14.10 |
| 44 | NA | 1.44 | NA | NA | NA | 1.38 |
| 45 | 2.33 | 1.43 | 2.17 | 1.92 | 1.85 | 1.66 |
| 46 | 0.86 | 9.89 | NA | NA | NA | 8.1 |
| 47 | 9.45 | 5.72 | 7.26 | 8.6 | 6.53 | 3.6 |
| 48 | 25.00 | 40.00 | NA | NA | NA | 15.90 |
| 49 | 26.60 | 39.60 | 15.50 | 31.10 | 31.10 | 20.70 |
| 50 | 1288.2 | 2524.3 | 468.4 | 1128.6 | 1370.3 | 1724.9 |
| 51 | 10.08 | 9.42 | 6.42 | 6.77 | 7.81 | 9.7 |
| 52 | 7.79 | 8.92 | 5.87 | 6.63 | 7.45 | 10.2 |
| 53 | 19.20 | 16.60 | 14.90 | 18.40 | 15.80 | 14.00 |
| 54 | 19.00 | 18.40 | 16.00 | 19.10 | 15.50 | 14.30 |

Table 56: Provided are the values of each of the parameters (as described above) measured in Sorghum accessions (Line) under drought conditions. Growth conditions are specified in the experimental procedure section.

TABLE 57

Measured parameters in additional Sorghum accessions under drought growth conditions

| Line/Corr. ID | Line-7 | Line-8 | Line-9 | Line-10 | Line-11 | Line-12 |
|---|---|---|---|---|---|---|
| 1 | 0.026 | 0.035 | 0.042 | 0.05 | 0.033 | 0.031 |
| 2 | 9979.9 | 17494.2 | 14526.2 | 15729 | 10949.1 | 13808.5 |
| 3 | 15.40 | 13.30 | 17.90 | 20.20 | 18.70 | 18.00 |
| 4 | 19.10 | 29.20 | 31.70 | 40.20 | 25.20 | 29.50 |
| 5 | 0.109 | 0.102 | 0.107 | 0.116 | 0.111 | 0.12 |
| 6 | 0.89 | 0.88 | 0.9 | 0.9 | 0.9 | 0.89 |
| 7 | 68.70 | 114.60 | 94.20 | 104.20 | 125.80 | 87.40 |
| 8 | 19.90 | 31.10 | 22.20 | 24.40 | 25.30 | 24.80 |
| 9 | 4.62 | 5.02 | 5.57 | 5.70 | 7.39 | 4.77 |
| 10 | 67.50 | 112.60 | 82.80 | 100.50 | 122.90 | 86.30 |
| 11 | 19.60 | 30.80 | 21.00 | 24.00 | 24.80 | 24.40 |
| 12 | 4.57 | 4.96 | 4.99 | 5.56 | 7.29 | 4.72 |
| 13 | 0.127 | 0.171 | 0.203 | 0.244 | 0.16 | 0.151 |
| 14 | 0.235 | 0.325 | 0.335 | 0.342 | 0.222 | 0.223 |
| 15 | 0.445 | 0.48 | 0.544 | 0.524 | 0.462 | 0.348 |
| 16 | 9.30 | 19.30 | 33.10 | 27.30 | 24.70 | 50.40 |
| 17 | 1.14 | 1.00 | 1.18 | 1.11 | 1.29 | 0.85 |
| 18 | 37.50 | 41.20 | 36.50 | 37.00 | 36.80 | 35.90 |
| 19 | 36.20 | 36.50 | 35.00 | 36.30 | 35.80 | 36.50 |
| 20 | 387.7 | 582.1 | 985.6 | 835 | 753.4 | 54.2 |
| 21 | 81.2 | 129.8 | 241.6 | 322.9 | 257 | 127.2 |
| 22 | 71.70 | 66.90 | 68.60 | 68.20 | 70.70 | 76.30 |
| 23 | 128.70 | 132.90 | 138.50 | 133.30 | 78.30 | 47.30 |
| 24 | 1.25 | 1.69 | 1.12 | 1.75 | 1.38 | NA |
| 25 | 47.60 | 44.70 | 51.90 | 48.80 | 40.00 | 37.60 |
| 26 | 42.90 | 30.90 | 43.70 | 37.80 | 38.40 | 32.50 |
| 27 | 0.678 | 0.807 | 0.788 | 0.731 | 0.741 | 0.831 |
| 28 | 0.326 | 0.329 | 0.364 | 0.377 | 0.469 | 0.625 |
| 29 | 64.20 | 70.80 | 64.10 | 75.70 | 72.10 | 87.20 |
| 30 | NA | NA | NA | NA | NA | 3.94 |
| 31 | 1476.2 | 1773.1 | 1052.7 | 1408.5 | 417.2 | 1247.1 |
| 32 | 47.8 | 80.9 | 93.4 | 104.1 | 75.8 | 105.6 |
| 33 | 0.92 | 1.44 | 1.6 | 1.87 | 1.33 | 1.9 |
| 34 | 68.30 | 63.00 | 56.00 | 59.70 | 56.00 | 76.70 |
| 35 | 92.00 | 92.00 | 92.00 | 92.00 | 92.00 | 107.00 |
| 36 | 0.038 | 0.033 | 0.033 | 0.044 | 0.061 | 0.076 |
| 37 | 1.75 | 1.69 | 2.37 | 1.61 | 1.52 | 2.03 |
| 38 | 2.38 | 1.71 | 1.66 | 1.64 | 2.36 | 1.6 |
| 39 | 10.87 | 10.36 | 11.28 | 10.7 | 10.71 | 9.68 |
| 40 | 7.51 | 7.54 | 8.75 | 8.34 | 4.52 | 7.76 |
| 41 | 2.82 | 4.04 | 4.75 | 4.72 | 3.29 | 7.66 |
| 42 | 3.11 | 4.12 | 4.31 | 5.74 | 3.53 | 5.9 |
| 43 | 17.00 | 16.40 | 13.70 | 14.70 | 14.00 | 19.50 |
| 44 | 1.47 | 1.81 | 2.12 | 1.79 | 2.07 | NA |
| 45 | 1.55 | 1.65 | 1.62 | 1.63 | 1.71 | 1.76 |
| 46 | 10.69 | 10.12 | 10.49 | 10.01 | 10.56 | NA |
| 47 | 4.61 | 5.18 | 5.39 | 5.4 | 2.98 | 5.53 |
| 48 | 25.80 | 50.10 | 46.80 | 46.90 | 44.20 | NA |
| 49 | 24.10 | 48.60 | 48.80 | 48.70 | 38.20 | 26.10 |
| 50 | 1507.8 | 2865.3 | 2857.9 | 2956 | 1964.3 | 1288.5 |
| 51 | 9.07 | 7.92 | 8.17 | 8.54 | 7.67 | 7.36 |
| 52 | 8.88 | 8.6 | 8.59 | 8.73 | 8.13 | 7.85 |
| 53 | 17.20 | 14.90 | 13.30 | 14.50 | 13.80 | 17.30 |
| 54 | 17.20 | 20.00 | 16.00 | 16.90 | 17.00 | 19.60 |

Table 57: Provided are the values of each of the parameters (as described above) measured in Sorghum accessions (Line) under drought conditions. Growth conditions are specified in the experimental procedure section.

TABLE 58

Correlation between the expression level of selected genes of some embodiments of the invention in various tissues and the phenotypic performance under normal conditions across Sorghum accessions

| Gene Name | R | P value | Exp. set | Corr. ID | Gene Name | R | P value | Exp. set | Corr. ID |
|---|---|---|---|---|---|---|---|---|---|
| LBY257 | 0.72 | 6.85E−02 | 2 | 53 | LBY257 | 0.76 | 4.93E−02 | 2 | 19 |
| LBY257 | 0.73 | 6.10E−02 | 1 | 15 | LBY257 | 0.89 | 1.77E−02 | 1 | 17 |
| LBY258 | 0.92 | 3.48E−03 | 2 | 15 | LBY258 | 0.89 | 7.06E−03 | 2 | 3 |
| LBY258 | 0.88 | 8.96E−03 | 2 | 6 | LBY258 | 0.88 | 9.67E−03 | 2 | 14 |
| LBY258 | 0.78 | 3.69E−02 | 2 | 11 | LBY258 | 0.72 | 6.75E−02 | 2 | 8 |

TABLE 58-continued

Correlation between the expression level of selected genes of some
embodiments of the invention in various tissues and the phenotypic
performance under normal conditions across Sorghum accessions

| Gene Name | R | P value | Exp. set | Corr. ID | Gene Name | R | P value | Exp. set | Corr. ID |
|---|---|---|---|---|---|---|---|---|---|
| LBY258 | 0.75 | 5.30E−02 | 2 | 23 | LBY258 | 0.88 | 9.05E−03 | 2 | 22 |
| LBY258 | 0.71 | 7.33E−02 | 2 | 21 | LBY258 | 0.84 | 1.87E−02 | 2 | 2 |
| LBY258 | 0.74 | 5.87E−02 | 2 | 16 | LBY258 | 0.84 | 1.87E−02 | 2 | 13 |
| LBY258 | 0.98 | 5.51E−04 | 5 | 50 | LBY258 | 0.99 | 7.29E−06 | 5 | 46 |
| LBY258 | 0.76 | 8.24E−02 | 5 | 24 | LBY258 | 0.76 | 4.84E−02 | 5 | 48 |
| LBY258 | 0.75 | 8.36E−02 | 6 | 24 | LBY258 | 0.73 | 1.55E−02 | 6 | 44 |
| LBY258 | 0.71 | 2.22E−02 | 6 | 27 | LBY258 | 0.71 | 2.16E−02 | 4 | 29 |
| LBY258 | 0.84 | 2.46E−03 | 4 | 45 | LBY258 | 0.86 | 2.84E−02 | 4 | 24 |
| LBY258 | 0.80 | 5.59E−03 | 4 | 10 | LBY258 | 0.85 | 1.71E−03 | 4 | 9 |
| LBY258 | 0.82 | 3.30E−03 | 4 | 12 | LBY258 | 0.73 | 1.74E−02 | 4 | 42 |
| LBY258 | 0.85 | 2.05E−03 | 4 | 7 | LBY258 | 0.70 | 2.35E−02 | 4 | 16 |
| LBY258 | 0.71 | 2.03E−02 | 4 | 28 | LBY258 | 0.87 | 1.03E−03 | 4 | 34 |
| LBY258 | 0.77 | 8.86E−03 | 4 | 41 | LBY258 | 0.73 | 1.76E−02 | 4 | 36 |
| LBY258 | 0.71 | 1.17E−01 | 3 | 50 | LBY258 | 0.70 | 7.70E−02 | 1 | 33 |
| LBY258 | 0.88 | 9.86E−03 | 1 | 5 | LBY258 | 0.80 | 3.14E−02 | 1 | 35 |
| LBY258 | 0.76 | 4.62E−02 | 1 | 43 | LBY258 | 0.82 | 2.54E−02 | 1 | 47 |
| LBY258 | 0.81 | 2.70E−02 | 1 | 32 | LBY258 | 0.88 | 9.49E−03 | 1 | 34 |
| LBY258 | 0.78 | 4.02E−02 | 1 | 36 | LBY259 | 0.79 | 3.46E−02 | 2 | 3 |
| LBY259 | 0.77 | 4.45E−02 | 2 | 51 | LBY259 | 0.74 | 5.66E−02 | 1 | 18 |
| LBY259 | 0.84 | 1.83E−02 | 1 | 51 | LBY259 | 0.81 | 2.81E−02 | 1 | 26 |
| LBY259 | 0.70 | 7.90E−02 | 1 | 8 | LBY259 | 0.70 | 7.74E−02 | 1 | 39 |
| LBY259 | 0.75 | 5.35E−02 | 1 | 37 | LBY260 | 0.74 | 5.90E−02 | 2 | 19 |
| LBY260 | 0.74 | 5.64E−02 | 1 | 5 | LBY260 | 0.73 | 6.43E−02 | 1 | 32 |
| LBY278 | 0.84 | 1.69E−02 | 2 | 3 | LBY278 | 0.76 | 4.77E−02 | 2 | 51 |
| LBY278 | 0.74 | 5.52E−02 | 2 | 6 | LBY278 | 0.76 | 4.64E−02 | 2 | 52 |
| LBY278 | 0.76 | 4.91E−02 | 2 | 16 | LBY278 | 0.74 | 2.30E−02 | 6 | 17 |
| LBY278 | 0.89 | 5.20E−04 | 6 | 47 | LBY278 | 0.75 | 1.31E−02 | 4 | 4 |
| LBY278 | 0.74 | 1.51E−02 | 4 | 9 | LBY278 | 0.89 | 4.88E−04 | 4 | 5 |
| LBY278 | 0.76 | 1.05E−02 | 4 | 12 | LBY278 | 0.88 | 3.99E−04 | 3 | 29 |
| LBY278 | 0.71 | 1.40E−02 | 3 | 35 | LBY278 | 0.73 | 1.11E−02 | 3 | 42 |
| LBY278 | 0.77 | 5.97E−03 | 3 | 47 | LBY278 | 0.76 | 6.77E−03 | 3 | 28 |
| LBY278 | 0.91 | 9.06E−05 | 3 | 34 | LBY278 | 0.81 | 2.26E−03 | 3 | 41 |
| LBY278 | 0.87 | 4.43E−04 | 3 | 36 | LBY278 | 0.95 | 8.13E−04 | 1 | 26 |
| LBY278 | 0.75 | 5.04E−02 | 1 | 40 | LBY279 | 0.80 | 3.13E−02 | 2 | 6 |
| LBY279 | 0.74 | 5.88E−02 | 2 | 2 | LBY279 | 0.74 | 5.76E−02 | 2 | 16 |
| LBY279 | 0.74 | 5.88E−02 | 2 | 13 | LBY279 | 0.73 | 1.02E−02 | 5 | 3 |
| LBY279 | 0.87 | 4.83E−04 | 5 | 16 | LBY279 | 0.74 | 1.40E−02 | 6 | 3 |
| LBY279 | 0.88 | 2.04E−02 | 6 | 50 | LBY279 | 0.86 | 1.50E−03 | 6 | 16 |
| LBY279 | 0.89 | 7.82E−03 | 1 | 3 | LBY279 | 0.90 | 5.22E−03 | 1 | 54 |
| LBY279 | 0.71 | 7.12E−02 | 1 | 31 | LBY279 | 0.90 | 6.12E−03 | 1 | 1 |
| LBY279 | 0.77 | 4.33E−02 | 1 | 2 | LBY279 | 0.77 | 4.33E−02 | 1 | 13 |
| LBY280 | 0.74 | 5.56E−02 | 2 | 4 | LBY280 | 0.91 | 1.14E−02 | 2 | 17 |
| LBY280 | 0.89 | 5.24E−04 | 4 | 15 | LBY280 | 0.84 | 2.19E−03 | 4 | 25 |
| LBY280 | 0.86 | 2.92E−02 | 4 | 50 | LBY280 | 0.78 | 7.56E−03 | 4 | 14 |
| LBY280 | 0.94 | 4.00E−05 | 4 | 23 | LBY280 | 0.74 | 1.45E−02 | 4 | 22 |
| LBY280 | 0.84 | 2.12E−03 | 4 | 21 | LBY280 | 0.75 | 7.84E−03 | 3 | 15 |
| LBY280 | 0.77 | 4.49E−02 | 1 | 53 | LBY281 | 0.79 | 3.51E−02 | 2 | 3 |
| LBY281 | 0.79 | 3.37E−02 | 2 | 31 | LBY281 | 0.70 | 7.96E−02 | 2 | 1 |
| LBY281 | 0.78 | 3.98E−02 | 2 | 16 | LBY281 | 0.93 | 2.45E−03 | 5 | 46 |
| LBY281 | 0.83 | 3.87E−02 | 4 | 50 | LBY281 | 0.82 | 2.42E−02 | 4 | 46 |
| LBY281 | 0.80 | 5.35E−03 | 4 | 9 | LBY281 | 0.71 | 2.05E−02 | 4 | 39 |
| LBY281 | 0.72 | 1.99E−02 | 4 | 12 | LBY281 | 0.76 | 1.01E−02 | 4 | 7 |
| LBY281 | 0.72 | 6.60E−02 | 1 | 4 | LBY281 | 0.72 | 6.68E−02 | 1 | 5 |
| LBY281 | 0.74 | 5.76E−02 | 1 | 35 | LBY281 | 0.76 | 4.68E−02 | 1 | 47 |
| LBY305 | 0.74 | 2.24E−02 | 6 | 17 | LBY305 | 0.88 | 8.53E−04 | 6 | 47 |
| LBY305 | 0.72 | 1.93E−02 | 4 | 4 | LBY305 | 0.85 | 1.95E−02 | 4 | 5 |
| LBY305 | 0.79 | 6.77E−03 | 4 | 47 | LBY305 | 0.72 | 1.90E−02 | 4 | 32 |
| LBY305 | 0.79 | 3.64E−03 | 3 | 47 | LBY305 | 0.71 | 7.65E−02 | 1 | 5 |
| LBY305 | 0.76 | 4.93E−02 | 1 | 43 | LBY305 | 0.91 | 4.34E−03 | 1 | 47 |
| LBY306 | 0.76 | 4.57E−02 | 2 | 19 | LBY306 | 0.96 | 2.57E−03 | 5 | 50 |
| LBY306 | 0.92 | 3.14E−03 | 5 | 46 | LBY306 | 0.74 | 9.10E−03 | 5 | 40 |
| LBY306 | 0.70 | 1.20E−01 | 6 | 24 | LBY306 | 0.81 | 4.41E−03 | 6 | 20 |
| LBY306 | 0.77 | 9.05E−03 | 4 | 34 | LBY306 | 0.70 | 7.70E−02 | 3 | 48 |
| LBY306 | 0.77 | 4.44E−02 | 1 | 35 | LBY306 | 0.75 | 5.43E−02 | 1 | 43 |
| LBY306 | 0.78 | 3.77E−02 | 1 | 47 | LBY307 | 0.76 | 4.91E−02 | 2 | 31 |
| LBY307 | 0.72 | 2.01E−02 | 4 | 4 | LBY307 | 0.76 | 1.12E−02 | 4 | 5 |
| LBY307 | 0.84 | 1.15E−03 | 3 | 47 | LBY307 | 0.76 | 4.69E−02 | 1 | 4 |
| LBY307 | 0.70 | 7.80E−02 | 1 | 5 | LBY307 | 0.93 | 2.34E−03 | 1 | 47 |
| LBY308 | 0.82 | 4.64E−02 | 2 | 17 | LBY308 | 0.80 | 5.87E−03 | 4 | 9 |
| LBY308 | 0.72 | 1.95E−02 | 4 | 41 | LBY308 | 0.75 | 8.74E−02 | 3 | 24 |
| LBY308 | 0.81 | 2.83E−02 | 1 | 19 | LBY308 | 0.72 | 6.61E−02 | 1 | 27 |
| LBY309 | 0.71 | 7.29E−02 | 2 | 31 | LBY309 | 0.89 | 7.44E−03 | 2 | 43 |
| LBY309 | 0.79 | 3.49E−02 | 2 | 47 | LBY309 | 0.78 | 4.32E−03 | 5 | 26 |

TABLE 58-continued

Correlation between the expression level of selected genes of some embodiments of the invention in various tissues and the phenotypic performance under normal conditions across Sorghum accessions

| Gene Name | R | P value | Exp. set | Corr. ID | Gene Name | R | P value | Exp. set | Corr. ID |
|---|---|---|---|---|---|---|---|---|---|
| LBY309 | 0.70 | 2.37E−02 | 6 | 47 | LBY309 | 0.75 | 1.33E−02 | 4 | 45 |
| LBY309 | 0.91 | 1.06E−02 | 3 | 50 | LBY309 | 0.75 | 5.31E−02 | 1 | 35 |
| LBY309 | 0.90 | 5.83E−03 | 1 | 47 | LBY338 | 0.74 | 5.67E−02 | 2 | 53 |
| LBY338 | 0.79 | 5.99E−02 | 2 | 17 | LBY338 | 0.80 | 5.60E−02 | 5 | 24 |
| LBY338 | 0.70 | 1.56E−02 | 5 | 20 | LBY338 | 0.77 | 9.76E−03 | 6 | 54 |
| LBY338 | 0.84 | 2.15E−03 | 6 | 6 | LBY338 | 0.72 | 1.99E−02 | 6 | 14 |
| LBY338 | 0.77 | 8.51E−03 | 6 | 52 | LBY338 | 0.75 | 1.25E−02 | 6 | 1 |
| LBY338 | 0.94 | 4.74E−05 | 6 | 2 | LBY338 | 0.94 | 4.74E−05 | 6 | 13 |
| LBY338 | 0.79 | 6.31E−02 | 4 | 50 | LBY338 | 0.71 | 1.45E−02 | 3 | 4 |
| LBY338 | 0.80 | 2.86E−03 | 3 | 5 | LBY338 | 0.77 | 4.09E−02 | 1 | 54 |
| LBY339 | 0.93 | 2.73E−02 | 2 | 16 | LBY339 | 0.76 | 6.82E−03 | 5 | 54 |
| LBY339 | 0.74 | 8.55E−03 | 5 | 53 | LBY339 | 0.72 | 1.95E−02 | 4 | 43 |
| LBY339 | 0.75 | 5.29E−02 | 1 | 33 | LBY339 | 0.71 | 7.57E−02 | 1 | 5 |
| LBY339 | 0.72 | 6.59E−02 | 1 | 31 | LBY339 | 0.86 | 1.38E−02 | 1 | 32 |
| LBY339 | 0.74 | 5.80E−02 | 1 | 34 | LBY340 | 0.71 | 7.29E−02 | 2 | 54 |
| LBY340 | 0.74 | 9.18E−03 | 5 | 53 | LBY340 | 0.87 | 1.22E−03 | 6 | 47 |
| LBY340 | 0.90 | 4.65E−04 | 4 | 5 | LBY340 | 0.75 | 1.28E−02 | 4 | 47 |
| LBY340 | 0.83 | 3.27E−03 | 4 | 34 | LBY340 | 0.72 | 1.20E−02 | 3 | 42 |
| LBY340 | 0.72 | 1.28E−02 | 3 | 47 | LBY340 | 0.82 | 1.92E−03 | 3 | 41 |
| LBY340 | 0.80 | 3.04E−02 | 1 | 4 | LBY340 | 0.83 | 1.99E−02 | 1 | 5 |
| LBY340 | 0.75 | 5.45E−02 | 1 | 19 | LBY341 | 0.88 | 8.78E−03 | 2 | 3 |
| LBY341 | 0.88 | 8.46E−03 | 2 | 16 | LBY341 | 0.74 | 8.55E−03 | 5 | 12 |
| LBY341 | 0.79 | 3.54E−03 | 5 | 28 | LBY341 | 0.84 | 1.14E−03 | 5 | 34 |
| LBY341 | 0.71 | 1.39E−02 | 5 | 41 | LBY341 | 0.72 | 2.94E−02 | 6 | 17 |
| LBY341 | 0.74 | 1.53E−02 | 6 | 35 | LBY341 | 0.91 | 2.56E−04 | 6 | 47 |
| LBY341 | 0.85 | 1.05E−03 | 3 | 38 | LBY341 | 0.89 | 7.81E−03 | 1 | 51 |
| LBY341 | 0.81 | 2.63E−02 | 1 | 6 | LBY341 | 0.81 | 2.72E−02 | 1 | 52 |
| LBY342 | 0.82 | 2.24E−02 | 2 | 15 | LBY342 | 0.82 | 2.43E−02 | 2 | 14 |
| LBY342 | 0.81 | 2.78E−02 | 2 | 23 | LBY342 | 0.87 | 1.10E−02 | 2 | 22 |
| LBY342 | 0.87 | 2.39E−02 | 5 | 50 | LBY342 | 0.80 | 3.20E−02 | 5 | 46 |
| LBY342 | 0.91 | 4.41E−03 | 4 | 46 | LBY342 | 0.71 | 2.27E−02 | 4 | 9 |
| LBY342 | 0.70 | 1.20E−01 | 3 | 50 | LBY342 | 0.95 | 1.25E−03 | 1 | 38 |
| LBY342 | 0.79 | 3.48E−02 | 1 | 39 | LBY342 | 0.76 | 4.59E−02 | 1 | 40 |
| LBY343 | 0.71 | 7.39E−02 | 2 | 1 | LBY343 | 0.91 | 4.01E−03 | 2 | 16 |
| LBY343 | 0.79 | 4.09E−03 | 5 | 10 | LBY343 | 0.78 | 4.68E−03 | 5 | 9 |
| LBY343 | 0.88 | 3.54E−04 | 5 | 12 | LBY343 | 0.75 | 7.71E−03 | 5 | 42 |
| LBY343 | 0.72 | 1.26E−02 | 5 | 7 | LBY343 | 0.83 | 1.50E−03 | 5 | 28 |
| LBY343 | 0.76 | 6.74E−03 | 5 | 41 | LBY343 | 0.75 | 1.24E−02 | 6 | 16 |
| LBY343 | 0.84 | 2.57E−03 | 6 | 36 | LBY343 | 0.90 | 4.12E−04 | 4 | 29 |
| LBY343 | 0.76 | 1.02E−02 | 4 | 5 | LBY343 | 0.79 | 7.06E−03 | 4 | 28 |
| LBY343 | 0.73 | 1.57E−02 | 4 | 32 | LBY343 | 0.85 | 1.67E−03 | 4 | 34 |
| LBY343 | 0.90 | 3.73E−04 | 4 | 36 | LBY343 | 0.85 | 1.02E−03 | 3 | 47 |
| LBY343 | 0.95 | 9.82E−04 | 1 | 16 | LBY343 | 0.80 | 2.93E−02 | 1 | 37 |
| LBY344 | 0.76 | 9.99E−03 | 6 | 35 | LBY344 | 0.82 | 3.63E−03 | 6 | 47 |
| LBY344 | 0.73 | 1.65E−02 | 4 | 9 | LBY344 | 0.74 | 9.13E−03 | 3 | 5 |
| LBY346 | 0.84 | 2.29E−03 | 6 | 47 | LBY346 | 0.89 | 7.51E−03 | 2 | 16 |
| LBY348 | 0.73 | 9.98E−03 | 2 | 17 | LBY348 | 0.83 | 2.08E−02 | 2 | 5 |
| LBY348 | 0.73 | 6.38E−02 | 2 | 34 | LBY348 | 0.85 | 1.54E−02 | 2 | 47 |
| LBY348 | 0.85 | 1.54E−02 | 5 | 46 | LBY348 | 0.99 | 2.27E−04 | 5 | 50 |
| LBY348 | 0.93 | 9.53E−05 | 6 | 47 | LBY348 | 0.74 | 8.93E−02 | 5 | 24 |
| LBY348 | 0.77 | 6.04E−03 | 3 | 35 | LBY348 | 0.85 | 1.86E−03 | 4 | 47 |
| LBY348 | 0.74 | 9.54E−03 | 3 | 36 | LBY348 | 0.85 | 1.04E−03 | 3 | 47 |
| LBY348 | 0.79 | 3.35E−02 | 1 | 5 | LBY348 | 0.89 | 7.10E−03 | 1 | 4 |
| LBY349 | 0.71 | 7.62E−02 | 2 | 15 | LBY348 | 0.87 | 9.95E−03 | 1 | 47 |
| LBY349 | 0.71 | 7.44E−02 | 2 | 44 | LBY349 | 0.78 | 3.66E−02 | 2 | 53 |
| LBY349 | 0.77 | 5.96E−03 | 5 | 51 | LBY349 | 0.81 | 2.58E−02 | 2 | 47 |
| LBY349 | 0.71 | 1.35E−02 | 5 | 4 | LBY349 | 0.80 | 5.65E−02 | 5 | 50 |
| LBY349 | 0.84 | 3.59E−02 | 6 | 24 | LBY349 | 0.72 | 1.04E−01 | 6 | 50 |
| LBY349 | 0.70 | 2.31E−02 | 4 | 33 | LBY349 | 0.96 | 4.42E−04 | 6 | 48 |
| LBY349 | 0.73 | 1.71E−02 | 4 | 42 | LBY349 | 0.81 | 4.63E−03 | 4 | 4 |
| LBY349 | 0.84 | 3.81E−02 | 3 | 50 | LBY349 | 0.86 | 6.37E−04 | 3 | 51 |
| LBY349 | 0.76 | 4.59E−02 | 1 | 23 | LBY349 | 0.75 | 7.68E−03 | 3 | 52 |
| LBY350 | 0.89 | 7.87E−03 | 2 | 51 | LBY349 | 0.76 | 4.81E−02 | 1 | 21 |
| LBY350 | 0.93 | 7.63E−03 | 6 | 24 | LBY350 | 0.76 | 4.88E−02 | 2 | 53 |
| LBY350 | 0.74 | 1.39E−02 | 4 | 15 | LBY350 | 0.81 | 4.32E−03 | 6 | 47 |
| LBY350 | 0.74 | 8.97E−02 | 4 | 50 | LBY350 | 0.76 | 1.03E−02 | 4 | 25 |
| LBY350 | 0.78 | 7.17E−03 | 4 | 20 | LBY350 | 0.78 | 7.76E−03 | 4 | 53 |
| LBY350 | 0.71 | 2.16E−02 | 4 | 23 | LBY350 | 0.83 | 3.06E−02 | 4 | 44 |
| LBY350 | 0.73 | 6.12E−02 | 1 | 4 | LBY350 | 0.73 | 1.65E−02 | 4 | 21 |
| LBY352 | 0.72 | 1.08E−01 | 2 | 17 | LBY350 | 0.80 | 2.99E−02 | 1 | 47 |
| LBY352 | 0.73 | 1.14E−02 | 5 | 20 | LBY352 | 0.82 | 4.78E−02 | 5 | 50 |
| LBY352 | 0.84 | 2.46E−03 | 4 | 25 | LBY352 | 0.78 | 8.38E−03 | 4 | 15 |
| LBY352 | 0.94 | 4.24E−05 | 4 | 23 | LBY352 | 0.72 | 1.07E−01 | 4 | 50 |

TABLE 58-continued

Correlation between the expression level of selected genes of some embodiments of the invention in various tissues and the phenotypic performance under normal conditions across Sorghum accessions

| Gene Name | R | P value | Exp. set | Corr. ID | Gene Name | R | P value | Exp. set | Corr. ID |
|---|---|---|---|---|---|---|---|---|---|
| LBY352 | 0.77 | 4.13E-02 | 1 | 43 | LBY352 | 0.87 | 1.17E-03 | 4 | 21 |
| LBY353 | 0.71 | 7.53E-02 | 2 | 41 | LBY352 | 0.75 | 5.47E-02 | 1 | 47 |
| LBY353 | 0.71 | 2.26E-02 | 6 | 47 | LBY353 | 0.70 | 2.33E-02 | 6 | 5 |
| LBY353 | 0.72 | 1.86E-02 | 6 | 34 | LBY353 | 0.75 | 1.17E-02 | 6 | 32 |
| LBY353 | 0.71 | 2.05E-02 | 4 | 28 | LBY353 | 0.83 | 2.95E-03 | 6 | 36 |
| LBY353 | 0.71 | 1.35E-02 | 3 | 14 | LBY353 | 0.72 | 1.84E-02 | 4 | 41 |
| LBY354 | 0.71 | 7.51E-02 | 2 | 54 | LBY353 | 0.80 | 3.12E-02 | 1 | 53 |
| LBY354 | 0.93 | 2.34E-03 | 2 | 5 | LBY354 | 0.83 | 2.03E-02 | 2 | 4 |
| LBY354 | 0.74 | 5.80E-02 | 2 | 32 | LBY354 | 0.88 | 9.38E-03 | 2 | 1 |
| LBY354 | 0.98 | 1.52E-04 | 5 | 46 | LBY354 | 0.78 | 6.68E-02 | 5 | 50 |
| LBY354 | 0.71 | 2.24E-02 | 6 | 38 | LBY354 | 0.81 | 2.74E-02 | 6 | 46 |
| LBY354 | 0.75 | 1.33E-02 | 4 | 10 | LBY354 | 0.88 | 1.67E-03 | 6 | 17 |
| LBY354 | 0.73 | 1.70E-02 | 4 | 5 | LBY354 | 0.83 | 3.12E-03 | 4 | 9 |
| LBY354 | 0.74 | 1.39E-02 | 4 | 7 | LBY354 | 0.84 | 2.49E-03 | 4 | 12 |
| LBY354 | 0.81 | 2.84E-02 | 3 | 46 | LBY354 | 0.76 | 1.04E-02 | 4 | 41 |
| LBY382 | 0.75 | 5.10E-02 | 2 | 20 | LBY382 | 0.76 | 4.55E-02 | 2 | 6 |
| LBY382 | 0.81 | 2.57E-02 | 2 | 13 | LBY382 | 0.81 | 2.57E-02 | 2 | 2 |
| LBY382 | 0.70 | 2.36E-02 | 6 | 25 | LBY382 | 0.72 | 6.55E-02 | 5 | 46 |
| LBY382 | 0.71 | 2.14E-02 | 6 | 23 | LBY382 | 0.79 | 6.87E-03 | 6 | 20 |
| LBY382 | 0.72 | 1.79E-02 | 4 | 53 | LBY382 | 0.74 | 1.38E-02 | 6 | 39 |
| LBY382 | 0.71 | 1.38E-02 | 3 | 11 | LBY382 | 0.71 | 1.48E-02 | 3 | 10 |
| LBY382 | 0.88 | 8.62E-03 | 1 | 25 | LBY382 | 0.72 | 1.89E-02 | 3 | 17 |
| LBY382 | 0.84 | 1.68E-02 | 1 | 20 | LBY382 | 0.71 | 1.15E-01 | 1 | 17 |
| LBY382 | 0.77 | 4.33E-02 | 1 | 39 | LBY382 | 0.80 | 3.18E-02 | 1 | 23 |
| LBY383 | 0.79 | 3.36E-02 | 2 | 15 | LBY382 | 0.84 | 1.88E-02 | 1 | 37 |
| LBY383 | 0.90 | 5.31E-03 | 2 | 53 | LBY383 | 0.80 | 3.13E-02 | 2 | 51 |
| LBY383 | 0.76 | 4.76E-02 | 2 | 11 | LBY383 | 0.70 | 7.97E-02 | 2 | 14 |
| LBY383 | 0.74 | 5.48E-02 | 2 | 22 | LBY383 | 0.82 | 2.37E-02 | 2 | 8 |
| LBY383 | 0.93 | 2.33E-03 | 5 | 46 | LBY383 | 0.90 | 1.44E-02 | 5 | 50 |
| LBY383 | 0.74 | 1.47E-02 | 4 | 9 | LBY383 | 0.76 | 7.84E-02 | 5 | 24 |
| LBY383 | 0.76 | 4.77E-02 | 1 | 26 | LBY383 | 0.80 | 5.24E-03 | 4 | 5 |
| LBY384 | 0.88 | 8.88E-03 | 2 | 29 | LBY383 | 0.79 | 3.64E-02 | 1 | 35 |
| LBY384 | 0.80 | 3.16E-02 | 2 | 5 | LBY384 | 0.71 | 7.65E-02 | 2 | 33 |
| LBY384 | 0.91 | 3.95E-03 | 2 | 34 | LBY384 | 0.84 | 1.72E-02 | 2 | 28 |
| LBY384 | 0.74 | 5.49E-02 | 2 | 41 | LBY384 | 0.83 | 2.18E-02 | 2 | 27 |
| LBY384 | 0.73 | 1.00E-01 | 5 | 50 | LBY384 | 0.83 | 2.16E-02 | 2 | 36 |
| LBY384 | 0.78 | 8.17E-03 | 6 | 9 | LBY384 | 0.78 | 8.44E-03 | 6 | 10 |
| LBY384 | 0.77 | 9.20E-03 | 6 | 7 | LBY384 | 0.81 | 4.14E-03 | 6 | 12 |
| LBY384 | 0.91 | 2.60E-04 | 4 | 10 | LBY384 | 0.83 | 3.14E-03 | 4 | 33 |
| LBY384 | 0.77 | 9.69E-03 | 4 | 5 | LBY384 | 0.91 | 2.09E-04 | 4 | 9 |
| LBY384 | 0.81 | 4.82E-03 | 4 | 8 | LBY384 | 0.79 | 6.30E-03 | 4 | 11 |
| LBY384 | 0.87 | 1.01E-03 | 4 | 42 | LBY384 | 0.93 | 9.04E-05 | 4 | 12 |
| LBY384 | 0.74 | 1.50E-02 | 4 | 16 | LBY384 | 0.92 | 1.33E-04 | 4 | 7 |
| LBY384 | 0.77 | 8.47E-03 | 4 | 32 | LBY384 | 0.87 | 1.11E-03 | 4 | 28 |
| LBY384 | 0.74 | 1.40E-02 | 4 | 36 | LBY384 | 0.92 | 1.55E-04 | 4 | 41 |
| LBY384 | 0.80 | 2.87E-03 | 3 | 10 | LBY384 | 0.72 | 1.18E-02 | 3 | 33 |
| LBY384 | 0.72 | 1.25E-02 | 3 | 5 | LBY384 | 0.75 | 7.39E-03 | 3 | 9 |
| LBY384 | 0.77 | 5.85E-03 | 3 | 7 | LBY384 | 0.82 | 2.18E-03 | 3 | 12 |
| LBY384 | 0.71 | 1.47E-02 | 3 | 32 | LBY384 | 0.77 | 5.23E-03 | 3 | 28 |
| LBY384 | 0.85 | 1.52E-02 | 1 | 43 | LBY384 | 0.72 | 1.31E-02 | 3 | 34 |
| LBY384 | 0.79 | 3.32E-02 | 1 | 34 | LBY384 | 0.86 | 1.33E-02 | 1 | 47 |
| LBY385 | 0.71 | 7.52E-02 | 2 | 51 | LBY385 | 0.89 | 7.00E-03 | 2 | 3 |
| LBY385 | 0.75 | 5.22E-02 | 2 | 2 | LBY385 | 0.83 | 2.23E-02 | 2 | 6 |
| LBY385 | 0.75 | 7.49E-03 | 5 | 43 | LBY385 | 0.75 | 5.22E-02 | 2 | 13 |
| LBY385 | 0.74 | 1.45E-02 | 4 | 25 | LBY385 | 0.76 | 1.06E-02 | 4 | 15 |
| LBY385 | 0.71 | 2.16E-02 | 4 | 14 | LBY385 | 0.71 | 1.15E-01 | 4 | 50 |
| LBY385 | 0.73 | 1.68E-02 | 4 | 21 | LBY385 | 0.88 | 7.25E-04 | 4 | 23 |
| LBY385 | 0.77 | 5.41E-03 | 3 | 22 | LBY385 | 0.71 | 1.54E-02 | 3 | 23 |
| LBY385 | 0.75 | 5.17E-02 | 1 | 26 | LBY385 | 0.81 | 2.46E-03 | 3 | 21 |
| LBY385 | 0.84 | 1.90E-02 | 2 | 15 | LBY385 | 0.86 | 1.39E-02 | 1 | 37 |
| LBY387 | 0.71 | 7.31E-02 | 2 | 53 | LBY387 | 0.79 | 3.62E-02 | 2 | 3 |
| LBY387 | 0.74 | 5.87E-02 | 2 | 22 | LBY387 | 0.74 | 5.61E-02 | 2 | 14 |
| LBY387 | 0.93 | 7.02E-03 | 5 | 50 | LBY387 | 0.71 | 7.50E-02 | 2 | 16 |
| LBY387 | 0.73 | 1.09E-02 | 5 | 40 | LBY387 | 0.87 | 1.16E-02 | 5 | 46 |
| LBY387 | 0.72 | 1.27E-02 | 3 | 54 | LBY387 | 0.72 | 1.21E-02 | 3 | 15 |
| LBY387 | 0.80 | 3.33E-03 | 3 | 2 | LBY387 | 0.75 | 8.15E-03 | 3 | 6 |
| LBY387 | 0.74 | 5.90E-02 | 1 | 22 | LBY387 | 0.80 | 3.33E-03 | 3 | 13 |
| LBY388 | 0.78 | 6.62E-02 | 2 | 17 | LBY388 | 0.79 | 3.64E-02 | 2 | 53 |
| LBY388 | 0.83 | 2.11E-02 | 5 | 48 | LBY388 | 0.71 | 1.50E-02 | 5 | 26 |
| LBY389 | 0.79 | 3.61E-02 | 2 | 44 | LBY389 | 0.72 | 6.68E-02 | 2 | 51 |
| LBY389 | 0.91 | 4.40E-03 | 5 | 46 | LBY389 | 0.87 | 2.40E-02 | 5 | 50 |
| LBY389 | 0.72 | 1.83E-02 | 4 | 12 | LBY389 | 0.78 | 3.81E-02 | 5 | 48 |
| LBY389 | 0.76 | 4.65E-02 | 1 | 26 | LBY389 | 0.72 | 6.90E-02 | 1 | 51 |

TABLE 58-continued

Correlation between the expression level of selected genes of some embodiments of the invention in various tissues and the phenotypic performance under normal conditions across Sorghum accessions

| Gene Name | R | P value | Exp. set | Corr. ID | Gene Name | R | P value | Exp. set | Corr. ID |
|---|---|---|---|---|---|---|---|---|---|
| LBY389 | 0.82 | 2.46E−02 | 1 | 49 | LBY389 | 0.82 | 2.43E−02 | 1 | 20 |
| LBY392 | 0.75 | 5.06E−02 | 2 | 18 | LBY389 | 0.88 | 8.46E−03 | 1 | 40 |
| LBY392 | 0.77 | 8.77E−03 | 4 | 33 | LBY392 | 0.76 | 4.71E−02 | 2 | 25 |
| LBY392 | 0.85 | 1.82E−03 | 4 | 9 | LBY392 | 0.84 | 1.93E−02 | 2 | 44 |
| LBY392 | 0.82 | 3.47E−03 | 4 | 42 | LBY392 | 0.78 | 7.87E−03 | 4 | 10 |
| LBY392 | 0.72 | 1.90E−02 | 4 | 28 | LBY392 | 0.87 | 1.12E−03 | 4 | 12 |
| LBY392 | 0.88 | 7.88E−04 | 4 | 41 | LBY392 | 0.78 | 7.39E−03 | 4 | 7 |
| LBY392 | 0.88 | 9.65E−03 | 1 | 37 | LBY392 | 0.71 | 2.04E−02 | 4 | 32 |
| LBY393 | 0.75 | 5.36E−02 | 2 | 11 | LBY392 | 0.85 | 2.00E−03 | 3 | 17 |
| LBY393 | 0.83 | 2.08E−02 | 2 | 16 | LBY393 | 0.70 | 7.86E−02 | 2 | 51 |
| LBY393 | 0.72 | 1.94E−02 | 4 | 51 | LBY393 | 0.87 | 1.11E−02 | 2 | 8 |
| LBY393 | 0.87 | 1.15E−02 | 1 | 35 | LBY393 | 0.86 | 1.57E−03 | 6 | 47 |
| LBY395 | 0.80 | 2.96E−02 | 2 | 6 | LBY393 | 0.90 | 1.38E−02 | 4 | 50 |
| LBY395 | 0.82 | 2.39E−02 | 2 | 13 | LBY395 | 0.85 | 1.46E−02 | 2 | 3 |
| LBY395 | 0.83 | 4.09E−02 | 6 | 50 | LBY395 | 0.82 | 2.39E−02 | 2 | 2 |
| LBY395 | 0.80 | 5.56E−03 | 4 | 28 | LBY395 | 0.83 | 2.21E−02 | 5 | 46 |
| LBY395 | 0.81 | 4.81E−03 | 4 | 36 | LBY395 | 0.80 | 5.95E−03 | 4 | 29 |
| LBY395 | 0.95 | 9.16E−04 | 1 | 35 | LBY395 | 0.81 | 4.86E−03 | 4 | 34 |
| LBY395 | 0.79 | 3.51E−02 | 1 | 47 | LBY395 | 0.88 | 2.01E−02 | 3 | 50 |
| LBY396 | 0.88 | 9.85E−03 | 2 | 47 | LBY395 | 0.71 | 7.12E−02 | 1 | 43 |
| LBY396 | 0.89 | 1.78E−02 | 5 | 50 | LBY396 | 0.74 | 5.75E−02 | 2 | 5 |
| LBY396 | 0.82 | 1.98E−03 | 5 | 16 | LBY396 | 0.84 | 1.93E−02 | 2 | 34 |
| LBY396 | 0.72 | 1.88E−02 | 6 | 42 | LBY396 | 0.95 | 1.04E−03 | 5 | 46 |
| LBY396 | 0.75 | 1.27E−02 | 4 | 29 | LBY396 | 0.72 | 1.87E−02 | 6 | 10 |
| LBY396 | 0.88 | 6.86E−04 | 4 | 10 | LBY396 | 0.82 | 3.49E−03 | 6 | 28 |
| LBY396 | 0.73 | 1.76E−02 | 4 | 5 | LBY396 | 0.81 | 4.47E−03 | 4 | 33 |
| LBY396 | 0.73 | 1.59E−02 | 4 | 8 | LBY396 | 0.78 | 8.08E−03 | 4 | 9 |
| LBY396 | 0.83 | 3.25E−03 | 4 | 42 | LBY396 | 0.73 | 1.58E−02 | 4 | 11 |
| LBY396 | 0.88 | 8.81E−04 | 4 | 28 | LBY396 | 0.86 | 1.46E−03 | 4 | 12 |
| LBY396 | 0.76 | 1.02E−02 | 4 | 34 | LBY396 | 0.87 | 1.23E−03 | 4 | 7 |
| LBY396 | 0.72 | 1.82E−02 | 4 | 36 | LBY396 | 0.75 | 1.27E−02 | 4 | 32 |
| LBY396 | 0.83 | 1.67E−03 | 3 | 42 | LBY396 | 0.90 | 4.20E−04 | 4 | 41 |
| LBY396 | 0.75 | 8.22E−03 | 3 | 28 | LBY396 | 0.82 | 2.23E−03 | 3 | 29 |
| LBY396 | 0.88 | 3.73E−04 | 3 | 41 | LBY396 | 0.77 | 5.18E−03 | 3 | 47 |
| LBY396 | 0.72 | 7.02E−02 | 1 | 29 | LBY396 | 0.81 | 2.50E−03 | 3 | 34 |
| LBY396 | 0.86 | 1.22E−02 | 1 | 5 | LBY396 | 0.83 | 1.47E−03 | 3 | 36 |
| LBY396 | 0.79 | 3.30E−02 | 1 | 32 | LBY396 | 0.70 | 7.74E−02 | 1 | 33 |
| LBY396 | 0.73 | 6.17E−02 | 1 | 36 | LBY396 | 0.84 | 1.82E−02 | 1 | 47 |
| LBY446 | 0.73 | 1.65E−02 | 6 | 4 | LBY396 | 0.87 | 1.16E−02 | 1 | 34 |
| LBY446 | 0.71 | 2.22E−02 | 6 | 47 | LBY446 | 0.92 | 3.11E−03 | 2 | 47 |
| LBY446 | 0.77 | 7.37E−02 | 4 | 50 | LBY446 | 0.76 | 1.04E−02 | 6 | 5 |
| LBY446 | 0.73 | 1.64E−02 | 4 | 39 | LBY446 | 0.77 | 9.71E−03 | 4 | 26 |
| LBY446 | 0.81 | 4.32E−03 | 3 | 17 | LBY446 | 0.91 | 4.50E−03 | 4 | 46 |
| LBY446 | 0.73 | 6.37E−02 | 1 | 47 | LBY446 | 0.82 | 2.53E−02 | 4 | 48 |
| LBY447 | 0.77 | 9.40E−03 | 6 | 3 | LBY446 | 0.83 | 2.22E−02 | 1 | 35 |
| LBY447 | 0.72 | 1.83E−02 | 6 | 1 | LBY447 | 0.70 | 7.90E−02 | 2 | 25 |
| LBY447 | 0.80 | 5.56E−03 | 6 | 13 | LBY447 | 0.78 | 7.47E−03 | 6 | 6 |
| LBY447 | 0.72 | 1.93E−02 | 4 | 5 | LBY447 | 0.80 | 5.56E−03 | 6 | 2 |
| LBY447 | 0.78 | 4.78E−03 | 3 | 1 | LBY447 | 0.71 | 2.25E−02 | 4 | 9 |
| LBY447 | 0.74 | 9.49E−03 | 3 | 13 | LBY447 | 0.82 | 1.88E−03 | 3 | 54 |
| LBY447 | 0.85 | 1.45E−02 | 1 | 51 | LBY447 | 0.74 | 9.49E−03 | 3 | 2 |
| LBY447 | 0.72 | 6.58E−02 | 1 | 23 | LBY447 | 0.72 | 6.72E−02 | 1 | 25 |
| LBY447 | 0.71 | 7.32E−02 | 1 | 40 | LBY447 | 0.70 | 7.89E−02 | 1 | 20 |
| LBY449 | 0.76 | 4.63E−02 | 2 | 47 | LBY447 | 0.81 | 2.79E−02 | 1 | 21 |
| LBY449 | 0.91 | 1.29E−02 | 5 | 50 | LBY449 | 0.73 | 6.04E−02 | 2 | 29 |
| LBY449 | 0.70 | 1.20E−01 | 5 | 24 | LBY449 | 0.76 | 4.85E−02 | 2 | 34 |
| LBY449 | 0.81 | 2.42E−03 | 5 | 21 | LBY449 | 0.92 | 3.39E−03 | 5 | 46 |
| LBY449 | 0.73 | 1.55E−02 | 4 | 4 | LBY449 | 0.81 | 2.34E−03 | 5 | 20 |
| LBY449 | 0.75 | 1.29E−02 | 4 | 34 | LBY449 | 0.83 | 2.18E−02 | 4 | 46 |
| LBY449 | 0.86 | 1.21E−02 | 1 | 5 | LBY449 | 0.83 | 2.72E−03 | 4 | 9 |
| LBY449 | 0.86 | 1.34E−02 | 1 | 34 | LBY449 | 0.87 | 1.06E−02 | 1 | 4 |
| LBY450 | 0.96 | 5.37E−04 | 2 | 29 | LBY449 | 0.70 | 7.96E−02 | 1 | 43 |
| LBY450 | 0.77 | 4.50E−02 | 2 | 5 | LBY449 | 0.71 | 7.12E−02 | 1 | 36 |
| LBY450 | 0.70 | 7.98E−02 | 2 | 42 | LBY450 | 0.71 | 7.25E−02 | 2 | 33 |
| LBY450 | 0.75 | 5.15E−02 | 2 | 32 | LBY450 | 0.71 | 7.22E−02 | 2 | 35 |
| LBY450 | 0.72 | 6.83E−02 | 2 | 41 | LBY450 | 0.82 | 2.35E−02 | 2 | 28 |
| LBY450 | 0.71 | 1.40E−02 | 5 | 53 | LBY450 | 0.96 | 7.12E−04 | 2 | 34 |
| LBY450 | 0.77 | 7.09E−02 | 4 | 24 | LBY450 | 0.89 | 6.97E−03 | 2 | 36 |
| LBY450 | 0.83 | 2.00E−02 | 1 | 39 | LBY450 | 0.80 | 5.65E−02 | 4 | 50 |
| LGA15 | 0.73 | 6.04E−02 | 2 | 25 | LBY450 | 0.71 | 7.65E−02 | 1 | 38 |
| LGA15 | 0.81 | 2.60E−02 | 5 | 48 | LBY450 | 0.82 | 2.35E−02 | 1 | 40 |
| LGA15 | 0.87 | 1.05E−02 | 1 | 51 | LGA15 | 0.70 | 7.80E−02 | 2 | 23 |
| LGA23 | 0.92 | 3.20E−03 | 2 | 3 | LGA15 | 0.70 | 2.36E−02 | 4 | 5 |

TABLE 58-continued

Correlation between the expression level of selected genes of some embodiments of the invention in various tissues and the phenotypic performance under normal conditions across Sorghum accessions

| Gene Name | R | P value | Exp. set | Corr. ID | Gene Name | R | P value | Exp. set | Corr. ID |
|---|---|---|---|---|---|---|---|---|---|
| LGA23 | 0.72 | 1.17E−02 | 5 | 51 | LGA23 | 0.76 | 4.75E−02 | 2 | 15 |
| LGA23 | 0.85 | 1.56E−02 | 5 | 46 | LGA23 | 0.71 | 7.28E−02 | 2 | 14 |
| LGA23 | 0.82 | 3.78E−03 | 4 | 9 | LGA23 | 0.83 | 4.04E−02 | 5 | 50 |
| LGA23 | 0.83 | 2.90E−03 | 4 | 12 | LGA23 | 0.82 | 3.31E−03 | 4 | 10 |
| LGA23 | 0.72 | 1.16E−02 | 3 | 26 | LGA23 | 0.72 | 1.85E−02 | 4 | 11 |
| LGA23 | 0.97 | 3.48E−04 | 1 | 49 | LGA23 | 0.81 | 4.50E−03 | 4 | 7 |
| LGA23 | 0.73 | 6.26E−02 | 1 | 40 | LGA23 | 0.85 | 1.65E−02 | 1 | 26 |
| MGP32 | 0.88 | 9.73E−03 | 2 | 29 | LGA23 | 0.79 | 3.32E−02 | 1 | 35 |
| MGP32 | 0.85 | 1.43E−02 | 2 | 45 | MGP59 | 0.71 | 7.63E−02 | 1 | 37 |
| MGP32 | 0.77 | 4.10E−02 | 2 | 42 | MGP32 | 0.72 | 7.08E−02 | 2 | 33 |
| MGP32 | 0.72 | 6.91E−02 | 2 | 32 | MGP32 | 0.76 | 4.91E−02 | 2 | 31 |
| MGP32 | 0.72 | 6.61E−02 | 2 | 41 | MGP32 | 0.84 | 1.84E−02 | 2 | 28 |
| MGP32 | 0.91 | 1.11E−02 | 5 | 50 | MGP32 | 0.86 | 1.36E−02 | 2 | 34 |
| MGP32 | 0.70 | 1.63E−02 | 5 | 40 | MGP32 | 0.82 | 2.25E−02 | 2 | 36 |
| MGP32 | 0.79 | 6.05E−03 | 6 | 23 | MGP32 | 0.73 | 1.00E−02 | 5 | 49 |
| MGP32 | 0.74 | 1.34E−02 | 4 | 33 | MGP32 | 0.73 | 2.64E−02 | 6 | 17 |
| MGP32 | 0.74 | 1.47E−02 | 4 | 9 | MGP32 | 0.88 | 6.93E−04 | 6 | 22 |
| MGP32 | 0.73 | 1.60E−02 | 4 | 42 | MGP32 | 0.73 | 9.76E−02 | 4 | 24 |
| MGP32 | 0.82 | 3.75E−03 | 4 | 41 | MGP32 | 0.82 | 3.37E−03 | 4 | 5 |
| MGP32 | 0.87 | 5.67E−04 | 3 | 9 | MGP32 | 0.77 | 9.50E−03 | 4 | 32 |
| MGP32 | 0.77 | 5.68E−03 | 3 | 28 | MGP32 | 0.71 | 1.51E−02 | 3 | 33 |
| MGP32 | 0.71 | 7.23E−02 | 1 | 31 | MGP32 | 0.86 | 7.33E−04 | 3 | 12 |
| MGP32 | 0.91 | 4.92E−03 | 1 | 43 | MGP32 | 0.73 | 6.34E−02 | 1 | 45 |
| MGP32 | 0.75 | 5.45E−02 | 1 | 34 | MGP32 | 0.72 | 6.91E−02 | 1 | 35 |
| MGP36 | 0.72 | 6.72E−02 | 2 | 5 | MGP32 | 0.83 | 1.95E−02 | 1 | 47 |
| MGP36 | 0.84 | 1.80E−02 | 2 | 47 | MGP32 | 0.77 | 4.34E−02 | 1 | 36 |
| MGP36 | 0.76 | 1.01E−02 | 4 | 35 | MGP36 | 0.74 | 9.41E−02 | 2 | 17 |
| MGP36 | 0.75 | 5.38E−02 | 1 | 4 | MGP36 | 0.77 | 9.65E−03 | 6 | 47 |
| MGP36 | 0.71 | 7.21E−02 | 1 | 5 | MGP36 | 0.73 | 1.02E−02 | 3 | 53 |
| MGP59 | 0.77 | 7.25E−02 | 4 | 24 | MGP36 | 0.75 | 5.35E−02 | 1 | 14 |
| MGP59 | 0.86 | 1.37E−02 | 1 | 16 | MGP36 | 0.70 | 7.98E−02 | 1 | 37 |
| MGP59 | 0.71 | 7.13E−02 | 1 | 6 | | | | | |

Table 58. Correlations (R) between the genes expression levels in various tissues (Table 50) and the phenotypic performance according to correlated parameters specified in Table 52.
"Corr. ID"—correlation vector ID.
"Exp. Set"—Expression set.
"R" = Pearson correlation coefficient;
"P" = p value.

TABLE 59

Correlation between the expression level of selected genes of some embodiments of the invention in various tissues and the phenotypic performance under drought across Sorghum accessions

| Gene Name | R | P value | Exp. set | Corr. ID | Gene Name | R | P value | Exp. set | Corr. ID |
|---|---|---|---|---|---|---|---|---|---|
| LBY257 | 0.70 | 5.21E−02 | 2 | 52 | LBY258 | 0.80 | 1.82E−02 | 1 | 13 |
| LBY258 | 0.86 | 6.39E−03 | 1 | 5 | LBY258 | 0.86 | 5.63E−03 | 1 | 34 |
| LBY258 | 0.74 | 3.42E−02 | 1 | 4 | LBY258 | 0.77 | 2.70E−02 | 1 | 3 |
| LBY258 | 0.75 | 3.15E−02 | 1 | 35 | LBY258 | 0.76 | 2.82E−02 | 1 | 50 |
| LBY258 | 0.80 | 1.82E−02 | 1 | 1 | LBY258 | 0.88 | 3.93E−03 | 1 | 2 |
| LBY258 | 0.81 | 8.79E−03 | 6 | 38 | LBY258 | 0.84 | 1.93E−02 | 6 | 46 |
| LBY258 | 0.84 | 1.85E−02 | 5 | 46 | LBY258 | 0.78 | 5.03E−03 | 4 | 49 |
| LBY258 | 0.83 | 2.23E−02 | 4 | 48 | LBY258 | 0.80 | 5.46E−02 | 4 | 24 |
| LBY258 | 0.88 | 2.10E−02 | 4 | 44 | LBY258 | 0.80 | 3.02E−02 | 4 | 46 |
| LBY258 | 0.85 | 3.04E−02 | 3 | 24 | LBY258 | 0.84 | 1.22E−03 | 3 | 38 |
| LBY258 | 0.79 | 1.94E−02 | 2 | 5 | LBY258 | 0.86 | 6.27E−03 | 2 | 34 |
| LBY258 | 0.78 | 2.29E−02 | 2 | 41 | LBY258 | 0.78 | 2.34E−02 | 2 | 35 |
| LBY258 | 0.82 | 1.26E−02 | 2 | 38 | LBY258 | 0.70 | 5.15E−02 | 2 | 42 |
| LBY259 | 0.93 | 6.89E−04 | 1 | 39 | LBY259 | 0.78 | 2.17E−02 | 1 | 20 |
| LBY259 | 0.74 | 5.61E−02 | 1 | 46 | LBY259 | 0.72 | 1.26E−02 | 5 | 11 |
| LBY259 | 0.71 | 1.45E−02 | 5 | 8 | LBY259 | 0.80 | 1.65E−02 | 2 | 19 |
| LBY260 | 0.85 | 7.50E−03 | 1 | 5 | LBY260 | 0.73 | 4.01E−02 | 1 | 3 |
| LBY260 | 0.88 | 3.59E−03 | 1 | 41 | LBY260 | 0.89 | 2.72E−03 | 1 | 35 |
| LBY260 | 0.75 | 3.11E−02 | 1 | 29 | LBY260 | 0.88 | 3.50E−03 | 1 | 42 |
| LBY260 | 0.77 | 2.54E−02 | 1 | 32 | LBY278 | 0.73 | 3.89E−02 | 1 | 13 |
| LBY278 | 0.77 | 2.66E−02 | 1 | 14 | LBY278 | 0.80 | 1.64E−02 | 1 | 39 |
| LBY278 | 0.79 | 1.99E−02 | 1 | 49 | LBY278 | 0.77 | 4.16E−02 | 1 | 48 |
| LBY278 | 0.96 | 7.40E−04 | 1 | 16 | LBY278 | 0.73 | 3.89E−02 | 1 | 1 |

TABLE 59-continued

Correlation between the expression level of selected genes of some embodiments of the invention in various tissues and the phenotypic performance under drought across *Sorghum* accessions

| Gene Name | R | P value | Exp. set | Corr. ID | Gene Name | R | P value | Exp. set | Corr. ID |
|---|---|---|---|---|---|---|---|---|---|
| LBY278 | 0.93 | 6.78E−03 | 1 | 44 | LBY278 | 0.72 | 2.92E−02 | 6 | 34 |
| LBY278 | 0.78 | 1.25E−02 | 6 | 31 | LBY278 | 0.71 | 3.25E−02 | 6 | 45 |
| LBY278 | 0.81 | 8.12E−03 | 6 | 47 | LBY278 | 0.74 | 8.85E−03 | 5 | 5 |
| LBY278 | 0.77 | 5.18E−03 | 5 | 9 | LBY278 | 0.83 | 1.77E−03 | 5 | 3 |
| LBY278 | 0.84 | 1.37E−03 | 5 | 12 | LBY278 | 0.83 | 1.66E−03 | 4 | 38 |
| LBY278 | 0.73 | 9.99E−03 | 3 | 5 | LBY278 | 0.81 | 2.45E−03 | 3 | 34 |
| LBY278 | 0.71 | 1.47E−02 | 3 | 31 | LBY278 | 0.74 | 9.08E−03 | 3 | 3 |
| LBY278 | 0.75 | 3.33E−02 | 2 | 19 | LBY279 | 0.71 | 3.33E−02 | 6 | 49 |
| LBY279 | 0.80 | 2.96E−02 | 6 | 48 | LBY279 | 0.75 | 8.92E−02 | 6 | 44 |
| LBY279 | 0.76 | 1.68E−02 | 6 | 18 | LBY279 | 0.77 | 5.65E−03 | 5 | 26 |
| LBY279 | 0.72 | 1.06E−01 | 5 | 44 | LBY279 | 0.75 | 8.02E−03 | 4 | 18 |
| LBY279 | 0.77 | 2.40E−02 | 2 | 6 | LBY279 | 0.72 | 4.53E−02 | 2 | 13 |
| LBY279 | 0.83 | 1.08E−02 | 2 | 28 | LBY279 | 0.72 | 4.53E−02 | 2 | 1 |
| LBY280 | 0.90 | 2.18E−03 | 1 | 5 | LBY280 | 0.82 | 1.36E−02 | 1 | 34 |
| LBY280 | 0.70 | 5.14E−02 | 1 | 31 | LBY280 | 0.80 | 1.64E−02 | 1 | 45 |
| LBY280 | 0.73 | 4.03E−02 | 1 | 3 | LBY280 | 0.91 | 1.49E−03 | 1 | 41 |
| LBY280 | 0.91 | 1.68E−03 | 1 | 35 | LBY280 | 0.87 | 5.06E−03 | 1 | 29 |
| LBY280 | 0.90 | 2.42E−03 | 1 | 42 | LBY280 | 0.74 | 2.16E−02 | 6 | 45 |
| LBY280 | 0.76 | 1.83E−02 | 6 | 41 | LBY280 | 0.75 | 2.12E−02 | 6 | 36 |
| LBY280 | 0.77 | 1.49E−02 | 6 | 42 | LBY280 | 0.75 | 7.72E−03 | 4 | 45 |
| LBY280 | 0.86 | 7.73E−04 | 4 | 35 | LBY280 | 0.75 | 8.40E−03 | 4 | 29 |
| LBY280 | 0.80 | 2.95E−03 | 4 | 36 | LBY280 | 0.91 | 3.04E−04 | 3 | 16 |
| LBY280 | 0.80 | 2.84E−03 | 3 | 36 | LBY280 | 0.84 | 3.54E−03 | 3 | 44 |
| LBY280 | 0.86 | 5.88E−03 | 2 | 33 | LBY280 | 0.72 | 4.41E−02 | 2 | 35 |
| LBY280 | 0.87 | 5.15E−03 | 2 | 29 | LBY280 | 0.88 | 3.90E−03 | 2 | 32 |
| LBY281 | 0.74 | 3.47E−02 | 1 | 5 | LBY281 | 0.78 | 2.19E−02 | 1 | 41 |
| LBY281 | 0.83 | 1.09E−02 | 1 | 35 | LBY281 | 0.75 | 3.31E−02 | 1 | 42 |
| LBY281 | 0.95 | 8.79E−05 | 6 | 22 | LBY281 | 0.83 | 1.42E−03 | 3 | 9 |
| LBY281 | 0.79 | 3.85E−03 | 3 | 12 | LBY281 | 0.83 | 1.09E−02 | 2 | 5 |
| LBY281 | 0.77 | 2.42E−02 | 2 | 3 | LBY305 | 0.71 | 5.01E−02 | 1 | 31 |
| LBY305 | 0.76 | 3.01E−02 | 1 | 45 | LBY305 | 0.74 | 3.55E−02 | 1 | 51 |
| LBY305 | 0.85 | 7.52E−03 | 1 | 35 | LBY305 | 0.80 | 1.61E−02 | 1 | 29 |
| LBY305 | 0.82 | 1.33E−02 | 1 | 36 | LBY305 | 0.75 | 8.47E−03 | 5 | 18 |
| LBY305 | 0.74 | 3.54E−02 | 2 | 32 | LBY306 | 0.74 | 3.42E−02 | 1 | 34 |
| LBY306 | 0.81 | 5.09E−02 | 1 | 17 | LBY306 | 0.71 | 4.88E−02 | 1 | 51 |
| LBY306 | 0.78 | 2.20E−02 | 1 | 35 | LBY306 | 0.78 | 2.13E−02 | 1 | 53 |
| LBY306 | 0.90 | 8.29E−04 | 6 | 22 | LBY306 | 0.73 | 1.14E−02 | 5 | 21 |
| LBY306 | 0.86 | 2.61E−03 | 5 | 17 | LBY306 | 0.70 | 1.63E−02 | 3 | 52 |
| LBY306 | 0.77 | 5.59E−03 | 3 | 51 | LBY306 | 0.73 | 1.01E−02 | 3 | 23 |
| LBY307 | 0.84 | 5.05E−03 | 6 | 43 | LBY307 | 0.74 | 9.20E−03 | 5 | 11 |
| LBY307 | 0.72 | 1.20E−02 | 5 | 8 | LBY307 | 0.72 | 1.20E−02 | 3 | 31 |
| LBY307 | 0.78 | 6.95E−02 | 3 | 44 | LBY307 | 0.84 | 9.52E−03 | 2 | 51 |
| LBY308 | 0.72 | 4.53E−02 | 1 | 43 | LBY308 | 0.92 | 9.96E−03 | 1 | 17 |
| LBY308 | 0.77 | 2.62E−02 | 1 | 54 | LBY308 | 0.72 | 4.50E−02 | 1 | 53 |
| LBY308 | 0.70 | 1.63E−02 | 5 | 11 | LBY308 | 0.77 | 5.09E−03 | 4 | 13 |
| LBY308 | 0.72 | 1.28E−02 | 4 | 14 | LBY308 | 0.72 | 1.18E−02 | 4 | 49 |
| LBY308 | 0.85 | 1.59E−02 | 4 | 48 | LBY308 | 0.77 | 5.09E−03 | 4 | 1 |
| LBY308 | 0.74 | 8.76E−03 | 4 | 2 | LBY308 | 0.92 | 8.88E−03 | 4 | 44 |
| LBY308 | 0.72 | 1.20E−02 | 3 | 29 | LBY308 | 0.75 | 3.14E−02 | 2 | 25 |
| LBY308 | 0.83 | 4.08E−02 | 2 | 17 | LBY308 | 0.91 | 1.79E−03 | 2 | 26 |
| LBY309 | 0.76 | 2.86E−02 | 1 | 43 | LBY309 | 0.70 | 5.09E−02 | 1 | 36 |
| LBY309 | 0.75 | 2.12E−02 | 6 | 31 | LBY309 | 0.77 | 4.33E−02 | 4 | 48 |
| LBY309 | 0.79 | 3.83E−03 | 4 | 2 | LBY309 | 0.85 | 1.05E−03 | 4 | 18 |
| LBY309 | 0.72 | 1.22E−02 | 3 | 49 | LBY309 | 0.87 | 1.05E−02 | 3 | 48 |
| LBY309 | 0.71 | 1.36E−02 | 3 | 2 | LBY309 | 0.79 | 6.01E−02 | 3 | 44 |
| LBY338 | 0.79 | 1.99E−02 | 1 | 41 | LBY338 | 0.77 | 2.67E−02 | 1 | 35 |
| LBY338 | 0.71 | 4.99E−02 | 1 | 29 | LBY338 | 0.77 | 2.66E−02 | 1 | 42 |
| LBY338 | 0.79 | 1.16E−02 | 6 | 11 | LBY338 | 0.80 | 9.51E−03 | 6 | 10 |
| LBY338 | 0.73 | 1.01E−01 | 6 | 24 | LBY338 | 0.78 | 1.27E−02 | 6 | 8 |
| LBY338 | 0.74 | 2.29E−02 | 6 | 7 | LBY338 | 0.78 | 4.62E−02 | 5 | 40 |
| LBY338 | 0.77 | 5.51E−03 | 4 | 43 | LBY338 | 0.80 | 3.02E−03 | 4 | 47 |
| LBY338 | 0.78 | 4.47E−03 | 4 | 53 | LBY338 | 0.83 | 1.51E−03 | 3 | 34 |
| LBY338 | 0.75 | 8.43E−03 | 3 | 35 | LBY338 | 0.82 | 1.24E−02 | 2 | 9 |
| LBY338 | 0.77 | 2.60E−02 | 2 | 12 | LBY339 | 0.77 | 2.41E−02 | 1 | 31 |
| LBY339 | 0.80 | 1.70E−02 | 1 | 45 | LBY339 | 0.76 | 2.81E−02 | 1 | 51 |
| LBY339 | 0.85 | 6.87E−03 | 1 | 35 | LBY339 | 0.75 | 3.33E−02 | 1 | 29 |
| LBY339 | 0.85 | 7.16E−03 | 1 | 36 | LBY339 | 0.82 | 6.79E−03 | 6 | 40 |
| LBY339 | 0.73 | 2.48E−02 | 6 | 47 | LBY339 | 0.83 | 1.48E−03 | 4 | 34 |
| LBY339 | 0.89 | 2.14E−04 | 4 | 45 | LBY339 | 0.88 | 2.99E−04 | 4 | 35 |
| LBY339 | 0.80 | 2.94E−03 | 4 | 36 | LBY339 | 0.70 | 1.56E−02 | 3 | 43 |
| LBY339 | 0.76 | 6.78E−03 | 3 | 31 | LBY339 | 0.75 | 8.10E−03 | 3 | 45 |
| LBY339 | 0.76 | 1.03E−02 | 3 | 16 | LBY339 | 0.92 | 1.15E−03 | 2 | 34 |
| LBY339 | 0.72 | 4.53E−02 | 2 | 45 | LBY339 | 0.86 | 5.62E−03 | 2 | 35 |

TABLE 59-continued

Correlation between the expression level of selected genes of some
embodiments of the invention in various tissues and the phenotypic
performance under drought across *Sorghum* accessions

| Gene Name | R | P value | Exp. set | Corr. ID | Gene Name | R | P value | Exp. set | Corr. ID |
|---|---|---|---|---|---|---|---|---|---|
| LBY340 | 0.71 | 4.96E−02 | 1 | 51 | LBY340 | 0.71 | 3.13E−02 | 6 | 5 |
| LBY340 | 0.84 | 4.37E−03 | 6 | 31 | LBY340 | 0.76 | 1.76E−02 | 6 | 45 |
| LBY340 | 0.82 | 7.13E−03 | 6 | 47 | LBY340 | 0.75 | 7.31E−03 | 4 | 34 |
| LBY340 | 0.76 | 7.04E−03 | 4 | 31 | LBY340 | 0.73 | 1.07E−02 | 4 | 45 |
| LBY340 | 0.86 | 6.05E−04 | 4 | 41 | LBY340 | 0.81 | 2.61E−03 | 4 | 35 |
| LBY340 | 0.70 | 1.55E−02 | 4 | 36 | LBY340 | 0.83 | 1.42E−03 | 4 | 42 |
| LBY340 | 0.79 | 4.18E−03 | 3 | 31 | LBY340 | 0.81 | 2.32E−03 | 3 | 45 |
| LBY340 | 0.72 | 1.21E−02 | 3 | 47 | LBY340 | 0.92 | 1.10E−03 | 2 | 51 |
| LBY341 | 0.79 | 1.98E−02 | 1 | 39 | LBY341 | 0.71 | 7.41E−02 | 1 | 48 |
| LBY341 | 0.70 | 7.91E−02 | 1 | 16 | LBY341 | 0.76 | 2.86E−02 | 1 | 23 |
| LBY341 | 0.71 | 4.90E−02 | 1 | 37 | LBY341 | 0.79 | 6.32E−02 | 1 | 44 |
| LBY341 | 0.76 | 4.94E−02 | 1 | 46 | LBY341 | 0.72 | 2.76E−02 | 6 | 5 |
| LBY341 | 0.76 | 1.69E−02 | 6 | 43 | LBY341 | 0.77 | 1.58E−02 | 6 | 31 |
| LBY341 | 0.79 | 1.12E−02 | 6 | 47 | LBY341 | 0.78 | 1.30E−02 | 6 | 53 |
| LBY341 | 0.75 | 7.61E−03 | 5 | 21 | LBY341 | 0.80 | 8.88E−03 | 5 | 17 |
| LBY341 | 0.79 | 6.15E−02 | 5 | 24 | LBY341 | 0.77 | 5.75E−03 | 3 | 5 |
| LBY341 | 0.75 | 8.40E−03 | 3 | 34 | LBY341 | 0.70 | 1.62E−02 | 3 | 45 |
| LBY341 | 0.73 | 1.15E−02 | 3 | 40 | LBY341 | 0.77 | 9.91E−03 | 3 | 16 |
| LBY341 | 0.73 | 1.10E−02 | 3 | 29 | LBY341 | 0.77 | 2.58E−02 | 2 | 28 |
| LBY341 | 0.95 | 1.31E−03 | 2 | 16 | LBY341 | 0.71 | 5.06E−02 | 2 | 29 |
| LBY341 | 0.74 | 3.74E−02 | 2 | 36 | LBY342 | 0.71 | 4.99E−02 | 1 | 13 |
| LBY342 | 0.72 | 4.45E−02 | 1 | 25 | LBY342 | 0.89 | 3.31E−03 | 1 | 49 |
| LBY342 | 0.90 | 5.78E−03 | 1 | 48 | LBY342 | 0.81 | 1.52E−02 | 1 | 20 |
| LBY342 | 0.82 | 1.19E−02 | 1 | 50 | LBY342 | 0.71 | 4.99E−02 | 1 | 1 |
| LBY342 | 0.89 | 1.60E−02 | 1 | 44 | LBY342 | 0.71 | 1.54E−02 | 5 | 43 |
| LBY342 | 0.72 | 1.17E−02 | 5 | 53 | LBY342 | 0.75 | 7.42E−03 | 3 | 5 |
| LBY342 | 0.79 | 3.68E−03 | 3 | 9 | LBY342 | 0.81 | 2.35E−03 | 3 | 3 |
| LBY342 | 0.86 | 7.94E−04 | 3 | 12 | LBY342 | 0.76 | 3.03E−02 | 2 | 14 |
| LBY342 | 0.75 | 3.12E−02 | 2 | 49 | LBY342 | 0.72 | 4.24E−02 | 2 | 50 |
| LBY343 | 0.85 | 7.79E−03 | 1 | 9 | LBY343 | 0.73 | 3.89E−02 | 1 | 12 |
| LBY343 | 0.72 | 2.90E−02 | 6 | 5 | LBY343 | 0.72 | 3.02E−02 | 6 | 34 |
| LBY343 | 0.83 | 5.45E−03 | 6 | 43 | LBY343 | 0.70 | 3.46E−02 | 6 | 31 |
| LBY343 | 0.74 | 2.33E−02 | 6 | 45 | LBY343 | 0.74 | 3.60E−02 | 6 | 16 |
| LBY343 | 0.71 | 3.38E−02 | 6 | 47 | LBY343 | 0.75 | 1.93E−02 | 6 | 29 |
| LBY343 | 0.72 | 2.72E−02 | 6 | 53 | LBY343 | 0.84 | 3.72E−02 | 5 | 24 |
| LBY343 | 0.81 | 2.39E−03 | 3 | 5 | LBY343 | 0.83 | 1.60E−03 | 3 | 34 |
| LBY343 | 0.76 | 6.27E−03 | 3 | 35 | LBY343 | 0.75 | 8.43E−03 | 3 | 29 |
| LBY343 | 0.80 | 1.76E−02 | 2 | 28 | LBY343 | 0.92 | 3.24E−03 | 2 | 16 |
| LBY344 | 0.74 | 3.69E−02 | 1 | 43 | LBY344 | 0.86 | 5.75E−03 | 1 | 31 |
| LBY344 | 0.89 | 3.29E−03 | 1 | 45 | LBY344 | 0.75 | 3.27E−02 | 1 | 47 |
| LBY344 | 0.79 | 2.02E−02 | 1 | 35 | LBY344 | 0.75 | 3.30E−02 | 1 | 29 |
| LBY344 | 0.91 | 1.68E−03 | 1 | 36 | LBY344 | 0.73 | 2.46E−02 | 6 | 49 |
| LBY344 | 0.82 | 4.68E−02 | 6 | 44 | LBY344 | 0.76 | 1.82E−02 | 6 | 18 |
| LBY344 | 0.87 | 5.08E−04 | 4 | 18 | LBY346 | 0.74 | 3.62E−02 | 1 | 51 |
| LBY346 | 0.75 | 2.02E−02 | 6 | 5 | LBY346 | 0.72 | 2.84E−02 | 6 | 43 |
| LBY346 | 0.73 | 2.41E−02 | 6 | 35 | LBY346 | 0.84 | 4.20E−03 | 6 | 29 |
| LBY346 | 0.71 | 3.12E−02 | 6 | 36 | LBY348 | 0.80 | 1.04E−02 | 6 | 25 |
| LBY348 | 0.71 | 4.63E−02 | 6 | 17 | LBY348 | 0.71 | 3.12E−02 | 6 | 51 |
| LBY348 | 0.91 | 9.75E−05 | 5 | 31 | LBY348 | 0.76 | 6.64E−03 | 5 | 45 |
| LBY348 | 0.70 | 1.60E−02 | 4 | 34 | LBY348 | 0.91 | 9.78E−05 | 4 | 31 |
| LBY348 | 0.76 | 6.52E−03 | 4 | 45 | LBY348 | 0.79 | 3.99E−03 | 3 | 43 |
| LBY348 | 0.78 | 4.30E−03 | 3 | 45 | LBY348 | 0.88 | 7.56E−04 | 3 | 16 |
| LBY348 | 0.83 | 1.67E−03 | 3 | 47 | LBY348 | 0.76 | 7.05E−03 | 3 | 29 |
| LBY348 | 0.74 | 9.59E−03 | 3 | 53 | LBY348 | 0.75 | 8.65E−02 | 2 | 17 |
| LBY348 | 0.70 | 5.14E−02 | 2 | 51 | LBY349 | 0.71 | 4.90E−02 | 1 | 25 |
| LBY349 | 0.81 | 1.41E−02 | 1 | 49 | LBY349 | 0.91 | 4.10E−03 | 1 | 48 |
| LBY349 | 0.74 | 3.74E−02 | 1 | 20 | LBY349 | 0.76 | 2.82E−02 | 1 | 50 |
| LBY349 | 0.72 | 4.49E−02 | 1 | 23 | LBY349 | 0.74 | 9.21E−02 | 1 | 44 |
| LBY349 | 0.72 | 4.45E−02 | 6 | 17 | LBY349 | 0.80 | 1.82E−02 | 2 | 31 |
| LBY350 | 0.74 | 5.94E−02 | 6 | 46 | LBY350 | 0.71 | 1.47E−02 | 3 | 34 |
| LBY350 | 0.76 | 7.19E−03 | 3 | 40 | LBY350 | 0.76 | 6.58E−03 | 3 | 37 |
| LBY350 | 0.84 | 1.28E−03 | 3 | 38 | LBY350 | 0.72 | 1.10E−01 | 2 | 17 |
| LBY350 | 0.72 | 4.57E−02 | 2 | 45 | LBY350 | 0.84 | 8.98E−03 | 2 | 35 |
| LBY350 | 0.73 | 3.89E−02 | 2 | 36 | LBY352 | 0.75 | 3.24E−02 | 1 | 51 |
| LBY352 | 0.73 | 3.85E−02 | 1 | 36 | LBY352 | 0.74 | 2.26E−02 | 6 | 5 |
| LBY352 | 0.76 | 1.14E−02 | 5 | 16 | LBY352 | 0.71 | 1.37E−02 | 5 | 36 |
| LBY352 | 0.77 | 7.21E−02 | 5 | 44 | LBY352 | 0.72 | 4.40E−02 | 2 | 6 |
| LBY352 | 0.81 | 1.57E−02 | 2 | 13 | LBY352 | 0.78 | 2.34E−02 | 2 | 21 |
| LBY352 | 0.81 | 1.57E−02 | 2 | 1 | LBY353 | 0.79 | 4.06E−03 | 4 | 52 |
| LBY353 | 0.76 | 6.59E−03 | 4 | 51 | LBY353 | 0.80 | 2.98E−03 | 3 | 15 |
| LBY353 | 0.70 | 1.59E−02 | 3 | 25 | LBY353 | 0.81 | 2.34E−03 | 3 | 20 |
| LBY353 | 0.85 | 1.01E−03 | 3 | 52 | LBY353 | 0.76 | 6.76E−03 | 3 | 50 |
| LBY353 | 0.91 | 1.17E−04 | 3 | 23 | LBY353 | 0.95 | 1.31E−03 | 3 | 46 |

TABLE 59-continued

Correlation between the expression level of selected genes of some embodiments of the invention in various tissues and the phenotypic performance under drought across Sorghum accessions

| Gene Name | R | P value | Exp. set | Corr. ID | Gene Name | R | P value | Exp. set | Corr. ID |
|---|---|---|---|---|---|---|---|---|---|
| LBY354 | 0.81 | 1.45E−02 | 1 | 33 | LBY354 | 0.85 | 6.95E−03 | 1 | 41 |
| LBY354 | 0.85 | 6.86E−03 | 1 | 42 | LBY354 | 0.86 | 5.65E−03 | 1 | 32 |
| LBY354 | 0.89 | 1.50E−03 | 6 | 37 | LBY354 | 0.80 | 5.62E−02 | 5 | 44 |
| LBY354 | 0.71 | 4.92E−02 | 2 | 9 | LBY382 | 0.75 | 3.09E−02 | 1 | 15 |
| LBY382 | 0.87 | 5.28E−03 | 1 | 25 | LBY382 | 0.94 | 4.95E−04 | 1 | 39 |
| LBY382 | 0.71 | 4.74E−02 | 1 | 20 | LBY382 | 0.73 | 6.03E−02 | 1 | 46 |
| LBY382 | 0.82 | 2.01E−03 | 5 | 43 | LBY382 | 0.74 | 9.13E−03 | 5 | 31 |
| LBY382 | 0.80 | 3.42E−03 | 5 | 53 | LBY382 | 0.74 | 9.78E−03 | 4 | 22 |
| LBY382 | 0.73 | 1.03E−02 | 3 | 5 | LBY382 | 0.73 | 3.82E−02 | 2 | 25 |
| LBY382 | 0.79 | 2.09E−02 | 2 | 10 | LBY382 | 0.77 | 2.53E−02 | 2 | 9 |
| LBY382 | 0.82 | 4.54E−02 | 2 | 17 | LBY382 | 0.81 | 1.42E−02 | 2 | 12 |
| LBY382 | 0.78 | 2.22E−02 | 2 | 7 | LBY383 | 0.78 | 2.13E−02 | 1 | 21 |
| LBY383 | 0.86 | 2.89E−02 | 1 | 17 | LBY383 | 0.75 | 3.32E−02 | 1 | 28 |
| LBY383 | 0.77 | 2.44E−02 | 1 | 22 | LBY383 | 0.73 | 2.48E−02 | 6 | 22 |
| LBY383 | 0.83 | 2.09E−02 | 6 | 46 | LBY383 | 0.78 | 4.00E−02 | 5 | 46 |
| LBY383 | 0.71 | 1.45E−02 | 3 | 5 | LBY383 | 0.76 | 6.67E−03 | 3 | 3 |
| LBY383 | 0.87 | 4.64E−04 | 3 | 38 | LBY383 | 0.85 | 8.25E−03 | 2 | 31 |
| LBY383 | 0.77 | 2.40E−02 | 2 | 45 | LBY383 | 0.72 | 4.46E−02 | 2 | 47 |
| LBY384 | 0.79 | 1.88E−02 | 1 | 5 | LBY384 | 0.74 | 3.40E−02 | 1 | 34 |
| LBY384 | 0.74 | 3.42E−02 | 1 | 31 | LBY384 | 0.79 | 2.04E−02 | 1 | 45 |
| LBY384 | 0.74 | 3.48E−02 | 1 | 51 | LBY384 | 0.71 | 4.78E−02 | 1 | 3 |
| LBY384 | 0.91 | 1.94E−03 | 1 | 35 | LBY384 | 0.74 | 3.70E−02 | 1 | 29 |
| LBY384 | 0.72 | 4.30E−02 | 1 | 36 | LBY384 | 0.91 | 6.76E−04 | 5 | 17 |
| LBY384 | 0.84 | 1.07E−03 | 4 | 34 | LBY384 | 0.78 | 4.42E−03 | 4 | 31 |
| LBY384 | 0.81 | 2.48E−03 | 4 | 45 | LBY384 | 0.84 | 1.22E−03 | 4 | 35 |
| LBY384 | 0.70 | 1.62E−02 | 3 | 43 | LBY384 | 0.78 | 1.25E−02 | 3 | 17 |
| LBY384 | 0.70 | 5.09E−02 | 2 | 34 | LBY384 | 0.73 | 3.89E−02 | 2 | 40 |
| LBY384 | 0.84 | 8.73E−03 | 2 | 38 | LBY385 | 0.70 | 5.16E−02 | 1 | 13 |
| LBY385 | 0.79 | 1.95E−02 | 1 | 49 | LBY385 | 0.73 | 6.00E−02 | 1 | 48 |
| LBY385 | 0.84 | 1.71E−02 | 1 | 16 | LBY385 | 0.70 | 5.16E−02 | 1 | 1 |
| LBY385 | 0.93 | 7.18E−03 | 1 | 44 | LBY385 | 0.75 | 1.93E−02 | 6 | 26 |
| LBY385 | 0.72 | 2.79E−02 | 6 | 38 | LBY385 | 0.74 | 9.29E−03 | 5 | 31 |
| LBY385 | 0.71 | 1.34E−02 | 5 | 51 | LBY385 | 0.89 | 1.85E−02 | 4 | 24 |
| LBY385 | 0.75 | 8.00E−03 | 3 | 5 | LBY385 | 0.76 | 6.29E−03 | 3 | 34 |
| LBY385 | 0.72 | 1.30E−02 | 3 | 43 | LBY385 | 0.78 | 4.55E−03 | 3 | 45 |
| LBY385 | 0.71 | 2.03E−02 | 3 | 16 | LBY385 | 0.79 | 3.95E−03 | 3 | 47 |
| LBY385 | 0.72 | 1.18E−02 | 3 | 35 | LBY385 | 0.95 | 4.27E−03 | 3 | 24 |
| LBY385 | 0.72 | 1.16E−02 | 3 | 29 | LBY385 | 0.89 | 7.04E−03 | 2 | 16 |
| LBY387 | 0.77 | 4.14E−02 | 1 | 48 | LBY387 | 0.85 | 6.86E−03 | 1 | 49 |
| LBY387 | 0.77 | 2.54E−02 | 1 | 50 | LBY387 | 0.82 | 2.28E−02 | 1 | 16 |
| LBY387 | 0.77 | 5.59E−03 | 4 | 18 | LBY387 | 0.97 | 1.15E−03 | 1 | 44 |
| LBY387 | 0.84 | 8.44E−03 | 2 | 11 | LBY387 | 0.77 | 5.53E−03 | 3 | 51 |
| LBY387 | 0.76 | 2.87E−02 | 2 | 10 | LBY387 | 0.82 | 1.33E−02 | 2 | 14 |
| LBY387 | 0.75 | 3.28E−02 | 2 | 49 | LBY387 | 0.70 | 5.13E−02 | 2 | 39 |
| LBY387 | 0.86 | 6.01E−03 | 2 | 8 | LBY387 | 0.78 | 2.13E−02 | 2 | 50 |
| LBY387 | 0.79 | 1.91E−02 | 2 | 7 | LBY387 | 0.80 | 1.61E−02 | 2 | 2 |
| LBY388 | 0.82 | 1.28E−02 | 2 | 51 | LBY387 | 0.77 | 2.59E−02 | 2 | 18 |
| LBY389 | 0.88 | 3.87E−03 | 1 | 49 | LBY389 | 0.79 | 2.03E−02 | 1 | 21 |
| LBY389 | 0.92 | 1.13E−03 | 1 | 20 | LBY389 | 0.89 | 6.87E−03 | 1 | 48 |
| LBY389 | 0.76 | 8.01E−02 | 1 | 24 | LBY389 | 0.94 | 4.10E−04 | 1 | 50 |
| LBY389 | 0.77 | 1.62E−02 | 6 | 22 | LBY389 | 0.78 | 2.15E−02 | 1 | 23 |
| LBY389 | 0.76 | 6.19E−02 | 4 | 9 | LBY389 | 0.78 | 1.29E−02 | 5 | 17 |
| LBY392 | 0.88 | 3.75E−03 | 1 | 39 | LBY389 | 0.78 | 4.29E−03 | 4 | 12 |
| LBY392 | 0.87 | 1.19E−02 | 1 | 48 | LBY392 | 0.79 | 1.89E−02 | 1 | 49 |
| LBY392 | 0.80 | 9.36E−03 | 6 | 22 | LBY392 | 0.81 | 5.08E−02 | 1 | 44 |
| LBY392 | 0.81 | 2.49E−03 | 4 | 19 | LBY392 | 0.74 | 9.68E−03 | 4 | 28 |
| LBY393 | 0.79 | 3.92E−03 | 3 | 40 | LBY393 | 0.78 | 4.33E−03 | 5 | 5 |
| LBY393 | 0.77 | 2.43E−02 | 2 | 35 | LBY393 | 0.90 | 1.97E−04 | 3 | 38 |
| LBY393 | 0.91 | 1.98E−03 | 2 | 36 | LBY393 | 0.75 | 3.29E−02 | 2 | 29 |
| LBY395 | 0.86 | 6.03E−03 | 1 | 45 | LBY395 | 0.82 | 1.21E−02 | 1 | 31 |
| LBY395 | 0.73 | 3.89E−02 | 1 | 35 | LBY395 | 0.80 | 1.61E−02 | 1 | 47 |
| LBY395 | 0.92 | 1.32E−03 | 1 | 36 | LBY395 | 0.74 | 3.69E−02 | 1 | 29 |
| LBY395 | 0.71 | 1.13E−01 | 2 | 17 | LBY395 | 0.75 | 7.95E−03 | 3 | 31 |
| LBY396 | 0.91 | 1.93E−03 | 1 | 45 | LBY396 | 0.79 | 1.86E−02 | 1 | 31 |
| LBY396 | 0.74 | 3.56E−02 | 1 | 47 | LBY396 | 0.82 | 2.28E−02 | 1 | 16 |
| LBY396 | 0.76 | 3.01E−02 | 1 | 29 | LBY396 | 0.82 | 1.36E−02 | 1 | 35 |
| LBY396 | 0.81 | 7.47E−03 | 6 | 41 | LBY396 | 0.71 | 1.14E−01 | 1 | 44 |
| LBY396 | 0.79 | 1.22E−02 | 6 | 42 | LBY396 | 0.84 | 4.41E−03 | 6 | 22 |
| LBY396 | 0.74 | 8.91E−03 | 3 | 25 | LBY396 | 0.90 | 1.50E−02 | 4 | 44 |
| LBY396 | 0.71 | 1.46E−02 | 3 | 20 | LBY396 | 0.71 | 1.38E−02 | 3 | 9 |
| LBY396 | 0.74 | 9.23E−03 | 3 | 12 | LBY396 | 0.73 | 1.00E−02 | 3 | 52 |
| LBY396 | 0.80 | 1.61E−02 | 2 | 37 | LBY396 | 0.81 | 2.64E−03 | 3 | 23 |
| LBY446 | 0.71 | 1.44E−02 | 3 | 15 | LBY396 | 0.93 | 7.39E−04 | 2 | 38 |

TABLE 59-continued

Correlation between the expression level of selected genes of some embodiments of the invention in various tissues and the phenotypic performance under drought across *Sorghum* accessions

| Gene Name | R | P value | Exp. set | Corr. ID | Gene Name | R | P value | Exp. set | Corr. ID |
|---|---|---|---|---|---|---|---|---|---|
| LBY446 | 0.84 | 1.37E−03 | 3 | 23 | LBY446 | 0.71 | 1.51E−02 | 3 | 25 |
| LBY446 | 0.78 | 2.18E−02 | 2 | 31 | LBY446 | 0.77 | 4.45E−02 | 3 | 46 |
| LBY446 | 0.75 | 3.25E−02 | 2 | 51 | LBY446 | 0.89 | 1.89E−02 | 2 | 17 |
| LBY447 | 0.80 | 1.64E−02 | 1 | 39 | LBY447 | 0.75 | 3.30E−02 | 1 | 13 |
| LBY447 | 0.79 | 3.32E−02 | 1 | 48 | LBY447 | 0.76 | 2.71E−02 | 1 | 49 |
| LBY447 | 0.76 | 2.93E−02 | 1 | 50 | LBY447 | 0.75 | 3.21E−02 | 1 | 20 |
| LBY447 | 0.75 | 3.30E−02 | 1 | 1 | LBY447 | 0.70 | 5.15E−02 | 1 | 23 |
| LBY447 | 0.82 | 6.41E−03 | 6 | 34 | LBY447 | 0.71 | 7.60E−02 | 1 | 46 |
| LBY447 | 0.74 | 2.22E−02 | 6 | 47 | LBY447 | 0.86 | 3.03E−03 | 6 | 45 |
| LBY447 | 0.92 | 3.79E−04 | 6 | 36 | LBY447 | 0.83 | 5.99E−03 | 6 | 35 |
| LBY449 | 0.71 | 7.58E−02 | 4 | 46 | LBY449 | 0.71 | 3.33E−02 | 6 | 22 |
| LBY449 | 0.80 | 3.32E−03 | 3 | 23 | LBY449 | 0.78 | 4.48E−03 | 3 | 52 |
| LBY449 | 0.72 | 1.03E−01 | 2 | 17 | LBY449 | 0.70 | 1.63E−02 | 3 | 27 |
| LBY450 | 0.87 | 4.68E−04 | 5 | 5 | LBY450 | 0.77 | 2.61E−02 | 1 | 38 |
| LBY450 | 0.72 | 1.25E−02 | 4 | 19 | LBY450 | 0.88 | 3.34E−04 | 5 | 3 |
| LBY450 | 0.74 | 9.30E−03 | 3 | 47 | LBY450 | 0.77 | 5.11E−03 | 3 | 40 |
| LBY450 | 0.76 | 2.79E−02 | 2 | 51 | LBY450 | 0.81 | 2.71E−03 | 3 | 38 |
| LGA15 | 0.88 | 4.07E−03 | 1 | 49 | LGA15 | 0.79 | 1.94E−02 | 1 | 13 |
| LGA15 | 0.83 | 1.17E−02 | 1 | 20 | LGA15 | 0.79 | 3.35E−02 | 1 | 48 |
| LGA15 | 0.89 | 3.17E−03 | 1 | 50 | LGA15 | 0.81 | 2.61E−02 | 1 | 16 |
| LGA15 | 0.77 | 7.10E−02 | 1 | 44 | LGA15 | 0.79 | 1.94E−02 | 1 | 1 |
| LGA15 | 0.74 | 9.77E−03 | 5 | 34 | LGA15 | 0.71 | 1.16E−01 | 6 | 44 |
| LGA15 | 0.84 | 1.06E−03 | 3 | 45 | LGA15 | 0.84 | 1.06E−03 | 3 | 34 |
| LGA15 | 0.87 | 5.77E−04 | 3 | 35 | LGA15 | 0.72 | 1.24E−02 | 3 | 47 |
| LGA15 | 0.74 | 3.52E−02 | 2 | 19 | LGA15 | 0.75 | 7.67E−03 | 3 | 36 |
| LGA23 | 0.76 | 7.71E−02 | 1 | 24 | LGA23 | 0.93 | 8.55E−04 | 1 | 54 |
| LGA23 | 0.92 | 5.18E−04 | 6 | 22 | LGA23 | 0.74 | 9.50E−02 | 1 | 44 |
| LGA23 | 0.74 | 9.31E−02 | 4 | 44 | LGA23 | 0.81 | 7.50E−03 | 5 | 17 |
| LGA23 | 0.73 | 1.11E−02 | 3 | 31 | LGA23 | 0.74 | 9.86E−03 | 3 | 5 |
| LGA23 | 0.78 | 2.32E−02 | 2 | 9 | LGA23 | 0.81 | 2.33E−02 | 3 | 3 |
| LGA23 | 0.78 | 2.19E−02 | 2 | 38 | LGA23 | 0.82 | 1.32E−02 | 2 | 12 |
| MGP32 | 0.74 | 3.41E−02 | 1 | 51 | MGP59 | 0.78 | 6.54E−02 | 4 | 44 |
| MGP32 | 0.79 | 4.02E−03 | 4 | 19 | MGP32 | 0.72 | 7.00E−02 | 6 | 48 |
| MGP32 | 0.81 | 2.36E−03 | 3 | 12 | MGP32 | 0.82 | 2.08E−03 | 3 | 9 |
| MGP32 | 0.70 | 5.32E−02 | 2 | 3 | MGP32 | 0.71 | 7.66E−02 | 3 | 46 |
| MGP36 | 0.91 | 1.79E−03 | 1 | 18 | MGP36 | 0.71 | 7.37E−02 | 1 | 48 |
| MGP36 | 0.75 | 2.05E−02 | 6 | 31 | MGP36 | 0.74 | 2.33E−02 | 6 | 5 |
| MGP36 | 0.72 | 1.17E−02 | 3 | 5 | MGP36 | 0.74 | 2.32E−02 | 6 | 35 |
| MGP36 | 0.78 | 4.64E−03 | 3 | 31 | MGP36 | 0.73 | 1.08E−02 | 3 | 43 |
| MGP36 | 0.77 | 9.46E−03 | 3 | 16 | MGP36 | 0.74 | 8.61E−03 | 3 | 45 |
| MGP36 | 0.70 | 1.63E−02 | 3 | 29 | MGP36 | 0.72 | 1.17E−02 | 3 | 47 |
| MGP36 | 0.71 | 4.64E−02 | 2 | 18 | MGP36 | 0.76 | 2.99E−02 | 2 | 51 |
| MGP59 | 0.87 | 5.09E−03 | 1 | 13 | MGP59 | 0.71 | 4.76E−02 | 1 | 6 |
| MGP59 | 0.78 | 3.69E−02 | 1 | 48 | MGP59 | 0.79 | 2.06E−02 | 1 | 49 |
| MGP59 | 0.87 | 5.09E−03 | 1 | 1 | MGP59 | 0.76 | 2.72E−02 | 1 | 50 |
| MGP59 | 0.97 | 1.35E−03 | 1 | 44 | MGP59 | 0.83 | 1.16E−02 | 1 | 2 |
| MGP59 | 0.75 | 7.29E−03 | 5 | 6 | MGP59 | 0.76 | 4.68E−02 | 6 | 48 |
| MGP59 | 0.80 | 3.17E−03 | 5 | 1 | MGP59 | 0.80 | 3.17E−03 | 5 | 13 |

Table 59. Provided are the correlations (R) between the genes expression levels in various tissues (Table 51) and the phenotypic performance according to correlated parameters specified in Table 53.
"Corr. ID"—correlation vector ID.
"Exp. Set"—Expression set.
"R" = Pearson correlation coefficient;
"P" = p value.

Example 6

Production of Maize Transcriptome and High Throughput Correlation Analysis Using 60K Maize Oligonucleotide Micro-Array In order to produce a high throughput correlation analysis between plant phenotype and gene expression level, the present inventors utilized a maize oligonucleotide microarray, produced by Agilent Technologies [chem. (dot) agilent (dot) com/Scripts/PDS (dot) asp?lPage=50879]. The array oligonucleotide represents about 45,000 maize genes and transcripts.

Correlation of Maize Hybrids Across Ecotypes Grown Under Regular Growth Conditions Experimental Procedures Twelve Maize hybrids were grown in 3 repetitive plots, in field. Maize seeds were planted and plants were grown in the field using commercial fertilization and irrigation protocols (normal growth conditions), which included 485 m$^3$ water per dunam (1000 square meters) per entire growth period and fertilization of 30 units of URAN® 21% fertilization per dunam per entire growth period. In order to define correlations between the levels of RNA expression with stress and yield components or vigor related parameters, the 12 different maize hybrids were analyzed. Among them, 10 hybrids encompassing the observed variance were selected for RNA expression analysis. The correlation between the RNA levels and the characterized parameters were analyzed using Pearson correlation test [davidmlane (dot) com/hyperstat/A34739 (dot) html].

Analyzed Maize tissues—10 selected maize hybrids were sampled in three time points (TP2=V2-V3 (when two to three collar leaf are visible, rapid growth phase and kernel row determination begins), TP5=R1-R2 (silking-blister), TP6=R3-R4 (milk-dough). Four types of plant tissues [Ear, flag leaf indicated in Table as leaf, grain distal part, and internode] were sampled and RNA was extracted as described in "GENERAL EXPERIMENTAL AND BIOINFORMATICS METHODS". For convenience, each microarray expression information tissue type has received a Set ID as summarized in Table 60 below.

TABLE 60

Tissues used for Maize transcriptome expression sets

| Expression Set | Set ID |
| --- | --- |
| Ear under normal conditions at reproductive stage: R1-R2 | 1 |
| Ear under normal conditions at reproductive stage: R3-R4 | 2 |
| Internode under normal conditions at vegetative stage: Vegetative V2-3 | 3 |
| Internode under normal conditions at reproductive stage: R1-R2 | 4 |
| Internode under normal conditions at reproductive stage: R3-R4 | 5 |
| Leaf under normal conditions at vegetative stage: Vegetative V2-3 | 6 |
| Leaf under normal conditions at reproductive stage: R1-R2 | 7 |
| Grain distal under normal conditions at reproductive stage: R1-R2 | 8 |

Table 60: Provided are the maize transcriptome expression sets.
Leaf = the leaf below the main ear;
Ear = the female flower at the anthesis day.
Grain Distal = maize developing grains from the cob extreme area;
Internodes = internodes located above and below the main ear in the plant.

The following parameters were collected using digital imaging system:

Grain Area (cm$^2$)—At the end of the growing period the grains were separated from the ear. A sample of ~200 grains was weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area (cm$^2$)—At the end of the growing period 5 ears were photographed and images were processed using the below described image processing system. The ear area was measured from those images and was divided by the number of ears.

Ear Length and Ear Width (cm)—At the end of the growing period 5 ears were photographed and images were processed using the below described image processing system. The ear length and width (longest axis) was measured from those images and was divided by the number of ears.

The image processing system used, which consists of a personal desktop computer (Intel P4 3.0 GHz processor) and a public domain program—ImageJ 1.37, Java based image processing software, was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 5 ears, the total grains weight of Sears was divided by 5.

Ear FW (gr.)—At the end of the experiment (when ears were harvested) total and 6 selected ears per plots within blocks A-C were collected separately. The plants (total and 6) were weighted (gr.) separately and the average ear per plant was calculated for total (Ear FW per plot) and for 6 plants (Ear FW per plant).

Plant height and Ear height [cm]—Plants were characterized for height at harvesting. In each measure, 6 plants were measured for their height using a measuring tape. Height was measured from ground level to top of the plant below the tassel. Ear height was measured from the ground level to the place where the main ear is located.

Leaf number per plant [num]—Plants were characterized for leaf number during growing period at 5 time points. In each measure, plants were measured for their leaf number by counting all the leaves of 3 selected plants per plot.

Relative Growth Rate was calculated using Formula 7 (described above).

SPAD—Chlorophyll content was determined using a Minolta SPAD 502 chlorophyll meter and measurement was performed 64 days post sowing. SPAD meter readings were done on young fully developed leaves. Three measurements per leaf were taken per plot. Data were taken after 46 and 54 days after (post) sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index was calculated using Formula 17 above.

Percent Filled Ear [%]—was calculated as the percentage of the Ear area with grains out of the total ear.

Cob diameter [mm]—The diameter of the cob without grains was measured using a ruler.

Kernel Row Number per Ear [number]—The number of rows in each ear was counted.

TABLE 61

Maize correlated parameters (vectors)

| Correlated parameter with | Corr. ID |
| --- | --- |
| SPAD 54 DPS [SPAD unit] at normal growth conditions | 1 |
| SPAD 46 DPS [SPAD unit] at normal growth conditions | 2 |

TABLE 61-continued

Maize correlated parameters (vectors)

| Correlated parameter with | Corr. ID |
|---|---|
| Relative Growth Rate [leaves/day] at normal growth conditions | 3 |
| Plant height [cm] at normal growth conditions | 4 |
| Ear height [cm] at normal growth conditions | 5 |
| Leaf number per plant [num] at normal growth conditions | 6 |
| Ear Length [cm] at normal growth conditions | 7 |
| Percent Filled Ear [%] at normal growth conditions | 8 |
| Cob diameter [mm] at normal growth conditions | 9 |
| Kernel Row Number per Ear [num] at normal growth conditions | 10 |
| Dry weight per plant [gr.] at normal growth conditions | 11 |
| Ear FW (per plant) [gr.] at normal growth conditions | 12 |
| Ear FW (per plot) [gr.] at normal growth conditions | 14 |
| Normalized Grain Weight per plant (per plot) [gr.] at normal growth conditions | 14 |
| Normalized Grain Weight per plant (per plant) [gr.] at normal growth conditions | 15 |
| Ear Area [cm²] at normal growth conditions | 16 |
| Ear Width [cm] at normal growth conditions | 17 |
| Grain Area [cm²] at normal growth conditions | 19 |
| Grain Length [cm] at normal growth conditions | 20 |
| Grain width [cm] at normal growth conditions | 21 |

Table 61.
SPAD 46 DPS and SPAD 54 DPS = Chlorophyll level after 46 and 54 days after sowing (DPS), respectively.
"FW" = fresh weight;
"Corr." = correlation.

Experimental Results

Twelve different maize hybrids were grown and characterized for different parameters. The correlated parameters are described in Table 61. The average for each of the measured parameters was calculated using the JMP software (Tables 62-63) and subsequent correlation analysis was performed (Table 64). Results were then integrated to the database.

TABLE 62

Measured parameters in Maize accessions under normal conditions

| Line/Corr. ID | Line-1 | Line-2 | Line-3 | Line-4 | Line-5 | Line-6 |
|---|---|---|---|---|---|---|
| 1 | 54.3 | 57.2 | 56 | 59.7 | 54.8 | 59.1 |
| 2 | 51.7 | 56.4 | 53.5 | 55.2 | 55.3 | 59.4 |
| 3 | 0.283 | 0.221 | 0.281 | 0.269 | 0.306 | 0.244 |
| 4 | 278.1 | 260.5 | 275.1 | 238.5 | 286.9 | 224.8 |
| 5 | 135.2 | 122.3 | 132 | 114 | 135.3 | 94.3 |
| 6 | 12 | 11.1 | 11.7 | 11.8 | 11.9 | 12.3 |
| 7 | 19.7 | 19.1 | 20.5 | 21.3 | 20.9 | 18.2 |
| 8 | 80.6 | 86.8 | 82.1 | 92.7 | 80.4 | 82.8 |
| 9 | 29 | 25.1 | 28.1 | 25.7 | 28.7 | 25.8 |
| 10 | 16.2 | 14.7 | 16.2 | 15.9 | 16.2 | 15.2 |
| 11 | 657.5 | 491.7 | 641.1 | 580.6 | 655.6 | 569.4 |
| 12 | 245.8 | 208.3 | 262.2 | 263.9 | 272.2 | 177.8 |
| 14 | 278.2 | 217.5 | 288.3 | 247.9 | 280.1 | 175.8 |
| 15 | 153.9 | 135.9 | 152.5 | 159.2 | 140.5 | 117.1 |
| 16 | 85.1 | 85.8 | 90.5 | 96 | 91.6 | 72.4 |
| 17 | 5.58 | 5.15 | 5.67 | 5.53 | 5.73 | 5.23 |
| 18 | 0.916 | 0.922 | 0.927 | 0.917 | 0.908 | 0.95 |
| 19 | 0.753 | 0.708 | 0.755 | 0.766 | 0.806 | 0.713 |
| 20 | 1.17 | 1.09 | 1.18 | 1.2 | 1.23 | 1.12 |
| 21 | 0.81 | 0.814 | 0.803 | 0.803 | 0.824 | 0.803 |

Table 62. Provided are the values of each of the parameters (as described above) measured in maize accessions (Line) under regular growth conditions. Growth conditions are specified in the experimental procedure section.
"Corr." = correlation.

TABLE 63

Additional measured parameters in Maize accessions under normal growth conditions

| Line/Corr. | Line-7 | Line-8 | Line-9 | Line-10 | Line-11 | Line-12 |
|---|---|---|---|---|---|---|
| 1 | 58 | 60.4 | 54.8 | 51.4 | 61.1 | 53.3 |
| 2 | 58.5 | 55.9 | 53 | 53.9 | 59.7 | 50 |
| 3 | 0.244 | 0.266 | | 0.194 | 0.301 | |
| 4 | 264.4 | 251.6 | | 163.8 | 278.4 | |
| 5 | 120.9 | 107.7 | | 60.4 | 112.5 | |
| 6 | 12.4 | 12.2 | | 9.3 | 12.6 | |
| 7 | 19 | 18.6 | | 16.7 | 21.7 | |
| 8 | 73.2 | 81.1 | | 81.1 | 91.6 | |
| 9 | 26.4 | 25.2 | | 26.7 | | |
| 10 | 16 | 14.8 | | 14.3 | 15.4 | |
| 11 | 511.1 | 544.4 | | 574.2 | 522.2 | |
| 12 | 188.9 | 197.2 | | 141.1 | 261.1 | |
| 14 | 192.5 | 204.7 | | 142.7 | 264.2 | |
| 15 | 123.2 | 131.3 | | 40.8 | 170.7 | |
| 16 | 74 | 76.5 | | 55.2 | 95.4 | |
| 17 | 5.22 | 5.33 | | 4.12 | 5.58 | |
| 18 | 0.873 | 0.939 | | 0.796 | 0.958 | |
| 19 | 0.714 | 0.753 | | 0.502 | 0.762 | |
| 20 | 1.14 | 1.13 | | 0.92 | 1.18 | |
| 21 | 0.791 | 0.837 | | 0.675 | 0.812 | |

Table 63. Provided are the values of each of the parameters (as described above) measured in maize accessions (Line) under regular growth conditions. Growth conditions are specified in the experimental procedure section.
"Corr." = correlation.

TABLE 64

Correlation between the expression level of selected genes of some embodiments of the invention in various tissues and the phenotypic performance under normal conditions across maize accessions

| Gene Name | R | P value | Exp. set | Corr. ID | Gene Name | R | P value | Exp. set | Corr. ID |
|---|---|---|---|---|---|---|---|---|---|
| LBY244 | 0.79 | 5.95E−02 | 7 | 9 | LBY244 | 0.92 | 1.30E−03 | 8 | 20 |
| LBY244 | 0.89 | 2.76E−03 | 8 | 3 | LBY244 | 0.71 | 4.90E−02 | 8 | 14 |
| LBY244 | 0.89 | 2.79E−03 | 8 | 19 | LBY244 | 0.78 | 2.37E−02 | 8 | 12 |
| LBY244 | 0.83 | 1.10E−02 | 8 | 11 | LBY244 | 0.72 | 4.28E−02 | 8 | 7 |
| LBY244 | 0.73 | 3.92E−02 | 8 | 10 | LBY244 | 0.76 | 2.72E−02 | 8 | 9 |
| LBY244 | 0.86 | 6.73E−03 | 8 | 17 | LBY245 | 0.85 | 3.04E−02 | 4 | 9 |
| LBY245 | 0.71 | 4.62E−02 | 8 | 4 | LBY245 | 0.77 | 4.11E−02 | 1 | 6 |
| LBY301 | 0.83 | 2.09E−02 | 1 | 18 | LBY301 | 0.71 | 7.58E−02 | 1 | 19 |
| LBY301 | 0.87 | 1.07E−02 | 1 | 21 | LBY301 | 0.87 | 5.50E−03 | 8 | 20 |
| LBY301 | 0.96 | 1.20E−04 | 8 | 3 | LBY301 | 0.77 | 2.47E−02 | 8 | 14 |
| LBY301 | 0.94 | 4.56E−04 | 8 | 19 | LBY301 | 0.79 | 2.03E−02 | 8 | 12 |
| LBY301 | 0.82 | 1.19E−02 | 8 | 11 | LBY301 | 0.71 | 5.01E−02 | 8 | 9 |
| LBY301 | 0.90 | 2.41E−03 | 8 | 17 | LBY302 | 0.75 | 5.36E−02 | 1 | 20 |
| LBY302 | 0.72 | 6.76E−02 | 1 | 6 | LBY302 | 0.78 | 3.90E−02 | 1 | 16 |
| LBY302 | 0.79 | 3.37E−02 | 1 | 18 | LBY302 | 0.78 | 3.74E−02 | 1 | 19 |
| LBY302 | 0.80 | 2.99E−02 | 1 | 15 | LBY302 | 0.79 | 3.55E−02 | 1 | 21 |
| LBY302 | 0.77 | 4.08E−02 | 1 | 8 | LBY302 | 0.83 | 2.11E−02 | 1 | 13 |
| LBY323 | 0.84 | 1.86E−02 | 4 | 11 | LBY323 | 0.72 | 1.09E−01 | 4 | 9 |
| LBY323 | 0.91 | 1.17E−02 | 7 | 9 | LBY323 | 0.85 | 1.66E−02 | 1 | 6 |
| LBY323 | 0.86 | 1.40E−02 | 1 | 18 | LBY323 | 0.73 | 6.00E−02 | 1 | 19 |
| LBY323 | 0.82 | 2.34E−02 | 1 | 21 | LBY323 | 0.86 | 6.18E−03 | 8 | 20 |
| LBY323 | 0.88 | 3.54E−03 | 8 | 3 | LBY323 | 0.87 | 4.73E−03 | 8 | 19 |
| LBY323 | 0.74 | 3.76E−02 | 8 | 12 | LBY323 | 0.72 | 4.47E−02 | 8 | 10 |
| LBY323 | 0.82 | 1.28E−02 | 8 | 17 | LBY323 | 0.71 | 1.11E−01 | 2 | 10 |
| LBY324 | 0.96 | 1.91E−04 | 5 | 20 | LBY324 | 0.74 | 3.55E−02 | 5 | 3 |
| LBY324 | 0.73 | 3.95E−02 | 5 | 16 | LBY324 | 0.89 | 3.09E−03 | 5 | 19 |
| LBY324 | 0.78 | 2.11E−02 | 5 | 15 | LBY324 | 0.83 | 1.13E−02 | 5 | 12 |
| LBY324 | 0.81 | 1.38E−02 | 5 | 7 | LBY324 | 0.82 | 1.34E−02 | 5 | 13 |
| LBY324 | 0.81 | 1.42E−02 | 5 | 17 | LBY324 | 0.75 | 1.19E−01 | 6 | 8 |
| LBY324 | 0.83 | 4.30E−02 | 2 | 18 | LBY324 | 0.83 | 4.21E−02 | 2 | 21 |
| LBY325 | 0.93 | 6.65E−04 | 5 | 21 | LBY325 | 0.93 | 2.80E−03 | 4 | 20 |
| LBY325 | 0.87 | 1.03E−02 | 4 | 3 | LBY325 | 0.82 | 2.45E−02 | 4 | 6 |
| LBY325 | 0.93 | 2.14E−03 | 4 | 16 | LBY325 | 0.93 | 2.59E−03 | 4 | 5 |
| LBY325 | 0.85 | 1.49E−02 | 4 | 18 | LBY325 | 0.96 | 4.80E−04 | 4 | 4 |
| LBY325 | 0.88 | 9.15E−03 | 4 | 14 | LBY325 | 0.97 | 2.95E−04 | 4 | 19 |
| LBY325 | 0.97 | 2.92E−04 | 4 | 15 | LBY325 | 0.88 | 8.63E−03 | 4 | 12 |
| LBY325 | 0.94 | 1.79E−03 | 4 | 21 | LBY325 | 0.85 | 1.44E−02 | 4 | 7 |
| LBY325 | 0.95 | 1.12E−03 | 4 | 13 | LBY325 | 0.95 | 1.12E−03 | 4 | 17 |
| LBY325 | 0.72 | 6.95E−02 | 7 | 18 | LBY325 | 0.75 | 8.28E−02 | 1 | 9 |
| LBY325 | 0.94 | 5.22E−03 | 2 | 21 | LBY326 | 0.82 | 4.52E−02 | 2 | 10 |
| LBY327 | 0.72 | 1.09E−01 | 4 | 9 | LBY327 | 0.74 | 5.55E−02 | 7 | 11 |
| LBY327 | 0.83 | 2.03E−02 | 1 | 11 | LBY327 | 0.92 | 8.30E−03 | 2 | 11 |
| LBY328 | 0.79 | 3.63E−02 | 4 | 11 | LBY328 | 0.70 | 1.21E−01 | 2 | 20 |
| LBY328 | 0.72 | 1.09E−01 | 2 | 16 | LBY328 | 0.79 | 6.22E−02 | 2 | 7 |
| LBY329 | 0.81 | 1.54E−02 | 8 | 20 | LBY329 | 0.87 | 4.47E−03 | 8 | 3 |
| LBY329 | 0.77 | 2.52E−02 | 8 | 19 | LBY329 | 0.80 | 1.59E−02 | 8 | 11 |
| LBY329 | 0.74 | 3.65E−02 | 8 | 17 | LBY329 | 0.71 | 1.10E−01 | 2 | 5 |
| LBY329 | 0.91 | 1.08E−02 | 2 | 10 | LBY373 | 0.86 | 2.70E−02 | 4 | 9 |
| LBY373 | 0.77 | 4.36E−02 | 4 | 11 | LBY373 | 0.75 | 5.05E−02 | 1 | 18 |
| LBY373 | 0.77 | 4.29E−02 | 1 | 6 | LBY375 | 0.70 | 7.88E−02 | 7 | 14 |
| LBY374 | 0.77 | 4.37E−02 | 4 | 11 | LBY423 | 0.75 | 8.49E−02 | 2 | 8 |
| LBY423 | 0.75 | 8.38E−02 | 2 | 18 | LBY426 | 0.80 | 2.95E−02 | 4 | 14 |
| LBY424 | 0.81 | 2.87E−02 | 4 |  | LBY426 | 0.77 | 4.48E−02 | 4 | 11 |
| LBY426 | 0.75 | 5.29E−02 | 4 | 16 | LBY426 | 0.91 | 4.80E−03 | 4 | 10 |
| LBY426 | 0.83 | 2.10E−02 | 4 | 12 | LBY426 | 0.79 | 1.86E−02 | 8 | 19 |
| LBY426 | 0.74 | 5.79E−02 | 4 | 7 | LBY427 | 0.74 | 9.15E−02 | 2 | 3 |
| LBY426 | 0.84 | 9.73E−03 | 8 | 3 | LBY427 | 0.80 | 5.69E−02 | 2 | 19 |
| LBY426 | 0.71 | 4.75E−02 | 8 | 9 | LBY427 | 0.84 | 3.46E−02 | 2 | 13 |
| LBY427 | 0.77 | 7.04E−02 | 2 | 16 | LGA10 | 0.80 | 3.19E−02 | 4 | 4 |
| LBY427 | 0.72 | 1.05E−01 | 2 | 7 | LGA10 | 0.85 | 1.52E−02 | 4 | 12 |
| LGA10 | 0.77 | 4.09E−02 | 4 | 16 | LGA10 | 0.88 | 9.44E−03 | 4 | 10 |
| LGA10 | 0.78 | 4.03E−02 | 4 | 14 | LGA10 | 0.82 | 2.34E−02 | 1 | 20 |
| LGA10 | 0.80 | 2.97E−02 | 4 | 7 | LGA10 | 0.73 | 6.35E−02 | 1 | 12 |
| LGA10 | 0.72 | 6.79E−02 | 4 | 13 | LGA10 | 0.72 | 7.05E−02 | 1 | 13 |
| LGA10 | 0.72 | 6.93E−02 | 1 | 19 | LGA10 | 0.79 | 1.86E−02 | 8 | 3 |
| LGA10 | 0.92 | 3.06E−03 | 1 | 10 | LGA10 | 0.82 | 1.21E−02 | 8 | 11 |
| LGA10 | 0.77 | 4.22E−02 | 1 | 17 | LGA10 | 0.74 | 3.59E−02 | 8 | 17 |
| LGA10 | 0.72 | 4.60E−02 | 8 | 19 | LYD959 | 0.74 | 3.64E−02 | 8 | 20 |
| LGA10 | 0.87 | 5.20E−03 | 8 | 9 | LYD959 | 0.78 | 2.14E−02 | 8 | 14 |
| LYD959 | 0.79 | 3.33E−02 | 1 | 21 | LYD959 | 0.73 | 3.81E−02 | 8 | 12 |
| LYD959 | 0.90 | 2.15E−03 | 8 | 3 | LYD959 | 0.85 | 7.63E−03 | 8 | 17 |

TABLE 64-continued

Correlation between the expression level of selected genes of some embodiments of the invention in various tissues and the phenotypic performance under normal conditions across maize accessions

| Gene Name | R | P value | Exp. set | Corr. ID | Gene Name | R | P value | Exp. set | Corr. ID |
|---|---|---|---|---|---|---|---|---|---|
| LYD959 | 0.85 | 8.15E−03 | 8 | 19 | | | | | |
| LYD959 | 0.80 | 1.69E−02 | 8 | 11 | | | | | |
| LYD959 | 0.76 | 8.03E−02 | 2 | 10 | | | | | |

Table 64. Provided are the correlations (R) between the expression levels of the yield improving genes and their homologs in various tissues [Expression (Exp) sets, Table 60] and the phenotypic performance (yield, biomass, growth rate and/or vigor components, Table 62-63) as determined using the Correlation (Corr.) vectors specified in Table 61 under normal conditions across maize varieties.
P = p value.

Example 7

Production of Maize Transcriptome and High Throughput Correlation Analysis with Yield, NUE, and ABST Related Parameters Measured in Semi-Hydroponics Conditions Using 60K Maize Oligonucleotide Micro-Arrays Maize vigor related parameters under low nitrogen, salinity stress (100 mM NaCl), low temperature (10±2° C.) and normal growth conditions—Twelve Maize hybrids were grown in 5 repetitive plots, each containing 7 plants, at a net house under semi-hydroponics conditions. Briefly, the growing protocol was as follows: Maize seeds were sown in trays filled with a mix of vermiculite and peat in a 1:1 ratio. Following germination, the trays were transferred to the high salinity solution (100 mM NaCl in addition to the Full Hoagland solution at 28±2° C.); low temperature ("cold conditions" of 10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.6 mM N at 28±2° C.) or at Normal growth solution (Full Hoagland containing 16 mM N solution, at 28±2° C.).

Full Hoagland solution consists of: $KNO_3$—0.808 grams/liter, $MgSO_4$—0.12 grams/liter, $KH_2PO_4$—0.136 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed Maize tissues—Twelve selected Maize hybrids were sampled per each treatment. Two tissues [leaves and root tip] growing at salinity stress (100 mM NaCl), low temperature (10±2° C., cold stress), low Nitrogen (1.6 mM Nitrogen, nitrogen deficiency) or under Normal conditions were sampled at the vegetative stage (V4-5) and RNA was extracted as described above. Each micro-array expression information tissue type has received a Set ID as summarized in Tables 65-68 below.

TABLE 65

Maize transcriptome expression sets under semi hydroponics and normal conditions

| Expression set | Set ID |
|---|---|
| leaf at vegetative stage (V4-V5) under Normal conditions | 1 |
| root tip at vegetative stage (V4-V5) under Normal conditions | 2 |

Table 65: Provided are the Maize transcriptome expression sets at normal conditions.

TABLE 66

Maize transcriptome expression sets under semi hydroponics and cold stress conditions

| Expression set | Set ID |
|---|---|
| leaf at vegetative stage (V4-V5) under cold conditions | 1 |
| root tip at vegetative stage (V4-V5) under cold conditions | 2 |

Table 66: Provided are the Maize transcriptome expression sets at cold conditions.

TABLE 67

Maize transcriptome expression sets under semi hydroponics and low N (Nitrogen deficient)

| Expression set | Set ID |
|---|---|
| leaf at vegetative stage (V4-V5) under low N conditions (1.6 mM N) | 1 |
| root tip at vegetative stage (V4-V5) under low N conditions (1.6 mM N) | 2 |

Table 67: Provided are the Maize transcriptome expression sets at low nitrogen conditions 1.6 mM Nitrogen.

TABLE 68

Maize transcriptome expression sets under semi hydroponics and salinity stress conditions

| Expression set | Set ID |
|---|---|
| leaf at vegetative stage (V4-V5) under salinity conditions (NaCl 100 mM) | 1 |
| root tip at vegetative stage (V4-V5) under salinity conditions (NaCl 100 mM) | 2 |

Table 68: Provided are the Maize transcriptome expression sets at 100 mM NaCl.

The following parameters were collected:

Leaves DW—leaves dry weight per plant (average of five plants).

Plant Height growth—was calculated as regression coefficient of plant height [cm] along time course (average of five plants).

Root DW—At the end of the experiment, the root material was collected, measured and divided by the number of plants. (average of four plants).

Root length—the length of the root was measured at V4 developmental stage.

Shoot DW—shoot dry weight per plant, all vegetative tissue above ground (average of four plants) after drying at 70° C. in oven for 48 hours.

Shoot FW—shoot fresh weight per plant, all vegetative tissue above ground (average of four plants).

SPAD—Chlorophyll content was determined using a Minolta SPAD 502 chlorophyll meter and measurement was performed 30 days post sowing. SPAD meter readings were done on young fully developed leaf. Three measurements per leaf were taken per plot.

Experimental Results 12 different Maize hybrids were grown and characterized at the vegetative stage (V4-5) for different parameters. The correlated parameters (vectors) are described in Table 69-72 below. The average for each of the measured parameters was calculated using the JMP software and values are summarized in Tables 73-80 below. Subsequent correlation analysis was performed (Tables 81-84). Results were then integrated to the database.

TABLE 69

Maize correlated parameters (vectors) under low nitrogen (nitrogen deficiency) growth conditions

| Correlated parameter with | Correlation ID |
|---|---|
| Leaves DW [gr.] | 1 |
| Plant height growth [cm/day] | 2 |
| Root DW [gr.] | 3 |
| Shoot DW [gr.] | 5 |
| Shoot FW [gr.] | 6 |
| SPAD | 7 |
| Root length [cm] | 4 |

Table 69: Provided are the Maize correlated parameters.
"DW" = dry weight;
"FW" = fresh weight.
"gr." = gram(s).

TABLE 70

Maize correlated parameters (vectors) under salinity stress growth conditions

| Correlated parameter with | Correlation ID |
|---|---|
| Leaves DW [gr.] | 1 |
| Plant height growth [cm/day] | 2 |
| Root DW [gr.] | 3 |
| Shoot DW [gr.] | 4 |
| Shoot FW [gr.] | 5 |
| SPAD | 6 |
| Root length [cm] | 7 |

Table 70: Provided are the Maize correlated parameters.
"DW" = dry weight;
"FW" = fresh weight.
"gr." = gram(s).

TABLE 71

Maize correlated parameters (vectors) under cold stress growth conditions

| Correlated parameter with | Correlation ID |
|---|---|
| Plant height growth [cm/day] | 1 |
| Root DW [gr.] | 2 |
| Shoot DW [gr.] | 3 |
| Shoot FW [gr.] | 4 |
| SPAD | 5 |
| Leaves DW [gr.] | 6 |
| Root length [cm] | 7 |

Table 71: Provided are the Maize correlated parameters.
"DW" = dry weight;
"FW" = fresh weight.
"gr." = gram(s).

TABLE 72

Maize correlated parameters (vectors) under regular growth conditions

| Correlated parameter with | Correlation ID |
|---|---|
| Leaves DW [gr.] | 1 |
| Plant height growth [cm/day] | 2 |
| Root DW [gr.] | 3 |
| Shoot DW [gr.] | 4 |
| Shoot FW [gr.] | 5 |
| SPAD | 6 |
| Root length [cm] | 7 |

Table 72: Provided are the Maize correlated parameters.
"DW" = dry weight;
"FW" = fresh weight.
"gr." = gram(s).

TABLE 73

Maize accessions, measured parameters under low nitrogen (nitrogen deficiency) growth conditions

| Line/Corr. | Line-1 | Line-2 | Line-3 | Line-4 | Line-5 | Line-6 |
|---|---|---|---|---|---|---|
| 1 | 0.566 | 0.451 | 0.464 | 0.476 | 0.355 | 0.514 |
| 2 | 0.752 | 0.811 | 0.877 | 0.691 | 0.831 | 0.835 |
| 3 | 0.38 | 0.353 | 0.255 | 0.36 | 0.313 | 0.297 |
| 4 | 44.5 | 45.6 | 44.2 | 43.6 | 40.7 | 42 |
| 5 | 2.56 | 1.96 | 2.01 | 1.94 | 1.94 | 2.52 |
| 6 | 23.3 | 20.6 | 19.3 | 20 | 18 | 22.1 |
| 7 | 21.4 | 21.2 | 22.2 | 24.6 | 22.8 | 26.5 |

Table 73: Provided are the values of each of the parameters (as described above) measured in Maize accessions (Line) under low nitrogen (nitrogen deficient) conditions. Growth conditions are specified in the experimental procedure section.

TABLE 74

Maize accessions, measured parameters under low nitrogen (nitrogen deficiency) growth conditions

| Line/Corr. | Line-7 | Line-8 | Line-9 | Line-10 | Line-11 | Line-12 |
|---|---|---|---|---|---|---|
| 1 | 0.529 | 0.579 | 0.551 | 0.51 | 0.563 | 0.392 |
| 2 | 0.782 | 0.918 | 0.887 | 0.853 | 0.805 | 0.642 |
| 3 | 0.289 | 0.306 | 0.291 | 0.322 | 0.43 | 0.168 |
| 4 | 42.6 | 45.1 | 45.3 | 42.2 | 41 | 37.6 |
| 5 | 2.03 | 2.37 | 2.09 | 2.17 | 2.62 | 1.53 |
| 6 | 21.3 | 22.1 | 20.3 | 19.9 | 22.5 | 15.9 |
| 7 | 22.1 | 25.1 | 23.7 | 25.7 | 25 | 19.5 |

Table 74: Provided are the values of each of the parameters (as described above) measured in Maize accessions (Line) under low nitrogen (nitrogen deficient) conditions. Growth conditions are specified in the experimental procedure section.

TABLE 75

Maize accessions, measured parameters under salinity stress growth conditions

| Line/Corr. | Line-7 | Line-8 | Line-9 | Line-10 | Line-11 | Line-12 |
|---|---|---|---|---|---|---|
| 1 | 0.407 | 0.502 | 0.432 | 0.481 | 0.434 | 0.564 |
| 2 | 0.457 | 0.398 | 0.454 | 0.316 | 0.322 | 0.311 |
| 3 | 0.047 | 0.0503 | 0.0295 | 0.071 | 0.0458 | 0.0307 |
| 4 | 2.43 | 2.19 | 2.25 | 2.26 | 1.54 | 1.94 |
| 5 | 19.6 | 20.8 | 18.4 | 19.4 | 15.6 | 16.1 |
| 6 | 36.5 | 39.9 | 37.8 | 41.3 | 40.8 | 44.4 |
| 7 | 10.9 | 11.3 | 11.8 | 10.1 | 8.5 | 10.6 |

Table 75: Provided are the values of each of the parameters (as described above) measured in Maize accessions (Line) under salinity stress (100 mM NaCl) growth conditions. Growth conditions are specified in the experimental procedure section.

TABLE 76

Maize accessions, measured parameters under salinity stress growth conditions

| Line/Corr. | Line-7 | Line-8 | Line-9 | Line-10 | Line-11 | Line-12 |
|---|---|---|---|---|---|---|
| 1 | 0.327 | 0.507 | 0.465 | 0.984 | 0.475 | 0.154 |
| 2 | 0.29 | 0.359 | 0.37 | 0.355 | 0.305 | 0.272 |
| 3 | 0.0954 | 0.0625 | 0.0163 | 0.0355 | 0.0494 | 0.0146 |
| 4 | 1.78 | 1.9 | 1.89 | 2.2 | 1.86 | 0.97 |
| 5 | 12.5 | 16.9 | 16.8 | 17.6 | 15.9 | 9.4 |
| 6 | 37.9 | 43.2 | 39.8 | 38.2 | 38.1 | 37.8 |
| 7 | 10.1 | 11.8 | 10.5 | 11.2 | 10.1 | 8.9 |

Table 76: Provided are the values of each of the parameters (as described above) measured in Maize accessions (Line) under salinity stress (100 mM NaCl) growth conditions. Growth conditions are specified in the experimental procedure section.

TABLE 77

Maize accessions, measured parameters under cold stress growth conditions

| Line/Corr. | Line-1 | Line-2 | Line-3 | Line-4 | Line-5 | Line-6 |
|---|---|---|---|---|---|---|
| 1 | 2.15 | 1.93 | 2.12 | 1.8 | 2.32 | 2.15 |
| 2 | 0.0466 | 0.0683 | 0.1 | 0.0808 | 0.0659 | 0.0667 |
| 3 | 5.74 | 4.86 | 3.98 | 4.22 | 4.63 | 4.93 |
| 4 | 73.8 | 55.5 | 53.3 | 54.9 | 59 | 62.4 |
| 5 | 28.9 | 29.1 | 27.1 | 32.4 | 32.7 | 32.9 |
| 6 | 1.19 | 1.17 | 1.02 | 1.18 | 1.04 | 1.23 |

Table 77: Provided are the values of each of the parameters (as described above) measured in Maize accessions (Line) under cold stress growth conditions. Growth conditions are specified in the experimental procedure section.

TABLE 78

Maize accessions, measured parameters under cold stress growth conditions

| Line/Corr. | Line-7 | Line-8 | Line-9 | Line-10 | Line-11 | Line-12 |
|---|---|---|---|---|---|---|
| 1 | 2.49 | 2.01 | 1.95 | 2.03 | 1.85 | 1.21 |
| 2 | 0.1367 | 0.0667 | 0.0733 | 0.0204 | 0.0517 | 0.0567 |
| 3 | 4.82 | 4.03 | 3.57 | 3.99 | 4.64 | 1.89 |
| 4 | 63.6 | 54.9 | 48.2 | 52.8 | 55.1 | 29.6 |
| 5 | 31.6 | 33 | 28.6 | 31.4 | 30.6 | 30.7 |
| 6 | 1.13 | 0.98 | 0.88 | 1.28 | 1.1 | 0.6 |

Table 78: Provided are the values of each of the parameters (as described above) measured in Maize accessions (Line) under cold stress growth conditions. Growth conditions are specified in the experimental procedure section.

TABLE 79

Maize accessions, measured parameters under regular growth conditions

| Line/Corr. | Line-1 | Line-2 | Line-3 | Line-4 | Line-5 | Line-6 |
|---|---|---|---|---|---|---|
| 1 | 1.161 | 1.099 | 0.924 | 1.013 | 0.935 | 0.907 |
| 2 | 1.99 | 1.92 | 1.93 | 1.93 | 2.15 | 1.95 |
| 3 | 0.14 | 0.106 | 0.227 | 0.155 | 0.077 | 0.049 |
| 4 | 5.27 | 4.67 | 3.88 | 5.08 | 4.1 | 4.46 |
| 5 | 79 | 62.8 | 59.7 | 63.9 | 60.1 | 64.7 |
| 6 | 34.5 | 35.8 | 34.7 | 34.4 | 35.3 | 37.5 |
| 7 | 20.1 | 15.9 | 18.6 | 18.7 | 16.4 | 14.9 |

Table 79: Provided are the values of each of the parameters (as described above) measured in Maize accessions (Line) under regular (normal) growth conditions. Growth conditions are specified in the experimental procedure section.

TABLE 80

Maize accessions, measured parameters under regular growth conditions

| Line/Corr. | Line-7 | Line-8 | Line-9 | Line-10 | Line-11 | Line-12 |
|---|---|---|---|---|---|---|
| 1 | 1.105 | 1.006 | 1.011 | 1.024 | 1.23 | 0.44 |
| 2 | 2.23 | 1.94 | 1.97 | 2.05 | 1.74 | 1.26 |
| 3 | 0.175 | 0.101 | 0.069 | 0.104 | 0.138 | 0.03 |
| 4 | 4.68 | 4.59 | 4.08 | 4.61 | 5.42 | 2.02 |
| 5 | 68.1 | 65.8 | 58.3 | 61.9 | 70 | 36 |
| 6 | 36.5 | 36.1 | 33.7 | 34.3 | 35.7 | 29 |
| 7 | 17.5 | 15.7 | 15.7 | 17.6 | 16.1 | 17.4 |

Table 80: Provided are the values of each of the parameters (as described above) measured in Maize accessions (Line) under regular (normal) growth conditions. Growth conditions are specified in the experimental procedure section.

TABLE 81

Correlation between the expression level of selected genes of some embodiments of the invention in various tissues and the phenotypic performance under normal conditions across Maize accessions

| Gene Name | R | P value | Exp. set | Corr. ID | Gene Name | R | P value | Exp. set | Corr. ID |
|---|---|---|---|---|---|---|---|---|---|
| LBY244 | 0.70 | 3.53E−02 | 2 | 7 | LBY244 | 0.87 | 2.52E−03 | 2 | 3 |
| LGA10 | 0.80 | 9.52E−03 | 2 | 1 | LGA10 | 0.78 | 1.41E−02 | 2 | 4 |
| LGA10 | 0.83 | 5.66E−03 | 2 | 3 | | | | | |

Table 81. Provided are the correlations (R) between the expression levels of yield improving genes and their homologues in tissues [Leaves or roots; Expression sets (Exp) Table 65]] and the phenotypic performance in various biomass, growth rate and/or vigor components [Tables 79-80 using the Correlation vector (corr.) as described in Table 72] under normal conditions across Maize accessions.
P = p value.

TABLE 82

Correlation between the expression level of selected genes of some embodiments of the invention in various tissues and the phenotypic performance under low nitrogen (nitrogen deficiency) conditions across Maize accessions

| Gene Name | R | P value | Exp. set | Corr. ID | Gene Name | R | P value | Exp. set | Corr. ID |
|---|---|---|---|---|---|---|---|---|---|
| LBY301 | 0.78 | 1.40E−02 | 2 | 4 | LBY373 | 0.71 | 3.31E−02 | 2 | 2 |
| LBY373 | 0.76 | 1.64E−02 | 2 | 7 | LBY424 | 0.83 | 5.80E−03 | 2 | 1 |
| LBY424 | 0.78 | 1.35E−02 | 2 | 4 | LBY426 | 0.72 | 2.88E−02 | 2 | 7 |
| LGA10 | 0.80 | 9.96E−03 | 2 | 3 | LGA10 | 0.73 | 2.60E−02 | 2 | 1 |
| LGA10 | 0.72 | 2.79E−02 | 2 | 5 | LGA10 | 0.75 | 2.04E−02 | 2 | 6 |

Table 82. Provided are the correlations (R) between the expression levels of yield improving genes and their homologues in tissues [Leaves or roots; Expression sets (Exp) Table 67] and the phenotypic performance in various biomass, growth rate and/or vigor components [Tables 73-74 using the Correlation vector (corr.) as described in Table 69] under low nitrogen conditions across Maize accessions.
P = p value.

TABLE 83

Correlation between the expression level of selected genes of some embodiments of the invention in various tissues and the phenotypic performance under cold stress conditions across Maize accessions

| Gene Name | R | P value | Exp. set | Corr. ID | Gene Name | R | P value | Exp. set | Corr. ID |
|---|---|---|---|---|---|---|---|---|---|
| LBY426 | 0.72 | 4.23E−02 | 1 | 1 | LBY426 | 0.81 | 1.40E−02 | 1 | 6 |
| LBY427 | 0.82 | 1.33E−02 | 1 | 2 | | | | | |

Table 83. Provided are the correlations (R) between the expression levels of yield improving genes and their homologues in tissues [Leaves or roots; Expression sets (Exp) Table 66] and the phenotypic performance in various biomass, growth rate and/or vigor components [Tables 77-78 using the Correlation vector (corr.) as described in Table 71] under cold conditions (10 ± 2° C.) across Maize accessions.
P = p value.

TABLE 84

Correlation between the expression level of selected genes of some embodiments of the invention in various tissues and the phenotypic performance under salinity stress conditions across Maize accessions

| Gene Name | R | P value | Exp. set | Corr. ID | Gene Name | R | P value | Exp. set | Corr. ID |
|---|---|---|---|---|---|---|---|---|---|
| LBY268 | 0.79 | 1.20E−02 | 2 | 7 | LBY301 | 0.79 | 1.08E−02 | 2 | 3 |
| LBY302 | 0.75 | 1.97E−02 | 2 | 6 | LBY423 | 0.80 | 9.15E−03 | 2 | 5 |
| LBY423 | 0.88 | 1.57E−03 | 2 | 1 | LBY423 | 0.81 | 8.06E−03 | 2 | 6 |
| LBY423 | 0.77 | 8.81E−03 | 1 | 6 | LBY424 | 0.76 | 1.75E−02 | 2 | 7 |
| LBY424 | 0.72 | 3.03E−02 | 2 | 2 | | | | | |

Table 84. Provided are the correlations (R) between the expression levels of yield improving genes and their homologues in tissues [Leaves or roots; Expression sets (Exp) Table 68] and the phenotypic performance in various biomass, growth rate and/or vigor components [Tables 75-76 using the Correlation vector (corr.) as described in Table 70] under salinity conditions (100 mM NaCl) across Maize accessions.
P = p value.

Example 8

Production of Maize Transcriptome and High Throughput Correlation Analysis when Grown Under Normal and Defoliation Conditions Using 60K Maize Oligonucleotide Micro-Array To produce a high throughput correlation analysis, the present inventors utilized a Maize oligonucleotide micro-array, produced by Agilent Technologies [chem. (dot) agilent (dot) com/Scripts/PDS (dot) asp?lPage=50879]. The array oligonucleotide represents about 60K Maize genes and transcripts designed based on data from Public databases (Example 23). To define correlations between the levels of RNA expression and yield, biomass components or vigor related parameters, various plant characteristics of 13 different Maize hybrids were analyzed under normal and defoliation conditions. Same hybrids were subjected to RNA expression analysis. The correlation between the RNA levels and the characterized parameters was analyzed using Pearson correlation test [davidmlane (dot) com/hyperstat/A34739 (dot) html].

Experimental Procedures 13 maize hybrids lines were grown in 6 repetitive plots, in field. Maize seeds were planted and plants were grown in the field using commercial fertilization and irrigation protocols (normal conditions). After silking 3 plots in every hybrid line the plants underwent the defoliation treatment. In this treatment all the leaves above the ear (about 75% of the total leaves) were removed. After the treatment all the plants were grown according to the same commercial fertilization and irrigation protocols.

Three tissues at flowering developmental (R1) and grain filling (R3) stage including leaf (flowering—R1), stem (flowering—R1 and grain filling—R3), and flowering meristem (flowering—R1) representing different plant characteristics, were sampled from treated and untreated plants. RNA was extracted as described in "GENERAL EXPERIMENTAL AND BIOINFORMATICS METHODS". For convenience, each micro-array expression information tissue type has received a Set ID as summarized in Tables 85-87 below.

TABLE 85

Tissues used for Maize transcriptome expression sets (Under normal conditions)

| Expression Set | Set ID |
|---|---|
| Female meristem at flowering stage under normal conditions | 1 |
| leaf at flowering stage under normal conditions | 2 |
| stem at flowering stage under normal conditions | 3 |
| stem at grain filling stage under normal conditions | 4 |

Table 85: Provided are the identification (ID) numbers of each of the Maize expression sets.

TABLE 86

Tissues used for Maize transcriptome expression sets (Under defoliation treatment)

| Expression Set | Set ID |
|---|---|
| Female meristem at flowering stage under defoliation treatment | 1 |
| Leaf at flowering stage under defoliation treatment | 2 |

TABLE 86-continued

Tissues used for Maize transcriptome expression sets (Under defoliation treatment)

| Expression Set | Set ID |
|---|---|
| Stem at flowering stage under defoliation treatment | 3 |
| Sem at grain filling stage under defoliation treatment | 4 |

Table 86: Provided are the identification (ID) numbers of each of the Maize expression sets.

The image processing system used, which consists of a personal desktop computer (Intel P4 3.0 GHz processor) and a public domain program—ImageJ 1.37, Java based image processing software, was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

The following parameters were collected by imaging.

1000 grain weight—At the end of the experiment all seeds from all plots were collected and weighed and the weight of 1000 was calculated.

Ear Area ($cm^2$)—At the end of the growing period 5 ears were photographed and images were processed using the below described image processing system. The Ear area was measured from those images and was divided by the number of ears.

Ear Length and Ear Width (cm)—At the end of the growing period 6 ears were, photographed and images were processed using the below described image processing system. The Ear length and width (longest axis) was measured from those images and was divided by the number of ears.

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains was weighted, photographed and images were processed using the below described image processing system. The sum of grain lengths/or width (longest axis) was measured from those images and was divided by the number of grains.

Grain Perimeter (cm)—At the end of the growing period the grains were separated from the ear. A sample of ~200 grains was weighted, photographed and images were processed using the below described image processing system. The sum of grain perimeter was measured from those images and was divided by the number of grains.

Ear filled grain area ($cm^2$)—At the end of the growing period 5 ears were photographed and images were processed using the below described image processing system. The Ear area filled with kernels was measured from those images and was divided by the number of Ears.

Filled per Whole Ear—was calculated as the length of the ear with grains out of the total ear.

Additional parameters were collected either by sampling 6 plants per plot or by measuring the parameter across all the plants within the plot.

Cob width [cm]—The diameter of the cob without grains was measured using a ruler.

Ear average weight [kg]—At the end of the experiment (when ears were harvested) total and 6 selected ears per plots were collected. The ears were weighted and the average ear per plant was calculated. The ear weight was normalized using the relative humidity to be 0%.

Plant height and Ear height—Plants were characterized for height at harvesting. In each measure, 6 plants were measured for their height using a measuring tape. Height was measured from ground level to top of the plant below the tassel. Ear height was measured from the ground level to the place where the main ear is located.

Ear row number—The number of rows per ear was counted.

Ear fresh weight per plant (GF)—During the grain filling period (GF) and total and 6 selected ears per plot were collected separately. The ears were weighted and the average ear weight per plant was calculated.

Ears dry weight—At the end of the experiment (when ears were harvested) total and 6 selected ears per plots were collected and weighted. The ear weight was normalized using the relative humidity to be 0%.

Ears fresh weight—At the end of the experiment (when ears were harvested) total and 6 selected ears per plots were collected and weighted.

Ears per plant—number of ears per plant were counted.

Grains weight (Kg.)—At the end of the experiment all ears were collected. Ears from 6 plants from each plot were separately threshed and grains were weighted.

Grains dry weight (Kg.)—At the end of the experiment all ears were collected. Ears from 6 plants from each plot were separately threshed and grains were weighted. The grain weight was normalized using the relative humidity to be 0%.

Grain weight per ear (Kg.)—At the end of the experiment all ears were collected. 5 ears from each plot were separately threshed and grains were weighted. The average grain weight per ear was calculated by dividing the total grain weight by the number of ears.

Leaves area per plant at GF and HD [LAI, leaf area index]=Total leaf area of 6 plants in a plot was measured using a Leaf area-meter at two time points during the course of the experiment; at heading (HD) and during the grain filling period (GF).

Leaves fresh weight at GF and HD—This parameter was measured at two time points during the course of the experiment; at heading (HD) and during the grain filling period (GF). Leaves used for measurement of the LAI were weighted.

Lower stem fresh weight at GF, HD and H—This parameter was measured at three time points during the course of the experiment: at heading (HD), during the grain filling period (GF) and at harvest (H). Lower internodes from at least 4 plants per plot were separated from the plant and weighted.

Lower stem length at GF, HD and H—This parameter was measured at three time points during the course of the experiment; at heading (HD), during the grain filling period (GF) and at harvest (H). Lower internodes from at least 4 plants per plot were separated from the plant and their length was measured using a ruler.

Average internode length—was calculated by dividing plant height by node number per plant.

Lower stem width at GF, HD, and H—This parameter was measured at three time points during the course of the experiment: at heading (HD), during the grain filling period (GF) and at harvest (H). Lower internodes from at least 4 plants per plot were separated from the plant and their diameter was measured using a caliber.

Plant height growth—the relative growth rate (RGR) of Plant Height was calculated as described in Formula 3 above.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Stem fresh weight at GF and HD—This parameter was measured at two time points during the course of the experiment: at heading (HD) and during the grain filling period (GF). Stems of the plants used for measurement of the LAI were weighted.

Total dry matter—Total dry matter was calculated using Formula 21 above.

Upper stem fresh weight at GF, HD and H—This parameter was measured at three time points during the course of the experiment; at heading (HD), during the grain filling period (GF) and at harvest (H). Upper internodes from at least 4 plants per plot were separated from the plant and weighted.

Upper stem length at GF, HD, and H—This parameter was measured at three time points during the course of the experiment; at heading (HD), during the grain filling period (GF) and at harvest (H). Upper internodes from at least 4 plants per plot were separated from the plant and their length was measured using a ruler.

Upper stem width at GF, HD and H (mm)—This parameter was measured at three time points during the course of the experiment; at heading (HD), during the grain filling period (GF) and at harvest (H). Upper internodes from at least 4 plants per plot were separated from the plant and their diameter was measured using a caliber.

Vegetative dry weight (Kg.)—total weight of the vegetative portion of 6 plants (above ground excluding roots) after drying at 70° C. in oven for 48 hours weight by the number of plants.

Vegetative fresh weight (Kg.)—total weight of the vegetative portion of 6 plants (above ground excluding roots).

Node number—nodes on the stem were counted at the heading stage of plant development.

Harvest Index (HI) (Maize)—The harvest index per plant was calculated using Formula 17.

TABLE 87

Maize correlated parameters (vectors) under normal grown conditions and under the treatment of defoliation

| Normal conditions | | Defoliation treatment | |
|---|---|---|---|
| Correlated parameter with | Corr. ID | Correlated parameter with | Corr. ID |
| Vegetative FW (SP) [kg] | 1 | 1000 grains weight [gr.] | 1 |
| Plant height growth [cm/day] | 2 | Avr. internode length [cm] | 2 |
| SPAD (GF) [SPAD unit] | 3 | Cob width [mm] | 3 |
| Stem FW (GF) [gr.] | 4 | Ear Area [cm$^2$] | 4 |
| Stem FW (HD) [gr.] | 5 | Ear avr weight [gr.] | 5 |
| Total dry matter (SP) [kg] | 6 | Ear Filled Grain Area [cm$^2$] | 6 |
| Upper Stem FW (GF) [gr.] | 7 | Ear height [cm] | 7 |
| Upper Stem FW (H) [gr.] | 8 | Ear length (feret's diameter) [cm] | 8 |
| Upper Stem length (GF) [cm] | 9 | Ear row number [num] | 9 |
| Upper Stem length (H) [cm] | 10 | Ear Width [cm] | 10 |
| Upper Stem width (GF) [mm] | 11 | Ears dry weight (SP) [gr.] | 11 |
| Upper Stem width (H) [mm] | 12 | Ears fresh weight (SP) [kg] | 12 |

TABLE 87-continued

Maize correlated parameters (vectors) under normal grown conditions and under the treatment of defoliation

| Normal conditions | | Defoliation treatment | |
|---|---|---|---|
| Correlated parameter with | Corr. ID | Correlated parameter with | Corr. ID |
| Vegetative DW (SP) [kg] | 13 | Ears per plant (SP) [num] | 13 |
| Lower Stem FW (GF) [gr.] | 14 | Filled/Whole Ear [ratio] | 14 |
| Lower Stem FW (H) [gr.] | 15 | Grain area [cm$^2$] | 15 |
| Lower Stem FW (HD) [gr.] | 16 | Grain length [cm] | 16 |
| Lower Stem length (GF) [cm] | 17 | Grain Perimeter [cm] | 17 |
| Lower Stem length (H) [cm] | 18 | Grain width [mm] | 18 |
| Lower Stem length (HD) [cm] | 19 | Grains dry yield (SP) [kg] | 19 |
| Lower Stem width (GF) [mm] | 20 | Grains yield (SP) [kg] | 20 |
| Lower Stem width (H) [mm] | 21 | Grains yield per ear (SP) [kg] | 21 |
| Lower Stem width (HD) [mm] | 22 | Leaves area PP (HD) [cm$^2$] | 23 |
| Node number [num] | 23 | Leaves FW (HD) [gr.] | 24 |
| Plant height [cm] | 24 | Leaves temperature [GF] [° C.] | 25 |
| Ears per plant (SP) [num] | 25 | Lower Stem FW [H] [gr.] | 26 |
| Filled/Whole Ear [ratio] | 26 | Lower Stem FW (HD) [gr.] | 27 |
| Grain area [cm$^2$] | 27 | Lower Stem length [H] [cm] | 28 |
| Grain length [cm] | 28 | Lower Stem length (HD) [cm] | 29 |
| Grain Perimeter [cm] | 29 | Lower Stem width [H] [mm] | 30 |
| Grain width [cm] | 30 | Lower Stem width (HD) [mm] | 31 |
| Grains dry yield (SP) [kg] | 31 | Node number [num] | 32 |
| Grains yield (SP) [kg] | 32 | Plant height [cm] | 33 |
| Grains yield per ear (SP) [kg] | 33 | Plant height growth [cm/day] | 34 |
| Leaves area PP (GF) [cm$^2$] | 34 | SPAD (GF) [SPAD unit] | 35 |
| Leaves area PP (HD) [cm$^2$] | 35 | Stem FW (HD) [gr.] | 36 |
| Leaves FW (GF) [gr.] | 36 | Total dry matter (SP) [kg] | 37 |
| Leaves FW (HD) [gr.] | 37 | Upper Stem FW (H) [gr.] | 38 |
| Leaves temperature (GF) [° C.] | 38 | Upper Stem length (H) [cm] | 39 |
| 1000 grains weight [gr.] | 39 | Upper Stem width (H) [mm] | 40 |
| Cob width [mm] | 40 | Vegetative DW (SP) [kg] | 41 |
| Ear Area [cm$^2$] | 41 | Vegetative FW (SP) [kg] | 42 |
| Ear avr. Weight [gr.] | 42 | Harvest index [ratio] | 42 |
| Ear Filled Grain Area [cm$^2$] | 43 | | |
| Ear height [cm] | 44 | | |
| Ear length [feret's diameter] [cm] | 45 | | |
| Ear row number [num] | 46 | | |
| Ear Width [cm] | 47 | | |
| Ears dry weight (SP) [kg] | 48 | | |
| Ears fresh weight (SP) [kg] | 49 | | |
| Ears FW per plant (GF) [gr./plant] | 50 | | |

Table 87.
"Avr." = Average;
"GF" = grain filling period;
"HD" = heading period;
"H" = harvest;
"FW" = fresh weight;
"DW" = dry weight;
"PP" = per plant;
"SP" = selected plants;
"num" = number;
"kg" = kilogram(s);
"cm" = centimeter(s);
"mm" = millimeter(s).

Thirteen maize varieties were grown, and characterized for parameters, as described above. The average for each of the measured parameters was calculated using the JMP software, and values are summarized in Tables 88-91 below. Subsequent correlation between the various transcriptome sets for all or sub set of lines was done and results were integrated into the database (Tables 92 and 93 below).

TABLE 88

Measured parameters in Maize Hybrid under normal conditions

| Line/Corr. ID | Line-1 | Line-2 | Line-3 | Line-4 | Lin-5 | Line-6 | Line-7 |
|---|---|---|---|---|---|---|---|
| 1 | 3.16 | 2.25 | 2.61 | 2.6 | 2.42 | 2.64 | 2.22 |
| 2 | 5.43 | 5.59 | 6.15 | 5.99 | 6.37 | 6.47 | 4.82 |
| 3 | 59.8 | 53.2 | 53.2 | 54.9 | 54 | 55.2 | 55.4 |
| 4 | 649 | 489.3 | 524.1 | 512.7 | 542.2 | 627.8 | 507.8 |
| 5 | 758.6 | 587.9 | 801.3 | 794.8 | 721.9 | 708.4 | 660.7 |
| 6 | 2.57 | 2.06 | 2.32 | 2.44 | 2.36 | 2.57 | 2.23 |
| 7 | 19.6 | 15.5 | 17.8 | 10.8 | 14.4 | 20.3 | 15.8 |
| 8 | 12.9 | 11.2 | 13 | 6.5 | 8 | 12.1 | 9.7 |
| 9 | 16.6 | 18.8 | 18.4 | 17.9 | 17.6 | 18.8 | 17.1 |
| 10 | 16.9 | 18.8 | 18.7 | 20 | 19.4 | 19.6 | 16.4 |
| 11 | 16 | 14.1 | 13.5 | 11.9 | 13.1 | 14.3 | 15 |
| 12 | 14.9 | 13 | 12.4 | 12 | 12.9 | 13.3 | 13.1 |
| 13 | 1.31 | 0.97 | 1.25 | 1.13 | 1.13 | 1.21 | 1.07 |
| 14 | 35.4 | 25 | 26.5 | 21.7 | 26.1 | 34.4 | 27.6 |
| 15 | 23.5 | 20.3 | 25.1 | 14.2 | 17.5 | 25.7 | 20.6 |
| 16 | 73 | 59.9 | 74.7 | 90.5 | 69.5 | 66.9 | 60.4 |
| 17 | 19.4 | 20.4 | 20.9 | 21.4 | 20 | 20.3 | 18.1 |
| 18 | 16.8 | 20 | 22.6 | 21.7 | 22.3 | 21.4 | 17.1 |
| 19 | 14.5 | 17.8 | 20 | 19.4 | 20.3 | 20.8 | 15 |
| 20 | 19.9 | 16.8 | 16.1 | 16.4 | 17 | 17.5 | 18.1 |
| 21 | 19.4 | 17.2 | 16.1 | 16.9 | 17.5 | 17.9 | 18 |
| 22 | 24.1 | 20.5 | 21 | 24.4 | 21.7 | 19.5 | 23.5 |
| 23 | 15.2 | 14.6 | 14.6 | 14.8 | 15 | 13.8 | 14.3 |
| 24 | 265.1 | 255.9 | 271.1 | 283.9 | 279.7 | 268.8 | 244.2 |
| 25 | 1 | 1.11 | 1 | 1 | 1 | 1.06 | 1 |
| 26 | 0.982 | 0.969 | 0.953 | 0.953 | 0.949 | 0.937 | 0.93 |
| 27 | 0.72 | 0.667 | 0.706 | 0.722 | 0.671 | 0.753 | 0.665 |
| 28 | 1.12 | 1.12 | 1.13 | 1.17 | 1.08 | 1.16 | 1.14 |
| 29 | 3.3 | 3.23 | 3.28 | 3.34 | 3.18 | 3.38 | 3.25 |
| 30 | 0.808 | 0.753 | 0.789 | 0.782 | 0.787 | 0.823 | 0.74 |
| 31 | 0.907 | 0.8 | 0.766 | 0.923 | 0.833 | 0.986 | 0.82 |
| 32 | 1.04 | 0.91 | 0.87 | 1.06 | 0.95 | 1.12 | 0.94 |
| 33 | 0.151 | 0.133 | 0.128 | 0.154 | 0.139 | 0.164 | 0.137 |
| 34 | 7034.6 | 6402.8 | 6353.1 | 6443.9 | 6835.5 | 6507.3 | 7123.5 |
| 35 | 4341.2 | 3171 | 4205.5 | 4347.5 | 3527 | 4517.3 | 3984.8 |
| 36 | 230.1 | 197.6 | 201 | 205.5 | 224.8 | 204.5 | 212.4 |
| 37 | 111 | 80.6 | 157.2 | 128.8 | 100.6 | 111.8 | 116.8 |
| 38 | 33.1 | 33.5 | 33.9 | 34.2 | 33.8 | 32.9 | 33.2 |
| 39 | 296.5 | 263.2 | 303.6 | 304.7 | 281.2 | 330.5 | 290.9 |
| 40 | 24.6 | 25.1 | 23.2 | 23.7 | 22.8 | 22.4 | 23.2 |
| 41 | 82.3 | 74.6 | 77 | 90.2 | 83.8 | 96.6 | 78.4 |
| 42 | 209.5 | 164.6 | 177.4 | 218.5 | 205.6 | 135.8 | 147.5 |
| 43 | 80.9 | 72.4 | 73.4 | 86 | 80.6 | 95 | 74.4 |
| 44 | 121.7 | 134.2 | 149.6 | 152.1 | 143.8 | 133.6 | 118.4 |
| 45 | 22.1 | 19.6 | 20 | 23.2 | 22.6 | 23.7 | 20.3 |
| 46 | 13 | 14.9 | 14.6 | 14.6 | 13.6 | 13.1 | 16.1 |
| 47 | 4.66 | 4.79 | 4.96 | 5 | 4.65 | 4.8 | 4.79 |
| 48 | 1.26 | 1.09 | 1.06 | 1.31 | 1.23 | 1.35 | 1.16 |
| 49 | 1.69 | 1.46 | 1.41 | 1.7 | 1.52 | 1.74 | 1.8 |

TABLE 89

Measured parameters in Maize Hybrid under normal conditions, additional maize lines

| Ecotype/Treatment | Line-8 | Line-9 | Line-10 | Line-11 | Line-12 | Line-13 |
|---|---|---|---|---|---|---|
| 1 | 2.9 | 2.22 | 2.83 | 2.29 | 2.15 | 2.9 |
| 2 | 6.01 | 5.99 | 6.66 | 5.99 | 5.62 | 6.53 |
| 3 | 56.8 | 55.8 | 58.5 | 51.7 | 55.2 | 54.2 |
| 4 | 549.3 | 509.7 | 662.1 | 527.4 | 474.7 | 544 |
| 5 | 724.6 | 618.5 | 837.6 | 612.8 | 728 | 950.3 |
| 6 | 2.73 | 2.33 | 2.4 | 2.2 | 2.08 | 2.84 |
| 7 | 14.4 | 17.8 | 20.4 | 13.9 | 13.1 | 16.5 |
| 8 | 7 | 9.4 | 13.6 | 9.2 | 7.7 | 10.2 |
| 9 | 17.5 | 18.1 | 18.6 | 17.7 | 18.1 | 18.6 |
| 10 | 18.3 | 16.6 | 19.4 | 16.7 | 16.3 | 15.9 |
| 11 | 13.6 | 14.7 | 14.6 | 13.2 | 12.8 | 14.2 |
| 12 | 13.5 | 13.4 | 13.3 | 13.1 | 12.5 | 13.8 |
| 13 | 1.44 | 0.96 | 1.1 | 1.01 | 0.95 | 1.31 |
| 14 | 25.3 | 26.2 | 34.3 | 25.5 | 23.1 | 25.6 |
| 15 | 16.3 | 18.9 | 27.3 | 22.3 | 19.3 | 22.8 |
| 16 | 63.1 | 55.9 | 82.1 | 60 | 58.7 | 116.1 |
| 17 | 20.2 | 19.8 | 22.9 | 19.8 | 19.5 | 21.4 |

TABLE 89-continued

Measured parameters in Maize Hybrid under normal conditions, additional maize lines

| Ecotype/Treatment | Line-8 | Line-9 | Line-10 | Line-11 | Line-12 | Line-13 |
|---|---|---|---|---|---|---|
| 18 | 20.7 | 18.5 | 23.3 | 19.4 | 19.7 | 20 |
| 19 | 18.7 | 20.5 | 22.6 | 19.8 | 14.5 | 20.3 |
| 20 | 17.1 | 16.9 | 17.5 | 16.6 | 17.1 | 17.4 |
| 21 | 18.4 | 17.4 | 18.1 | 17.7 | 17.6 | 18.9 |
| 22 | 21 | 21.5 | 21.4 | 22.1 | 23.2 | 24.3 |
| 23 | 14.7 | 15.4 | 14.3 | 14.4 | 14.9 | 14.4 |
| 24 | 273.6 | 273.2 | 295.3 | 259.2 | 257.9 | 277.2 |
| 25 | 1.06 | 1 | 1 | 1 | 1 | 1 |
| 26 | 0.982 | 0.986 | 0.974 | 0.966 | NA | 0.989 |
| 27 | 0.646 | 0.705 | 0.678 | 0.67 | 0.652 | 0.723 |
| 28 | 1.12 | 1.15 | 1.16 | 1.12 | 1.09 | 1.21 |
| 29 | 3.18 | 3.29 | 3.27 | 3.22 | 3.15 | 3.38 |
| 30 | 0.73 | 0.774 | 0.739 | 0.756 | 0.757 | 0.76 |
| 31 | 0.921 | 1.017 | 0.942 | 0.852 | 0.813 | 1.142 |
| 32 | 1.05 | 1.15 | 1.08 | 0.97 | 0.92 | 1.29 |
| 33 | 0.154 | 0.169 | 0.157 | 0.142 | 0.136 | 0.19 |
| 34 | 6075.2 | 6597.7 | 6030.4 | 6307.1 | 6617.6 | 6848 |
| 35 | 3696.8 | 3926.7 | 3127.7 | 3942.8 | 3955 | 4854 |
| 36 | 181.4 | 199.2 | 206.9 | 168.5 | 199.4 | 200.1 |
| 37 | 106.9 | 86 | 102.7 | 105.7 | 102.1 | 143.1 |
| 38 | 33.7 | 33.8 | 32.6 | 34 | 33.3 | 33.9 |
| 39 | 250.3 | 306.2 | 253.2 | 277 | 269.5 | 274.8 |
| 40 | 24.9 | 26.5 | 23.1 | 22.7 | 23.6 | 26.3 |
| 41 | 93.9 | 96.8 | 85.4 | 76.8 | NA | 98 |
| 42 | 207.1 | 228.4 | 215.9 | 198.7 | 188.5 | 254.4 |
| 43 | 92.3 | 95.4 | 83.3 | 74.3 | NA | 96.9 |
| 44 | 145.2 | 133.8 | 143.7 | 134.2 | 143 | 147.8 |
| 45 | 22.6 | 23.8 | 21.7 | 20 | NA | 22.4 |
| 46 | 15.9 | 14 | 15.4 | 14.9 | 14.9 | 16.8 |
| 47 | 5.18 | 5 | 4.95 | 4.79 | NA | 5.43 |
| 48 | 1.29 | 1.37 | 1.3 | 1.19 | 1.13 | 1.53 |
| 49 | 1.6 | 1.74 | 1.68 | 1.56 | 1.42 | 1.89 |
| 50 | 327.1 | 363.7 | 405.7 | 338.2 | 345.3 | 369.7 |

TABLE 90

Measured parameters in Maize Hybrid under defoliation

| Ecotype/Treatment | Line-1 | Line-2 | Line-3 | Line-4 | Line-5 | Line-6 | Line-7 |
|---|---|---|---|---|---|---|---|
| 1 | 280 | 251.9 | 294.3 | 295.4 | 288.4 | 308.3 | 230.1 |
| 2 | 16.6 | 17.3 | 17.9 | 18.9 | 19.3 | 18.4 | 17.7 |
| 3 | 19 | 22.1 | 16.3 | 21.5 | 19.8 | 18.2 | 19.8 |
| 4 | 53.6 | 45.5 | 38.3 | 58.5 | 53.9 | 63.5 | 39.8 |
| 5 | 89.2 | 100.8 | 73.4 | 129.8 | 129.8 | 115.1 | 85 |
| 6 | 51.5 | 43 | 34.6 | 55.7 | 51.4 | 61.4 | 36.3 |
| 7 | 119.4 | 131.6 | 145.5 | 156.1 | 145.3 | 129.5 | 123.4 |
| 8 | 16.3 | 13.6 | 12.9 | 15.9 | 15.3 | 17.5 | 13.2 |
| 9 | 12.7 | 14.4 | 13 | 14.1 | 13.5 | 13.1 | 14.1 |
| 10 | 4.18 | 4.21 | 3.92 | 4.77 | 4.51 | 4.61 | 4.1 |
| 11 | 0.747 | 0.583 | 0.44 | 0.742 | 0.779 | 0.576 | 0.454 |
| 12 | 0.973 | 0.833 | 0.629 | 0.979 | 1.01 | 0.803 | 0.648 |
| 13 | 1 | 0.944 | 1 | 0.944 | 1 | 0.941 | 0.889 |
| 14 | 0.954 | 0.915 | 0.873 | 0.95 | 0.948 | 0.961 | 0.905 |
| 15 | 0.649 | 0.632 | 0.669 | 0.675 | 0.677 | 0.683 | 0.631 |
| 16 | 1.05 | 1.08 | 1.08 | 1.11 | 1.09 | 1.09 | 1.07 |
| 17 | 3.11 | 3.14 | 3.18 | 3.21 | 3.2 | 3.23 | 3.13 |
| 18 | 0.777 | 0.74 | 0.781 | 0.765 | 0.786 | 0.788 | 0.75 |
| 19 | 0.523 | 0.4 | 0.289 | 0.517 | 0.547 | 0.398 | 0.302 |
| 20 | 0.604 | 0.456 | 0.331 | 0.588 | 0.624 | 0.458 | 0.345 |
| 21 | 0.0871 | 0.0687 | 0.0482 | 0.0902 | 0.0911 | 0.0798 | 0.0564 |
| 22 | 0.338 | 0.281 | 0.206 | 0.334 | 0.349 | 0.256 | 0.225 |
| 23 | 3914 | 3480 | 4276.5 | 4985.5 | 4643.5 | 4223 | 3436 |
| 24 | 112.3 | 95 | 125.1 | 144.5 | 112.5 | 116.2 | 113.8 |
| 25 | 32.5 | 33.1 | 33.6 | 32.3 | 32.9 | 33.4 | 33.4 |
| 26 | 23 | 26.5 | 27 | 15.2 | 18.2 | 37.2 | 27.9 |
| 27 | 64.2 | 53.8 | 56.4 | 81 | 71.3 | 66.7 | 64.2 |
| 28 | 16.3 | 21.4 | 20.9 | 22.6 | 22.9 | 21.6 | 18.8 |
| 29 | 15.2 | 18.5 | 16.7 | 18.1 | 18 | 19.8 | 16.1 |
| 30 | 19.5 | 16.9 | 15.8 | 17 | 17.1 | 18.2 | 18.2 |
| 31 | 24.3 | 20.6 | 21.1 | 24.9 | 20.9 | 20.5 | 21 |

TABLE 90-continued

Measured parameters in Maize Hybrid under defoliation

| Ecotype/Treatment | Line-1 | Line-2 | Line-3 | Line-4 | Line-5 | Line-6 | Line-7 |
|---|---|---|---|---|---|---|---|
| 32 | 15.2 | 14.4 | 15 | 15.1 | 14.5 | 14.2 | 14.4 |
| 33 | 251.4 | 248.6 | 268.1 | 285.1 | 278.8 | 261.9 | 254.6 |
| 34 | 6.38 | 6.32 | 6.31 | 6.93 | 6.83 | 7.14 | 6.48 |
| 35 | 61.2 | 57.4 | 58 | 62.4 | 60.7 | 62.2 | 59.7 |
| 36 | 713.5 | 538 | 705.5 | 803.3 | 703.4 | 664.2 | 673.2 |
| 37 | 1.54 | 1.37 | 1.44 | 1.53 | 1.57 | 1.57 | 1.34 |
| 38 | 8.68 | 11.07 | 14.1 | 4.89 | 6.04 | 13.95 | 10.93 |
| 39 | 16.2 | 18.8 | 17.7 | 19.6 | 20.7 | 20.1 | 17.2 |
| 40 | 14.3 | 12.8 | 12.7 | 11.1 | 12 | 13 | 14.3 |
| 41 | 0.792 | 0.782 | 1 | 0.79 | 0.792 | 0.998 | 0.883 |
| 42 | 2.51 | 1.96 | 2.8 | 2.11 | 2.2 | 2.79 | 2.54 |

TABLE 91

Measured parameters in Maize Hybrid under defoliation, additional maize lines

| Ecotype/Treatment | Line-8 | Line-9 | Line-10 | Line-11 | Line-12 | Line-13 |
|---|---|---|---|---|---|---|
| 1 | 271.3 | 259.4 | 244 | 262.4 | 248.6 | 244.2 |
| 2 | 17.9 | 17.3 | 18.9 | 18.7 | 18.3 | 20 |
| 3 | 22.4 | 20.3 | 19.6 | 22.3 | 23.3 | 27.8 |
| 4 | 47.3 | 65.9 | 43.8 | 43.3 | 52.3 | 58.3 |
| 5 | 33.1 | 161.8 | 89.4 | 87.7 | 88.2 | 124.6 |
| 6 | 43.3 | 64.8 | 39.6 | 40.4 | 49.3 | 55.7 |
| 7 | 135 | 136.5 | 136.4 | 130.3 | 139.7 | 143.4 |
| 8 | 14.8 | 17.6 | 13.8 | 13.7 | 15.5 | 14.9 |
| 9 | 13.8 | 13.9 | 12.8 | 13 | 14.3 | 15.8 |
| 10 | 4.2 | 4.66 | 4.06 | 4.01 | 4.41 | 4.98 |
| 11 | 0.63 | 0.803 | 0.536 | 0.552 | 0.512 | 0.748 |
| 12 | 0.819 | 1.148 | 0.877 | 0.791 | 0.693 | 0.991 |
| 13 | 1 | 0.882 | 1 | 1.056 | 0.944 | 1 |
| 14 | 0.905 | 0.983 | 0.89 | 0.918 | 0.94 | 0.95 |
| 15 | 0.61 | 0.623 | 0.619 | 0.6 | 0.583 | 0.631 |
| 16 | 1.02 | 1.08 | 1.05 | 1.02 | 1 | 1.09 |
| 17 | 3.02 | 3.12 | 3.09 | 3.03 | 2.98 | 3.15 |
| 18 | 0.75 | 0.724 | 0.741 | 0.738 | 0.733 | 0.725 |
| 19 | 0.439 | 0.667 | 0.359 | 0.377 | 0.344 | 0.531 |
| 20 | 0.505 | 0.767 | 0.411 | 0.435 | 0.394 | 0.609 |
| 21 | 0.0731 | 0.1239 | 0.0599 | 0.0628 | 0.0589 | 0.0885 |
| 22 | 0.28 | 0.384 | 0.238 | 0.287 | 0.226 | 0.308 |
| 23 | 4593 | 4315.5 | 4020.5 | 4154 | 4851.5 | 3750 |
| 24 | 93.7 | 89.9 | 87 | 117.3 | 150.7 | 161.6 |
| 25 | 33.4 | 34 | 33.1 | 32.6 | 33.5 | 33.3 |
| 26 | 17.3 | 20.5 | 25.4 | 28.4 | 23.2 | 38.8 |
| 27 | 76.2 | 57.9 | 70 | 67.3 | 72.9 | 83.6 |
| 28 | 20.9 | 17.8 | 20.7 | 20.4 | 20.1 | 24.1 |
| 29 | 14.8 | 17.5 | 23.7 | 19 | 16.4 | 20.6 |
| 30 | 17.2 | 17.9 | 17.1 | 17.5 | 18.6 | 19.9 |
| 31 | 22.5 | 21.2 | 19.8 | 21.3 | 23.6 | 21.4 |
| 32 | 14.7 | 15.6 | 14.4 | 14.1 | 14.6 | 14 |
| 33 | 261.9 | 268.9 | 272.7 | 262.5 | 266.3 | 279.1 |
| 34 | 6.28 | 7.04 | 7.2 | 7.34 | 6.94 | 7.27 |
| 35 | 60 | 56.8 | 65.7 | 57.9 | 60.3 | 57.7 |
| 36 | 738.4 | 692.2 | 619.8 | 729.2 | 794.6 | 847.5 |
| 37 | 1.47 | 1.66 | 1.48 | 1.31 | 1.48 | 1.71 |
| 38 | 6.48 | 9.01 | 10.69 | 10.38 | 8.49 | 12.29 |
| 39 | 19.1 | 16.7 | 16 | 17.3 | 18.2 | 17.8 |
| 40 | 12.8 | 13.5 | 13.1 | 13.4 | 13.2 | 14.7 |
| 41 | 0.844 | 0.86 | 0.94 | 0.762 | 0.964 | 0.967 |
| 42 | 2.48 | 2.35 | 2.59 | 2.41 | 2.7 | 2.72 |

Tables 92 and 93 hereinbelow provide the correlations (R) between the expression levels of the genes of some embodiments of the invention and their homologs in various tissues [Expression (Exp) sets] and the phenotypic performance [yield, biomass, growth rate and/or vigor components as described in Tables 88-91 using the Correlation (Corr.) vector ID described in Table 87]] under normal conditions (Table 92) and defoliation treatment (Table 93) across maize varieties. P=p value.

TABLE 92

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LBY268 | 0.78 | 3.01E−03 | 3 | 25 | LBY268 | 0.78 | 4.86E−03 | 4 | 25 |
| LBY268 | 0.82 | 3.35E−03 | 2 | 45 | LBY323 | 0.83 | 7.54E−04 | 3 | 25 |
| LBY323 | 0.73 | 7.36E−03 | 3 | 10 | LBY323 | 0.77 | 5.99E−03 | 4 | 46 |
| LBY323 | 0.73 | 1.75E−02 | 2 | 45 | LBY327 | 0.75 | 7.29E−03 | 4 | 32 |
| LBY327 | 0.71 | 1.42E−02 | 4 | 48 | LBY327 | 0.78 | 4.57E−03 | 4 | 49 |
| LBY327 | 0.76 | 6.12E−03 | 4 | 16 | LBY327 | 0.84 | 1.31E−03 | 4 | 28 |
| LBY327 | 0.74 | 8.67E−03 | 4 | 29 | LBY327 | 0.74 | 1.49E−02 | 4 | 47 |
| LBY327 | 0.75 | 7.23E−03 | 4 | 33 | LBY327 | 0.75 | 7.23E−03 | 4 | 31 |
| LBY328 | 0.71 | 6.87E−03 | 1 | 42 | LBY328 | 0.82 | 3.55E−03 | 2 | 43 |
| LBY328 | 0.94 | 6.35E−05 | 2 | 45 | LBY328 | 0.83 | 3.13E−03 | 2 | 41 |
| LBY329 | 0.85 | 9.27E−04 | 4 | 25 | LBY373 | 0.86 | 3.22E−04 | 3 | 2 |
| LBY373 | 0.76 | 4.08E−03 | 3 | 19 | LBY373 | 0.88 | 1.85E−04 | 3 | 18 |
| LBY373 | 0.77 | 3.31E−03 | 3 | 24 | LBY373 | 0.71 | 1.04E−02 | 3 | 9 |
| LBY373 | 0.78 | 2.97E−03 | 3 | 44 | LBY373 | 0.90 | 8.07E−05 | 3 | 17 |
| LBY373 | 0.76 | 6.33E−03 | 4 | 46 | LBY373 | 0.70 | 1.61E−02 | 2 | 46 |
| LBY373 | 0.77 | 5.68E−03 | 2 | 5 | LBY373 | 0.74 | 9.48E−03 | 2 | 16 |
| LBY373 | 0.74 | 1.37E−02 | 2 | 47 | LBY375 | 0.74 | 9.06E−03 | 4 | 30 |
| LBY375 | 0.83 | 1.50E−03 | 2 | 5 | LBY375 | 0.82 | 1.94E−03 | 2 | 16 |
| LBY423 | 0.78 | 2.86E−03 | 3 | 18 | LBY423 | 0.71 | 1.02E−02 | 3 | 44 |
| LBY423 | 0.71 | 1.03E−02 | 3 | 10 | LBY423 | 0.85 | 4.92E−04 | 3 | 17 |
| LBY424 | 0.76 | 2.49E−03 | 1 | 14 | LBY424 | 0.79 | 1.31E−03 | 1 | 4 |
| LBY424 | 0.73 | 4.52E−03 | 1 | 3 | LBY424 | 0.79 | 2.12E−03 | 3 | 46 |
| LBY424 | 0.80 | 2.97E−03 | 3 | 47 | LBY424 | 0.77 | 5.29E−03 | 4 | 46 |
| LBY427 | 0.78 | 4.64E−03 | 4 | 28 | LBY426 | 0.80 | 2.84E−03 | 2 | 46 |

Table 92: Provided are the correlations (R) between the genes expression levels in various tissues and the phenotypic performance.
"Corr. ID" — correlation vector ID according to the correlated parameters specified in Table 87.
"Exp. Set"— Expression set specified in Table 85.
"R" = Pearson correlation coefficient;
"P" = p value.

TABLE 93

Correlation between the expression level of selected genes of some embodiments of the invention in various tissues and the phenotypic performance under defoliation treatment across maize varieties

| Gene Name | R | P value | Exp. set | Corr. ID | Gene Name | R | P value | Exp. set | Corr. ID |
|---|---|---|---|---|---|---|---|---|---|
| LBY245 | 0.72 | 8.68E−03 | 2 | 34 | LBY268 | 0.82 | 1.00E−03 | 1 | 34 |
| LBY302 | 0.71 | 1.02E−02 | 3 | 28 | LBY302 | 0.74 | 6.44E−03 | 3 | 27 |
| LBY323 | 0.74 | 6.27E−03 | 1 | 38 | LBY323 | 0.76 | 4.15E−03 | 3 | 13 |
| LBY323 | 0.77 | 3.42E−03 | 2 | 26 | LBY323 | 0.76 | 6.88E−03 | 4 | 38 |
| LBY323 | 0.72 | 1.20E−02 | 4 | 26 | LBY325 | 0.72 | 7.71E−03 | 2 | 25 |
| LBY326 | 0.73 | 7.56E−03 | 3 | 13 | LBY327 | 0.77 | 3.50E−03 | 3 | 39 |
| LBY328 | 0.80 | 1.99E−03 | 1 | 42 | LBY328 | 0.74 | 6.45E−03 | 1 | 41 |
| LBY373 | 0.78 | 2.61E−03 | 3 | 7 | LBY373 | 0.79 | 2.46E−03 | 2 | 41 |
| LBY375 | 0.71 | 9.17E−03 | 1 | 30 | LBY423 | 0.80 | 1.87E−03 | 1 | 41 |
| LBY424 | 0.71 | 9.78E−03 | 3 | 33 | LBY424 | 0.80 | 1.72E−03 | 3 | 27 |
| LBY424 | 0.76 | 4.43E−03 | 3 | 2 | LBY424 | 0.74 | 5.71E−03 | 3 | 34 |
| LBY424 | 0.76 | 6.83E−03 | 4 | 40 | LBY424 | 0.94 | 1.20E−05 | 4 | 30 |
| LBY424 | 0.76 | 6.72E−03 | 4 | 42 | LBY424 | 0.77 | 5.81E−03 | 4 | 26 |
| LGA10 | 0.71 | 1.03E−02 | 1 | 18 | LBY427 | 0.71 | 1.39E−02 | 4 | 26 |

Table 93: Provided are the correlations (R) between the genes expression levels in various tissues and the phenotypic performance.
"Corr. ID"—correlation vector ID according to the correlated parameters specified in Table 87.
"Exp. Set"— Expression set specified in Table 86.
"R" = Pearson correlation coefficient;
"P" = p value.

Example 9

Production of Maize Transcriptome and High Throughput Correlation Analysis with Yield and NUE Related Parameters Using 60K Maize Oligonucleotide Micro-Arrays In order to produce a high throughput correlation analysis between plant phenotype and gene expression level, the present inventors utilized a maize oligonucleotide microarray, produced by Agilent Technologies [chem. (dot) agilent (dot) com/Scripts/PDS (dot) asp?lPage=50879]. The array oligonucleotide represents about 60,000 maize genes and transcripts.

Correlation of Maize Hybrids Across Ecotypes Grown Under Low Nitrogen Conditions

Experimental Procedures

12 Maize hybrids were grown in 3 repetitive plots in field. Maize seeds were planted and plants were grown in the field using commercial fertilization and irrigation protocols, which included 485 m³ water per dunam per entire growth period and fertilization of 30 units of nitrogen (using URAN® 21% fertilization) per dunam per entire growth period (normal conditions) or under low nitrogen conditions which included 50% percent less Nitrogen as compared to the amount of nitrogen (N) provided under the normal conditions. In order to define correlations between the levels of RNA expression with NUE and yield components or vigor related parameters the 12 different maize hybrids were analyzed. Among them, 11 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Analyzed Maize tissues—All 10 selected maize hybrids were sampled per each treatment (low N and normal conditions), in three time points [TP2=V6-V8 (six to eight collar leaf are visible, rapid growth phase and kernel row determination begins), TP5=R1-R2 (silking-blister), TP6=R3-R4 (milk-dough)]. Four types of plant tissues [Ear, "flag leaf" indicated in Table as "leaf", grain distal part, and internode] were sampled and RNA was extracted as described above. Each micro-array expression information tissue type has received a Set ID as summarized in Tables 94-95 below.

TABLE 94

Maize transcriptome expression sets under low nitrogen conditions

| Expression Set | Set ID |
|---|---|
| Ear under low nitrogen conditions at reproductive stage: R1-R2 | 1 |
| Ear under low nitrogen conditions at reproductive stage: R3-R4 | 2 |
| Internode under low nitrogen conditions at vegetative stage: V6-V8 | 3 |
| Internode under low nitrogen conditions at reproductive stage: R1-R2 | 4 |
| Internode under low nitrogen conditions at reproductive stage: R3-R4 | 5 |
| Leaf under low nitrogen conditions at vegetative stage: V6-V8 | 6 |
| Leaf under low nitrogen conditions at reproductive stage: R1-R2 | 7 |
| Leaf under low nitrogen conditions at reproductive stage: R3-R4 | 8 |

Table 94: Provided are the maize transcriptome expression sets under low nitrogen conditions Leaf = the leaf below the main ear; Flower meristem = Apical meristem following male flower initiation; Ear = the female flower at the anthesis day. Grain Distal = maize developing grains from the cob extreme area, Grain Basal = maize developing grains from the cob basal area; Internodes = internodes located above and below the main ear in the plant.

TABLE 95

Maize transcriptome expression sets under normal growth conditions

| Expression Set | Set ID |
|---|---|
| Ear at R1-R2 stage under normal conditions | 1 |
| Grain distal at R4-R5 stage under normal conditions | 2 |
| Internode at R3-R4 stage under normal conditions | 3 |
| Leaf at R1-R2 stage under normal conditions | 4 |
| Ear at R3-R4 stage under normal conditions | 5 |
| Internode at R1-R2 stage under normal conditions | 6 |
| Internode at V6-V8 stage under normal conditions | 7 |
| Leaf at V6-V8 stage under normal conditions | 8 |

Table 95: Provided are the maize transcriptome expression sets under normal growth conditions. Leaf = the leaf below the main ear; Flower meristem = Apical meristem following male flower initiation; Ear = the female flower at the anthesis day. Grain Distal = maize developing grains from the cob extreme area, Grain Basal = maize developing grains from the cob basal area; Internodes = internodes located above and below the main ear in the plant.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were photographed and images were processed using the below described image processing system. The Ear area was measured from those images and was divided by the number of Ears.

Ear Length and Ear Width (cm)—At the end of the growing period 5 ears were photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place where the main ear is located.

Leaf number per plant—Plants were characterized for leaf number during growing period at 5 time points. In each measure, plants were measured for their leaf number by counting all the leaves of 3 selected plants per plot.

Relative Growth Rate was calculated using Formulas 2-13, 28, and/or 34 (described above).

SPAD—Chlorophyll content was determined using a Minolta SPAD 502 chlorophyll meter and measurement was performed at early stages of grain filling (R1-R2) and late stage of grain filling (R3-R4). SPAD meter readings were done on young fully developed leaf. Three measurements per leaf were taken per plot. Data were taken after 46 and 54 days after sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index per plant was calculated using Formula 17 above.

Percent Filled Ear [%]—The percent of filled ear was calculated as the percentage of the Ear area with grains out of the total ear.

Cob diameter [cm]—The diameter of the cob without grains was measured using a ruler.

Kernel Row Number per Ear—The number of rows in each ear was counted.

Experimental Results 11 different maize hybrids were grown and characterized for different parameters. Tables 94-95 describe the Maize expression sets, and Tables 96-97 below describe the Maize correlated parameters. The average for each of the measured parameters was calculated using the JMP software (Tables 98-101) and a subsequent correlation analysis was performed (Table 102-103). Results were then integrated to the database.

TABLE 96

Maize correlated parameters (vectors) under low nitrogen conditions

| Correlated parameter with | Correlation ID |
|---|---|
| Final Plant DW under Low N conditions [kg] | 1 |
| Ears weight per plot under Low N conditions [kg] | 2 |
| seed yield per plant under Low N conditions [kg] | 3 |
| Seed yield per dunam under Low N conditions [kg] | 4 |
| Final Plant Height under Low N conditions [cm] | 5 |
| Final Main Ear Height under Low N conditions [cm] | 6 |
| Final Leaf Number under Low N conditions [num] | 7 |
| Stalk width at TP5 under Low N conditions [mm] | 8 |
| Ear Length under Low N conditions [cm] | 9 |

TABLE 96-continued

Maize correlated parameters (vectors) under low nitrogen conditions

| Correlated parameter with | Correlation ID |
|---|---|
| Ear width under Low N conditions [mm] | 10 |
| Ear Length of filled area under Low N conditions [cm] | 11 |
| No of rows per ear under Low N conditions [num] | 12 |
| SPAD at R1-R2 under Low N conditions [SPAD unit] | 13 |
| SPAD at R3-R4 under Low N conditions [SPAD unit] | 14 |
| NUE yield/N applied in soil under Low N conditions [ratio] | 15 |
| NUE at grain filling (R3-R4) yield [kg]/N in plant per SPAD under Low N conditions | 16 |
| NUE at early grain filling (R1-R2) yield [kg]/N in plant per SPAD under Low N conditions | 17 |
| Yield/stalk width under Low N conditions [ratio] | 18 |
| NUpE under Low N conditions [biomass/N applied] | 19 |
| Final Leaf Area under Low N conditions [number] | 20 |
| Yield/LAI under Low N conditions [ratio] | 21 |

Table 96.
"cm" = centimeters'
"mm" = millimeters;
"kg" = kilograms; SPAD at R1-R2 and SPAD R3-R4: Chlorophyll level after early and late stages of grain filling;
"NUE" = nitrogen use efficiency;
"NUpE" = nitrogen uptake efficiency;
"LAI" = leaf area;
"N" = nitrogen; Low N = under low Nitrogen conditions;
"Normal" = under normal conditions;
"dunam" = 1000 m².
"num" = number.

TABLE 97

Maize correlated parameters (vectors) under normal conditions

| Correlated parameter with | Corr. ID |
|---|---|
| Yield/LAI under Normal conditions [ratio] | 1 |
| Final Plant DW under Normal conditions [kg] | 2 |
| Ears weight per plot under Normal conditions [kg] | 3 |
| Seed yield per plant under Normal conditions [kg] | 4 |
| Seed yield per dunam [kg] under Normal conditions [kg] | 5 |
| Final Plant Height under Normal conditions [cm] | 6 |
| Final Main Ear Height under Normal conditions [cm] | 7 |
| Final Leaf Number under Normal conditions [num] | 8 |
| Stalk width at TP5 under Normal conditions [cm] | 9 |
| Ear Length under Normal conditions [cm] | 10 |
| Ear width under Normal conditions [mm] | 11 |
| Ear Length of filled area under Normal conditions [cm] | 12 |
| No of rows per ear under Normal conditions [num] | 13 |
| SPAD at R3-R4 under Normal conditions [SPAD unit] | 14 |
| NUE yield/N applied in soil under Normal conditions [ratio] | 15 |
| NUE at grain filling [R3-R4] yield [kg]/N in plant per SPAD under Normal conditions [ratio] | 16 |
| NUE at early grain filling [R1-R2] yield [kg]/N in plant per SPAD under Normal conditions [ratio] | 17 |
| Yield/stalk width under Normal conditions [ratio] | 18 |
| NUpE under Normal conditions [biomass/N applied] | 19 |
| Final Leaf Area under Normal conditions [number] | 20 |

Table 97.
"cm" = centimeters'
"mm" = millimeters;
"kg" = kilograms; SPAD at R1-R2 and SPAD R3-R4: Chlorophyll level after early and late stages of grain filling;
"NUE" = nitrogen use efficiency;
"NUpE" = nitrogen uptake efficiency;
"LAI" = leaf area;
"N" = nitrogen; Low N = under low Nitrogen conditions;
"Normal" = under normal conditions;
"dunam" = 1000 m².
"num" = number.

TABLE 98

Measured parameters in Maize accessions under Low nitrogen conditions

| Line/Corr. ID | Line-1 | Line-2 | Line-3 | Line-4 | Line-5 | Line-6 |
|---|---|---|---|---|---|---|
| 1 | 1.59 | 1.43 | 1.53 | 1.95 | 1.48 | 1.6 |
| 2 | 6.61 | 7.97 | 9.63 | 9.22 | 7.63 | 7.21 |
| 3 | 0.135 | 0.158 | 0.194 | 0.187 | 0.143 | 0.145 |
| 4 | 1083.7 | 1261.6 | 1549.2 | 1497.9 | 1143.9 | 1159.3 |
| 5 | 305.8 | 270.9 | 290.6 | 252.2 | 260.2 | 227.2 |
| 6 | 158.1 | 136.2 | 128.4 | 133.1 | 137.8 | 99.6 |
| 7 | 15 | 11.6 | 13.5 | 11.6 | 11.8 | 11.9 |
| 8 | 2.76 | 2.42 | 2.65 | 2.77 | 2.67 | 2.59 |
| 9 | 20.6 | 21 | 20.2 | 20.1 | 20.1 | 18.5 |
| 10 | 46.7 | 48.2 | 48.3 | 49.9 | 52.9 | 47.4 |
| 11 | 18.4 | 18.4 | 19.8 | 18.8 | 16.2 | 16 |
| 12 | 14.2 | 15.2 | 15 | 15.7 | 16 | 15.9 |
| 13 | 60.2 | 57.9 | 58.8 | 59.5 | 58.5 | 64 |
| 14 | 59.3 | 57.6 | 58.4 | 59.2 | 58.2 | 62.7 |
| 15 | 7.22 | 8.41 | 10.33 | 9.99 | 7.63 | 7.73 |
| 16 | 18.4 | 21.9 | 26.5 | 25.3 | 19.7 | 18.5 |
| 17 | 18 | 21.8 | 26.3 | 25.1 | 19.5 | 18 |
| 18 | 416.5 | 528.4 | 583.5 | 541 | 428.1 | 444.3 |
| 19 | 0.0106 | 0.0095 | 0.0102 | 0.013 | 0.0099 | 0.0107 |
| 20 | 2.92 | 3.15 | 3.33 | 2.87 | 2.79 | 3.76 |
| 21 | 341.5 | 408.1 | 464.8 | 522.3 | 439.5 | 312.6 |

Table 98: Provided are the values of each of the parameters (as described above) measured in maize accessions (line) under low nitrogen growth conditions. Growth conditions are specified in the experimental procedure section.

TABLE 99

Additional parameters in Maize accessions under Low nitrogen conditions

| Line/Corr. ID | Line-7 | Line-8 | Line-9 | Line-10 | Line-11 |
|---|---|---|---|---|---|
| 1 | 1.58 | 1.28 | 1.51 | 0.43 | 1.52 |
| 2 | 7.92 | 28.96 | 7.8 | 2.41 | 9.78 |
| 3 | 0.151 | 0.156 | 0.143 | 0.048 | 0.199 |
| 4 | 1207.4 | 1250.1 | 1146 | 383.2 | 1589.9 |
| 5 | 271.7 | 248.6 | 279.3 | 171.3 | 269.8 |
| 6 | 130.2 | 114.6 | 143.9 | 61.6 | 114.4 |
| 7 | 12.6 | 11.7 | 12.4 | 9.3 | 13.2 |
| 8 | 2.98 | 2.61 | 2.65 | 2.28 | 2.82 |
| 9 | 19.1 | 18.2 | 20.1 | 17.8 | 21.2 |
| 10 | 49.6 | 48.6 | 52.4 | 42.6 | 50 |
| 11 | 15.3 | 15.7 | 16.8 | 14.1 | 19.6 |
| 12 | 15.6 | 14.5 | 16.4 | 14.4 | 15.7 |
| 13 | 56.4 | 60 | 58.3 | 53.1 | 61.7 |
| 14 | 61 | 59.9 | 57.5 | 49.6 | 61.9 |
| 15 | 8.05 | 8.33 | 7.64 | 2.55 | 10.6 |
| 16 | 19.8 | 20.9 | 19.9 | 7.7 | 25.9 |
| 17 | 21.4 | 20.8 | 19.7 | 7.2 | 25.7 |
| 18 | 407.2 | 477.4 | 445.6 | 167.9 | 562.3 |
| 19 | 0.0106 | 0.0086 | 0.0101 | 0.0029 | 0.0101 |
| 20 | 3.5 | 5.02 | | | 3.16 |
| 21 | 345.9 | 287.7 | | | 501.2 |

Table 99. Provided are the values of each of the parameters (as described above) measured in maize accessions (line) under low nitrogen growth conditions. Growth conditions are specified in the experimental procedure section.

TABLE 100

Measured parameters in Maize accessions under normal growth conditions

| Line/Corr. ID | Line-1 | Line-2 | Line-3 | Line-4 | Line-5 | Line-6 |
|---|---|---|---|---|---|---|
| 1 | 426.1 | 313 | 307.3 | 362.4 | 314.1 | 224.6 |
| 2 | 1.27 | 1.3 | 1.33 | 1.5 | 1.3 | 1.58 |
| 3 | 8.94 | 7.02 | 7.53 | 7.99 | 8.48 | 5.63 |
| 4 | 0.167 | 0.136 | 0.15 | 0.159 | 0.15 | 0.117 |
| 5 | 1335.6 | 1087.1 | 1202.5 | 1271.2 | 1203 | 937.1 |
| 6 | 273.5 | 260.5 | 288 | 238.5 | 286.9 | 224.8 |
| 7 | 130.3 | 122.3 | 127.7 | 113 | 135.3 | 94.3 |
| 8 | 11.8 | 11.1 | 13.3 | 11.8 | 11.9 | 12.3 |
| 9 | 2.91 | 2.64 | 2.71 | 2.9 | 2.7 | 2.62 |
| 10 | 19.9 | 20.2 | 18.1 | 19.9 | 19.5 | 17.7 |
| 11 | 51.1 | 46.3 | 45.9 | 47.6 | 51.4 | 47.4 |
| 12 | 16.2 | 17.5 | 17.7 | 18.4 | 15.7 | 14.7 |
| 13 | 16.1 | 14.7 | 15.4 | 15.9 | 16.2 | 15.2 |
| 14 | 59.9 | 60.9 | 56.9 | 58.7 | 58.7 | 63.2 |
| 15 | 4.45 | 3.62 | 4.01 | 4.24 | 4.01 | 3.12 |
| 16 | 25 | 17.8 | 20.3 | 20 | 19 | 13.9 |
| 17 | 23.4 | 19.1 | 20.3 | 20.7 | 20.5 | 15.4 |
| 18 | 456.7 | 412.4 | 443.4 | 438.7 | 446.7 | 357 |

TABLE 100-continued

Measured parameters in Maize accessions under normal growth conditions

| Line/Corr. ID | Line-1 | Line-2 | Line-3 | Line-4 | Line-5 | Line-6 |
|---|---|---|---|---|---|---|
| 19 | 0.0084 | 0.0087 | 0.0089 | 0.01 | 0.0087 | 0.0106 |
| 20 | 3.21 | 3.95 | 3.33 | 4.01 | 3.86 | 4.19 |

Table 100: Provided are the values of each of the parameters (as described above) measured in maize accessions (line) under normal growth conditions. Growth conditions are specified in the experimental procedure section.

TABLE 101

Additional measured parameters in Maize accessions under normal growth conditions

| Line/Corr. ID | Line-7 | Line-8 | Line-9 | Line-10 | Line-11 |
|---|---|---|---|---|---|
| 1 | 266.4 | 261.7 | | | 482.3 |
| 2 | 1.42 | 1.37 | 1.7 | 0.42 | 11.38 |
| 3 | 6.1 | 6.66 | 8.21 | 1.88 | 8.4 |
| 4 | 0.123 | 0.131 | 0.153 | 0.038 | 0.171 |
| 5 | 985.9 | 1050.1 | 1226.1 | 300.9 | 1365.3 |
| 6 | 264.4 | 251.6 | 279 | 163.8 | 278.4 |
| 7 | 120.9 | 107.7 | 139.7 | 60.4 | 112.5 |
| 8 | 12.4 | 12.2 | 11.7 | 9.3 | 12.6 |
| 9 | 2.92 | 2.72 | 2.66 | 2.26 | 2.84 |
| 10 | 17.7 | 17.3 | 17.5 | 19.9 | 20.5 |
| 11 | 47.3 | 46.8 | 48.3 | 41.8 | 49.3 |
| 12 | 12.9 | 14 | 12.3 | 16.1 | 18.8 |
| 13 | 16 | 14.8 | 17.7 | 14.3 | 15.4 |
| 14 | 59.8 | 62.4 | 57.2 | 49.3 | 61.9 |
| 15 | 3.29 | 3.5 | 4.09 | 1 | 4.55 |
| 16 | 16.2 | 17.2 | 21.5 | 5.5 | 21 |
| 17 | 16.4 | 17.2 | 21 | 5.7 | 22 |
| 18 | 337.5 | 385.8 | 471.6 | 139.7 | 481.9 |
| 19 | 0.0094 | 0.0091 | 0.0038 | 0.0028 | 0.0759 |
| 20 | 3.97 | 4.32 | 4.31 | | 2.89 |

Table 101. Provided are the values of each of the parameters (as described above) measured in maize accessions (line) under normal growth conditions. Growth conditions are specified in the experimental procedure section.

TABLE 102

Correlation between the expression level of selected genes of some embodiments of the invention in various tissues and the phenotypic performance under low nitrogen conditions across maize accession

| Gene Name | R | P value | Exp. set | Corr. ID | Gene Name | R | P value | Exp. set | Corr. ID |
|---|---|---|---|---|---|---|---|---|---|
| LBY244 | 0.76 | 4.58E−02 | 1 | 10 | LBY244 | 0.74 | 5.94E−02 | 1 | 6 |
| LBY244 | 0.71 | 1.14E−01 | 6 | 18 | LBY244 | 0.96 | 2.95E−03 | 6 | 9 |
| LBY244 | 0.78 | 6.45E−02 | 6 | 11 | LBY244 | 0.77 | 7.24E−02 | 6 | 21 |
| LBY244 | 0.71 | 4.82E−02 | 8 | 9 | LBY244 | 0.78 | 4.02E−02 | 7 | 21 |
| LBY245 | 0.75 | 3.25E−02 | 7 | 9 | LBY268 | 0.77 | 2.52E−02 | 8 | 12 |
| LBY301 | 0.87 | 1.08E−02 | 1 | 8 | LBY302 | 0.75 | 5.21E−02 | 1 | 19 |
| LBY302 | 0.85 | 1.52E−02 | 1 | 10 | LBY302 | 0.78 | 3.69E−02 | 1 | 8 |
| LBY302 | 0.71 | 7.13E−02 | 1 | 17 | LBY302 | 0.83 | 2.14E−02 | 1 | 6 |
| LBY302 | 0.75 | 5.21E−02 | 1 | 1 | LBY302 | 0.77 | 2.61E−02 | 2 | 19 |
| LBY302 | 0.77 | 2.61E−02 | 2 | 1 | LBY302 | 0.79 | 3.40E−02 | 4 | 13 |
| LBY323 | 0.74 | 5.62E−02 | 1 | 10 | LBY323 | 0.90 | 5.63E−03 | 1 | 8 |
| LBY323 | 0.88 | 2.03E−02 | 6 | 6 | LBY323 | 0.87 | 2.29E−02 | 6 | 5 |
| LBY323 | 0.77 | 2.56E−02 | 2 | 19 | LBY323 | 0.77 | 2.56E−02 | 2 | 1 |
| LBY323 | 0.79 | 3.45E−02 | 4 | 13 | LBY323 | 0.73 | 6.44E−02 | 4 | 19 |
| LBY323 | 0.73 | 6.44E−02 | 4 | 1 | LBY325 | 0.80 | 5.60E−02 | 6 | 20 |
| LBY325 | 0.76 | 8.24E−02 | 6 | 2 | LBY326 | 0.77 | 4.29E−02 | 1 | 8 |
| LBY326 | 0.98 | 4.73E−04 | 6 | 20 | LBY326 | 0.88 | 1.95E−02 | 6 | 2 |
| LBY326 | 0.70 | 7.93E−02 | 8 | 21 | LBY326 | 0.75 | 5.12E−02 | 7 | 20 |
| LBY327 | 0.70 | 7.98E−02 | 1 | 9 | LBY327 | 0.75 | 3.37E−02 | 7 | 8 |
| LBY328 | 0.86 | 2.85E−02 | 6 | 3 | LBY328 | 0.76 | 7.99E−02 | 6 | 16 |
| LBY328 | 0.72 | 1.07E−01 | 6 | 17 | LBY328 | 0.86 | 2.85E−02 | 6 | 4 |
| LBY328 | 0.86 | 2.85E−02 | 6 | 15 | LBY328 | 0.78 | 4.01E−02 | 7 | 20 |
| LBY328 | 0.73 | 3.78E−02 | 7 | 2 | LBY328 | 0.75 | 5.25E−02 | 2 | 20 |
| LBY328 | 0.93 | 2.26E−03 | 4 | 20 | LBY328 | 0.90 | 6.16E−03 | 4 | 2 |
| LBY329 | 0.90 | 6.48E−03 | 1 | 8 | LBY373 | 0.87 | 1.13E−02 | 1 | 8 |
| LBY373 | 0.88 | 2.14E−02 | 6 | 6 | LBY373 | 0.84 | 1.75E−02 | 4 | 13 |
| LBY374 | 0.82 | 2.53E−02 | 1 | 8 | LBY374 | 0.71 | 7.63E−02 | 1 | 17 |
| LBY374 | 0.75 | 5.38E−02 | 1 | 7 | LBY375 | 0.74 | 9.52E−02 | 1 | 21 |
| LBY375 | 0.73 | 1.71E−02 | 3 | 13 | LBY375 | 0.83 | 2.95E−03 | 3 | 3 |
| LBY375 | 0.80 | 5.05E−03 | 3 | 16 | LBY375 | 0.78 | 8.37E−03 | 3 | 17 |
| LBY375 | 0.71 | 2.09E−02 | 3 | 14 | LBY375 | 0.84 | 2.26E−03 | 3 | 18 |
| LBY375 | 0.83 | 2.95E−03 | 3 | 4 | LBY375 | 0.83 | 2.95E−03 | 3 | 15 |
| LBY375 | 0.74 | 5.69E−02 | 4 | 13 | LBY423 | 0.84 | 3.62E−02 | 1 | 21 |
| LBY423 | 0.95 | 3.53E−03 | 6 | 6 | LBY423 | 0.75 | 8.50E−02 | 6 | 5 |
| LBY423 | 0.73 | 3.78E−02 | 7 | 8 | LBY423 | 0.74 | 3.48E−02 | 2 | 14 |
| LBY423 | 0.75 | 5.23E−02 | 2 | 20 | LBY423 | 0.74 | 5.59E−02 | 4 | 16 |
| LBY423 | 0.76 | 4.89E−02 | 4 | 6 | LBY423 | 0.73 | 6.51E−02 | 4 | 18 |
| LBY423 | 0.70 | 7.88E−02 | 4 | 11 | LBY424 | 0.74 | 9.11E−02 | 1 | 21 |
| LBY424 | 0.75 | 8.60E−02 | 6 | 13 | LBY424 | 0.75 | 8.57E−02 | 6 | 10 |

TABLE 102-continued

Correlation between the expression level of selected genes of some embodiments of the invention in various tissues and the phenotypic performance under low nitrogen conditions across maize accession

| Gene Name | R | P value | Exp. set | Corr. ID | Gene Name | R | P value | Exp. set | Corr. ID |
|---|---|---|---|---|---|---|---|---|---|
| LBY424 | 0.77 | 7.38E−02 | 6 | 8 | LBY424 | 0.85 | 3.36E−02 | 6 | 14 |
| LBY424 | 0.85 | 3.18E−02 | 6 | 12 | LBY424 | 0.73 | 3.78E−02 | 7 | 2 |
| LBY424 | 0.88 | 8.98E−03 | 4 | 6 | LBY426 | 0.78 | 3.97E−02 | 1 | 10 |
| LBY426 | 0.81 | 2.77E−02 | 1 | 3 | LBY426 | 0.70 | 7.86E−02 | 1 | 8 |
| LBY426 | 0.85 | 1.65E−02 | 1 | 16 | LBY426 | 0.90 | 5.99E−03 | 1 | 6 |
| LBY426 | 0.85 | 1.60E−02 | 1 | 17 | LBY426 | 0.84 | 1.72E−02 | 1 | 18 |
| LBY426 | 0.83 | 2.02E−02 | 1 | 5 | LBY426 | 0.81 | 2.77E−02 | 1 | 4 |
| LBY426 | 0.76 | 4.53E−02 | 1 | 9 | LBY426 | 0.81 | 2.77E−02 | 1 | 15 |
| LBY426 | 0.73 | 6.18E−02 | 1 | 11 | LBY426 | 0.72 | 1.83E−02 | 3 | 6 |
| LBY426 | 0.73 | 1.61E−02 | 3 | 10 | LBY426 | 0.79 | 1.91E−02 | 7 | 8 |
| LBY426 | 0.84 | 2.15E−03 | 3 | 9 | LBY426 | 0.83 | 1.01E−02 | 2 | 1 |
| LBY426 | 0.83 | 1.01E−02 | 2 | 19 | LBY427 | 0.70 | 7.86E−02 | 4 | 20 |
| LBY427 | 0.84 | 4.56E−03 | 5 | 13 | LGA10 | 0.97 | 2.93E−04 | 1 | 3 |
| LGA10 | 0.86 | 1.38E−02 | 1 | 19 | LGA10 | 0.99 | 3.97E−05 | 1 | 16 |
| LGA10 | 0.84 | 1.90E−02 | 1 | 10 | LGA10 | 0.89 | 6.96E−03 | 1 | 6 |
| LGA10 | 0.98 | 1.42E−04 | 1 | 17 | LGA10 | 0.96 | 7.78E−04 | 1 | 18 |
| LGA10 | 0.88 | 9.04E−03 | 1 | 5 | LGA10 | 0.97 | 2.93E−04 | 1 | 4 |
| LGA10 | 0.79 | 3.27E−02 | 1 | 9 | LGA10 | 0.86 | 1.38E−02 | 1 | 1 |
| LGA10 | 0.82 | 2.44E−02 | 1 | 7 | LGA10 | 0.94 | 5.77E−03 | 1 | 21 |
| LGA10 | 0.91 | 4.55E−03 | 1 | 11 | LGA10 | 0.83 | 3.14E−03 | 3 | 9 |
| LGA10 | 0.97 | 2.93E−04 | 1 | 15 | LGA10 | 0.81 | 1.46E−02 | 2 | 19 |
| LGA10 | 0.75 | 1.24E−02 | 3 | 11 | LGA10 | 0.81 | 1.46E−02 | 2 | 1 |
| LGA10 | 0.77 | 2.64E−02 | 2 | 6 | LGA10 | 0.75 | 5.11E−02 | 4 | 17 |
| LGA10 | 0.70 | 7.79E−02 | 4 | 16 | LGA10 | 0.73 | 6.06E−02 | 4 | 7 |
| LGA10 | 0.74 | 5.95E−02 | 4 | 5 | | | | | |
| LYD959 | 0.83 | 2.03E−02 | 1 | 8 | | | | | |

Table 102: Correlations (R) between the genes expression levels in various tissues (Table 94) and the phenotypic performance under low nitrogen conditions.
"Corr. ID"— correlation set ID according to the correlated parameters described in Table 96 above.
"Exp. Set"— Expression set.
"R" = Pearson correlation coefficient;
"P" = p value.

TABLE 103

Correlation between the expression level of selected genes of some embodiments of the invention in various tissues and the phenotypic performance under normal conditions across maize accessions

| Gene Name | R | P value | Exp. set | Corr. ID | Gene Name | R | P value | Exp. set | Corr. ID |
|---|---|---|---|---|---|---|---|---|---|
| LBY244 | 0.71 | 7.59E−02 | 1 | 7 | LBY244 | 0.78 | 6.79E−02 | 5 | 9 |
| LBY244 | 0.94 | 4.68E−03 | 5 | 13 | LBY244 | 0.71 | 4.85E−02 | 2 | 4 |
| LBY244 | 0.79 | 1.85E−02 | 2 | 3 | LBY244 | 0.71 | 4.85E−02 | 2 | 5 |
| LBY244 | 0.71 | 4.85E−02 | 2 | 15 | LBY244 | 0.80 | 1.65E−02 | 2 | 13 |
| LBY244 | 0.87 | 5.04E−03 | 2 | 11 | LBY244 | 0.72 | 6.98E−02 | 4 | 12 |
| LBY244 | 0.82 | 4.54E−02 | 4 | 1 | LBY244 | 0.74 | 3.75E−02 | 3 | 9 |
| LBY244 | 0.72 | 4.42E−02 | 7 | 20 | LBY245 | 0.72 | 6.63E−02 | 6 | 2 |
| LBY245 | 0.72 | 6.63E−02 | 6 | 19 | LBY268 | 0.78 | 6.96E−02 | 5 | 8 |
| LBY268 | 0.75 | 3.35E−02 | 2 | 2 | LBY268 | 0.75 | 3.35E−02 | 2 | 19 |
| LBY268 | 0.75 | 2.13E−02 | 8 | 20 | LBY268 | 0.86 | 5.81E−03 | 3 | 20 |
| LBY301 | 0.96 | 4.43E−04 | 1 | 14 | LBY301 | 0.73 | 9.71E−02 | 1 | 20 |
| LBY301 | 0.73 | 6.06E−02 | 1 | 11 | LBY301 | 0.84 | 3.78E−02 | 5 | 9 |
| LBY301 | 0.96 | 1.90E−03 | 5 | 13 | LBY301 | 0.73 | 4.02E−02 | 2 | 4 |
| LBY301 | 0.81 | 1.59E−02 | 2 | 3 | LBY301 | 0.73 | 4.02E−02 | 2 | 5 |
| LBY301 | 0.72 | 4.41E−02 | 2 | 18 | LBY301 | 0.73 | 4.02E−02 | 2 | 15 |
| LBY302 | 0.89 | 6.73E−03 | 1 | 4 | LBY302 | 0.89 | 6.76E−03 | 1 | 3 |
| LBY302 | 0.75 | 5.41E−02 | 1 | 7 | LBY302 | 0.89 | 6.73E−03 | 1 | 5 |
| LBY302 | 0.72 | 6.63E−02 | 1 | 6 | LBY302 | 0.89 | 7.27E−03 | 1 | 18 |
| LBY302 | 0.89 | 7.10E−03 | 1 | 9 | LBY302 | 0.89 | 6.73E−03 | 1 | 15 |
| LBY302 | 0.94 | 1.86E−03 | 1 | 14 | LBY302 | 0.88 | 8.13E−03 | 1 | 17 |
| LBY302 | 0.94 | 1.67E−03 | 1 | 11 | LBY302 | 0.84 | 1.68E−02 | 1 | 16 |
| LBY302 | 0.79 | 1.93E−02 | 2 | 11 | LBY302 | 0.86 | 6.39E−03 | 3 | 2 |
| LBY302 | 0.86 | 6.39E−03 | 3 | 19 | LBY302 | 0.74 | 3.57E−02 | 3 | 1 |
| LBY323 | 0.76 | 4.71E−02 | 1 | 8 | LBY323 | 0.73 | 6.50E−02 | 1 | 18 |
| LBY323 | 0.96 | 7.69E−04 | 1 | 14 | LBY323 | 0.78 | 3.66E−02 | 1 | 11 |
| LBY323 | 0.73 | 9.71E−02 | 5 | 9 | LBY323 | 0.87 | 2.33E−02 | 5 | 13 |
| LBY323 | 0.78 | 2.30E−02 | 2 | 4 | LBY323 | 0.82 | 1.24E−02 | 2 | 3 |
| LBY323 | 0.79 | 1.94E−02 | 2 | 7 | LBY323 | 0.78 | 2.30E−02 | 2 | 5 |
| LBY323 | 0.78 | 2.30E−02 | 2 | 15 | LBY323 | 0.74 | 3.64E−02 | 2 | 17 |
| LBY323 | 0.72 | 4.43E−02 | 2 | 13 | LBY323 | 0.70 | 5.22E−02 | 2 | 16 |
| LBY324 | 0.72 | 6.78E−02 | 1 | 10 | LBY324 | 0.71 | 1.16E−01 | 4 | 20 |

TABLE 103-continued

Correlation between the expression level of selected genes of some embodiments of the invention in various tissues and the phenotypic performance under normal conditions across maize accessions

| Gene Name | R | P value | Exp. set | Corr. ID | Gene Name | R | P value | Exp. set | Corr. ID |
|---|---|---|---|---|---|---|---|---|---|
| LBY324 | 0.79 | 1.90E−02 | 3 | 4 | LBY324 | 0.73 | 3.98E−02 | 3 | 3 |
| LBY324 | 0.79 | 1.90E−02 | 3 | 5 | LBY324 | 0.75 | 3.28E−02 | 3 | 9 |
| LBY324 | 0.79 | 1.90E−02 | 3 | 15 | LBY324 | 0.70 | 5.31E−02 | 3 | 13 |
| LBY324 | 0.73 | 6.46E−02 | 6 | 12 | LBY324 | 0.91 | 1.14E−02 | 6 | 1 |
| LBY325 | 0.78 | 6.79E−02 | 5 | 11 | LBY325 | 0.74 | 9.60E−02 | 5 | 16 |
| LBY325 | 0.91 | 1.51E−03 | 2 | 11 | LBY325 | 0.97 | 2.92E−04 | 6 | 4 |
| LBY325 | 0.97 | 1.92E−04 | 6 | 3 | LBY325 | 0.92 | 3.58E−03 | 6 | 7 |
| LBY325 | 0.85 | 1.55E−02 | 6 | 8 | LBY325 | 0.97 | 2.92E−04 | 6 | 5 |
| LBY325 | 0.94 | 1.91E−03 | 6 | 6 | LBY325 | 0.97 | 3.71E−04 | 6 | 18 |
| LBY325 | 0.78 | 6.92E−02 | 6 | 1 | LBY325 | 0.94 | 1.43E−03 | 6 | 9 |
| LBY325 | 0.97 | 2.92E−04 | 6 | 15 | LBY325 | 0.72 | 6.65E−02 | 6 | 14 |
| LBY325 | 0.97 | 3.57E−04 | 6 | 17 | LBY325 | 0.79 | 3.31E−02 | 6 | 13 |
| LBY325 | 0.83 | 2.18E−02 | 6 | 11 | LBY325 | 0.99 | 3.90E−05 | 6 | 16 |
| LBY326 | 0.90 | 1.53E−02 | 5 | 8 | LBY326 | 0.91 | 1.61E−03 | 2 | 2 |
| LBY326 | 0.91 | 1.61E−03 | 2 | 19 | LBY327 | 0.71 | 1.15E−01 | 6 | 1 |
| LBY328 | 0.76 | 8.26E−02 | 5 | 8 | LBY328 | 0.84 | 9.75E−03 | 7 | 20 |
| LBY329 | 0.80 | 5.77E−02 | 5 | 13 | LBY329 | 0.73 | 4.05E−02 | 2 | 13 |
| LBY329 | 0.75 | 3.08E−02 | 2 | 11 | LBY375 | 0.76 | 2.84E−02 | 2 | 8 |
| LBY373 | 0.81 | 2.88E−02 | 1 | 14 | LBY423 | 0.75 | 8.34E−02 | 1 | 1 |
| LBY375 | 0.85 | 1.61E−02 | 4 | 12 | LBY423 | 0.71 | 1.13E−01 | 5 | 19 |
| LBY423 | 0.71 | 1.13E−01 | 5 | 2 | LBY423 | 0.79 | 3.65E−02 | 6 | 12 |
| LBY423 | 0.71 | 3.19E−02 | 8 | 20 | LBY424 | 0.83 | 2.03E−02 | 1 | 2 |
| LBY423 | 0.85 | 3.29E−02 | 6 | 20 | LBY424 | 0.85 | 3.33E−02 | 1 | 1 |
| LBY424 | 0.83 | 2.03E−02 | 1 | 19 | LBY424 | 0.86 | 6.40E−03 | 2 | 2 |
| LBY424 | 0.99 | 2.06E−04 | 5 | 8 | LBY424 | 0.70 | 7.84E−02 | 4 | 10 |
| LBY424 | 0.86 | 6.40E−03 | 2 | 19 | LBY424 | 0.84 | 1.77E−02 | 6 | 13 |
| LBY426 | 0.74 | 9.25E−02 | 1 | 20 | LBY426 | 0.91 | 1.21E−02 | 5 | 11 |
| LBY426 | 0.90 | 2.56E−03 | 2 | 11 | LBY426 | 0.84 | 1.78E−02 | 6 | 13 |
| LBY427 | 0.83 | 4.28E−02 | 5 | 12 | LBY427 | 0.71 | 1.10E−01 | 5 | 18 |
| LGA10 | 0.73 | 6.33E−02 | 1 | 9 | LGA10 | 0.92 | 3.13E−03 | 1 | 13 |
| LGA10 | 0.80 | 1.76E−02 | 2 | 3 | LGA10 | 0.71 | 4.66E−02 | 2 | 17 |
| LGA10 | 0.95 | 2.97E−04 | 2 | 11 | LGA10 | 0.99 | 1.35E−06 | 3 | 2 |
| LGA10 | 0.99 | 1.35E−06 | 3 | 19 | LGA10 | 0.72 | 4.22E−02 | 3 | 1 |
| LGA10 | 0.73 | 6.20E−02 | 6 | 2 | LGA10 | 0.77 | 4.45E−02 | 6 | 6 |
| LGA10 | 0.73 | 6.20E−02 | 6 | 19 | LGA10 | 0.78 | 3.70E−02 | 6 | 13 |
| LGA10 | 0.72 | 2.98E−02 | 7 | 13 | LGA10 | 0.71 | 3.33E−02 | 7 | 11 |
| LYD959 | 0.88 | 8.32E−03 | 1 | 14 | LYD959 | 0.73 | 1.00E−01 | 1 | 20 |
| LYD959 | 0.75 | 8.65E−02 | 5 | 9 | LYD959 | 0.91 | 1.26E−02 | 5 | 13 |
| LYD959 | 0.74 | 3.69E−02 | 2 | 4 | LYD959 | 0.80 | 1.64E−02 | 2 | 3 |
| LYD959 | 0.74 | 3.69E−02 | 2 | 5 | LYD959 | 0.73 | 3.92E−02 | 2 | 18 |
| LYD959 | 0.74 | 3.69E−02 | 2 | 15 | LYD959 | 0.72 | 4.59E−02 | 2 | 11 |

Table 103: Correlations (R) between the genes expression levels in various tissues (Table 95) and the phenotypic performance under normal conditions.
"Corr. ID"— correlation set ID according to the correlated parameters described in Table 97 above.
"Exp. Set"— Expression set.
"R" = Pearson correlation coefficient;
"P" = p value. .

Example 10

Production of Soybean (Glycine max) Transcriptome and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [chem. (dot) agilent (dot) com/Scripts/PDS (dot) asp?lPage=50879]. The array oligonucleotide represents about 42,000 Soybean genes and transcripts. In order to define correlations between the levels of RNA expression with yield components, plant architecture related parameters or plant vigor related parameters, various plant characteristics of 29 different Glycine max varieties were analyzed and 26 varieties were further used for RNA expression analysis. The correlation between the RNA levels and the characterized parameters was analyzed using Pearson correlation test.

Correlation of Glycine max Genes' Expression Levels with Phenotypic Characteristics Across Ecotype Experimental Procedures 29 Soybean varieties were grown in three repetitive plots in field. Briefly, the growing protocol was as follows: Soybean seeds were sown in soil and grown under normal conditions (no irrigation, good organomic particles) which included high temperature about 82.38 (° F.), low temperature about 58.54 (° F.); total precipitation rainfall from May through September (from sowing until harvest) was about 16.97 inch.

In order to define correlations between the levels of RNA expression with yield components, plant architecture related parameters or vigor related parameters, 26 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

TABLE 104

Soybean transcriptome expression sets

| Expression Set | Set ID |
|---|---|
| Apical meristem at vegetative stage under normal growth condition | 1 |
| Leaf at vegetative stage under normal growth condition | 2 |
| Leaf at flowering stage under normal growth condition | 3 |
| Leaf at pod setting stage under normal growth condition | 4 |
| Root at vegetative stage under normal growth condition | 5 |
| Root at flowering stage under normal growth condition | 6 |
| Root at pod setting stage under normal growth condition | 7 |
| Stem at vegetative stage under normal growth condition | 8 |
| Stem at pod setting stage under normal growth condition | 9 |
| Flower bud at flowering stage under normal growth condition | 10 |
| Pod (R3-R4) at pod setting stage under normal growth condition | 11 |

Table 104.

RNA extraction—All 12 selected Soybean varieties were sampled per treatment. Plant tissues [leaf, root, Stem, Pod, apical meristem, Flower buds] growing under normal conditions were sampled and RNA was extracted as described above. The collected data parameters were as follows:

Main branch base diameter [mm] at pod set—the diameter of the base of the main branch (based diameter) average of three plants per plot.

Fresh weight [gr./plant] at pod set]—total weight of the vegetative portion above ground (excluding roots) before drying at pod set, average of three plants per plot.

Dry weight [gr./plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr./plant]—weight of all lateral branches at pod set, average of three plants per plot.

Total weight of pods on main stem at pod set [gr./plant]—weight of all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count of the number of pods containing 1 seed in all lateral branches at pod set, average of three plants per plot.

Total number of pods with 2 seeds on lateral branches at pod set [value/plant]—count of the number of pods containing 2 seeds in all lateral branches at pod set, average of three plants per plot.

Total number of pods with 3 seeds on lateral branches at pod set [value/plant]—count of the number of pods containing 3 seeds in all lateral branches at pod set, average of three plants per plot.

Total number of pods with 4 seeds on lateral branches at pod set [value/plant]—count of the number of pods containing 4 seeds in all lateral branches at pod set, average of three plants per plot.

Total number of pods with 1 seed on main stem at pod set [value/plant]—count of the number of pods containing 1 seed in main stem at pod set, average of three plants per plot.

Total number of pods with 2 seeds on main stem at pod set [value/plant]—count of the number of pods containing 2 seeds in main stem at pod set, average of three plants per plot.

Total number of pods with 3 seeds on main stem at pod set [value/plant]—count of the number of pods containing 3 seeds in main stem at pod set, average of three plants per plot.

Total number of pods with 4 seeds on main stem at pod set [value/plant]—count of the number of pods containing 4 seeds in main stem at pod set, average of three plants per plot.

Total number of seeds per plant at pod set [value/plant]—count of number of seeds in lateral branches and main stem at pod set, average of three plants per plot.

Total number of seeds on lateral branches at pod set [value/plant]—count of total number of seeds on lateral branches at pod set, average of three plants per plot.

Total number of seeds on main stem at pod set [value/plant]—count of total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr./plant]—weight of all pods on lateral branches at pod set, average of three plants per plot.

Ratio of the number of pods per node on main stem at pod set—calculated in Formula 23 (above), average of three plants per plot.

Ratio of total number of seeds in main stem to number of seeds on lateral branches—calculated in Formula 24 above, average of three plants per plot.

Total weight of pods per plant at pod set [gr./plant]—weight of all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, ars-grin (dot) gov/cgi-bin/npgs/html/desclist(dot)pl?51].

Seed quality [ranked 1-5]—measure at harvest; a visual estimate based on several hundred seeds. Parameter is rated according to the following scores considering the amount and degree of wrinkling, defective coat (cracks), greenishness, and moldy or other pigment. Rating is "1"—very good, "2"—good, "3"—fair, "4"—poor, "5"—very poor.

Lodging [ranked 1-5]—is rated at maturity per plot according to the following scores: "1"—most plants in a plot are erected; "2"—all plants leaning slightly or a few plants down; "3"—all plants leaning moderately, or 25%-50% down; "4"—all plants leaning considerably, or 50%-80% down; "5"—most plants down. Note: intermediate score such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate number of seeds on lateral branches—at pod set and divide by the number of pods with seeds on lateral branches—at pod set.

Average main stem seeds per pod [number]—Calculate total number of seeds on main stem at pod set and divide by the number of pods with seeds on main stem at pod setting.

Main stem average internode length [cm]—Calculate plant height at pod set and divide by the total number of nodes on main stem at pod setting.

Total number of pods with seeds on main stem [number]—count all pods containing seeds on the main stem at pod setting.

Total number of pods with seeds on lateral branches [number]—count all pods containing seeds on the lateral branches at pod setting.

Total number of pods per plant at pod set [number]—count pods on main stem and lateral branches at pod setting.

TABLE 105

Soybean correlated parameters (vectors)

| Correlated parameter with | Correlation ID |
|---|---|
| 100 percent flowering (days) | 1 |
| Lodging (score 1-5) | 2 |
| Maturity (days) | 3 |
| Plant height at harvest (cm) | 4 |
| Seed quality (score 1-5) | 5 |
| yield at harvest (bushel/hectare) | 6 |
| Total weight of seeds per plant (gr./plant) | 7 |
| Average lateral branch seeds per pod (number) | 8 |
| Average main stem seeds per pod (number) | 9 |
| Base diameter at pod set (mm) | 10 |
| DW at pod set (gr.) | 11 |
| fresh weight at pod set (gr.) | 12 |

TABLE 105-continued

Soybean correlated parameters (vectors)

| Correlated parameter with | Correlation ID |
|---|---|
| Main stem average internode length (cm) | 13 |
| Num of lateral branches (number) | 14 |
| Num of nodes with pods on lateral branches-pod set (number) | 15 |
| Num of pods with 1 seed on lateral branch-pod set (number) | 16 |
| Num of pods with 1 seed on main stem at pod set (number) | 17 |
| Num of pods with 2 seed on lateral branch-pod set (number) | 18 |
| Num of pods with 2 seed on main stem at pod set (number) | 19 |
| Num of pods with 3 seed on main stem at pod set (number) | 20 |
| Num of pods with 4 seed on main stem at pod set (number) | 21 |
| Num of Seeds on lateral branches-at pod set | 22 |
| Num pods with 3 seed on lateral branch-at pod set (number) | 23 |
| Num pods with 4 seed on lateral branch-at pod set (number) | 24 |
| Num pods with seeds on lateral branches-at pod set (number) | 25 |
| Plant height at pod set (cm) | 26 |
| Ratio num of seeds-main stem to lateral branches (ratio) | 27 |
| Ratio number of pods per node on main stem (ratio) | 28 |
| Total number of nodes on main stem (number) | 30 |
| Total number of pods per plant (number) | 31 |
| Total number of pods with seeds on main stem (number) | 32 |
| Total Number of Seeds on main stem at pod set (number) | 33 |
| Total number of seeds per plant (number) | 34 |
| Total weight of lateral branches at pod set (gr.) | 35 |
| Total weight of pods on main stem at pod set (gr.) | 36 |
| Total weight of pods per plant (gr./plant) | 37 |
| Weight of pods on lateral branches at pod set (gr.) | 38 |
| 50 percent flowering (days) | 39 |
| corrected Seed size (gr.) | 40 |

Table 105.
"Num" = number;
"DW" = dry weight.

Experimental Results 29 different Soybean varieties lines were grown and characterized for 40 parameters as specified above. Tissues for expression analysis were sampled from a subset of 12-26 lines. The correlated parameters are described in Table 105 above. The average for each of the measured parameter was calculated using the JMP software (Tables 106-109) and a subsequent correlation analysis was performed (Tables 110-111). Results were then integrated to the database.

TABLE 106

Measured parameter in Soybean varieties (lines 1-8)

| Line/Corr. ID | Line-1 | Line-2 | Line-3 | Line-4 | Line-5 | Line-6 | Line-7 | Line-8 |
|---|---|---|---|---|---|---|---|---|
| 1 | 67.30 | 67.30 | 67.30 | 70.00 | 68.00 | 71.70 | 67.30 | 67.70 |
| 2 | 2.00 | 2.00 | 1.67 | 1.67 | 1.17 | 1.83 | 1.67 | 1.17 |
| 3 | 27.70 | 27.70 | 24.00 | 30.30 | 31.30 | 43.70 | 27.00 | 30.30 |
| 4 | 69.20 | 85.00 | 96.70 | 75.80 | 73.30 | 76.70 | 75.00 | 67.50 |
| 5 | 3.00 | 2.17 | 2.33 | 2.33 | 2.50 | 3.50 | 2.67 | 3.00 |
| 6 | 55.50 | 50.30 | 47.60 | 46.80 | 55.90 | 43.80 | 51.70 | 50.40 |
| 7 | 21.40 | 14.70 | 15.10 | 13.40 | 16.60 | 10.50 | 16.00 | 17.20 |
| 8 | 2.53 | 2.58 | 2.67 | 2.51 | 2.74 | 1.95 | 2.46 | 2.43 |
| 9 | 2.52 | 2.49 | 2.60 | 2.36 | 2.77 | 1.89 | 2.50 | 2.52 |
| 10 | 8.27 | 8.00 | 8.33 | 7.16 | 7.78 | 9.54 | 8.13 | 9.68 |
| 11 | 35.80 | 51.70 | 53.70 | 34.70 | 47.50 | 50.30 | 53.50 | 38.00 |
| 12 | 158.90 | 185.80 | 170.90 | 146.80 | 172.80 | 198.20 | 166.40 | 152.60 |
| 13 | 4.29 | 4.93 | 5.24 | 3.61 | 3.85 | 4.15 | 4.29 | 3.91 |
| 14 | 5.11 | 8.44 | 9.00 | 7.00 | 8.67 | 8.67 | 7.11 | 9.11 |
| 15 | 13.90 | 20.90 | 23.00 | 22.40 | 26.10 | 16.00 | 21.60 | 23.10 |
| 16 | 0.78 | 0.89 | 1.56 | 0.78 | 1.00 | 3.00 | 1.22 | 1.78 |
| 17 | 0.56 | 2.44 | 1.11 | 2.56 | 0.89 | 4.38 | 1.89 | 1.44 |
| 18 | 15.30 | 17.60 | 17.00 | 23.30 | 18.10 | 18.80 | 21.20 | 26.40 |

TABLE 106-continued

Measured parameter in Soybean varieties (lines 1-8)

| Line/Corr. ID | Line-1 | Line-2 | Line-3 | Line-4 | Line-5 | Line-6 | Line-7 | Line-8 |
|---|---|---|---|---|---|---|---|---|
| 19 | 16.40 | 17.20 | 16.90 | 25.30 | 10.40 | 16.20 | 20.00 | 13.20 |
| 20 | 19.30 | 23.30 | 29.60 | 23.30 | 30.60 | 1.80 | 23.60 | 19.80 |
| 21 | 0.00 | 0.00 | 0.00 | 0.00 | 2.22 | 0.00 | 0.00 | 0.11 |
| 22 | 92.80 | 124.00 | 150.90 | 122.80 | 174.90 | 55.90 | 112.70 | 134.00 |
| 23 | 20.40 | 29.30 | 38.40 | 25.10 | 43.20 | 2.00 | 23.00 | 26.40 |
| 24 | 0.00 | 0.00 | 0.00 | 0.00 | 2.00 | 0.00 | 0.00 | 0.00 |
| 25 | 36.60 | 47.80 | 57.00 | 49.20 | 64.30 | 28.60 | 45.40 | 54.70 |
| 26 | 66.80 | 79.40 | 86.80 | 64.10 | 68.00 | 69.60 | 74.10 | 62.40 |
| 27 | 1.28 | 1.13 | 0.89 | 1.35 | 0.86 | 0.90 | 1.43 | 0.87 |
| 28 | 2.34 | 2.67 | 2.87 | 2.87 | 2.51 | 1.38 | 2.65 | 2.13 |
| 30 | 15.60 | 16.10 | 16.60 | 17.80 | 17.70 | 16.80 | 17.30 | 16.10 |
| 31 | 72.90 | 90.80 | 104.60 | 100.40 | 108.40 | 51.70 | 90.90 | 89.20 |
| 32 | 36.30 | 43.00 | 47.60 | 51.20 | 44.10 | 23.10 | 45.40 | 34.60 |
| 33 | 91.40 | 106.90 | 123.60 | 123.20 | 122.30 | 43.90 | 112.60 | 87.70 |
| 34 | 184.20 | 230.90 | 274.40 | 246.00 | 297.20 | 99.80 | 225.20 | 221.70 |
| 35 | 57.80 | 66.70 | 67.80 | 57.00 | 73.70 | 63.80 | 64.40 | 64.90 |
| 36 | 22.60 | 22.20 | 22.10 | 17.90 | 17.90 | 14.30 | 23.80 | 16.00 |
| 37 | 45.60 | 47.20 | 48.10 | 36.20 | 41.10 | 29.20 | 51.70 | 36.10 |
| 38 | 23.00 | 25.00 | 26.00 | 18.30 | 23.20 | 14.90 | 27.90 | 20.10 |
| 39 | | | 61 | | | 65.3 | | 60.7 |
| 40 | | | 89 | | | | | 93 |

TABLE 107

Measured parameters in Soybean varieties (lines 9-16)

| Line/Corr. ID | Line-9 | Line-10 | Line-11 | Line-12 | Line-13 | Line-14 | Line-15 | Line-16 |
|---|---|---|---|---|---|---|---|---|
| 1 | 71.70 | 67.30 | 67.00 | 69.70 | 60.00 | 70.70 | 71.70 | 71.70 |
| 2 | 1.83 | 1.67 | 1.17 | 2.67 | 2.67 | 1.50 | 3.00 | 1.83 |
| 3 | 35.30 | 30.30 | 28.00 | 41.00 | 38.30 | 31.00 | 36.00 | 38.70 |
| 4 | 75.00 | 75.80 | 66.70 | 115.80 | 74.20 | 72.50 | 83.30 | 76.70 |
| 5 | 2.00 | 2.17 | 2.00 | 3.00 | 2.83 | 2.17 | 2.00 | 2.33 |
| 6 | 52.90 | 56.30 | 55.10 | 40.20 | 44.00 | 52.40 | 46.90 | 48.60 |
| 7 | 14.60 | 16.50 | 17.10 | 10.50 | 12.10 | 15.80 | 12.60 | 12.60 |
| 8 | 2.43 | 2.53 | 2.60 | 2.34 | 2.13 | 2.48 | 2.47 | 2.70 |
| 9 | 2.48 | 2.53 | 2.60 | 2.26 | 2.17 | 2.40 | 2.52 | 2.68 |
| 10 | 8.41 | 8.11 | 7.54 | 7.83 | 8.82 | 8.10 | 8.72 | 9.54 |
| 11 | 45.80 | 46.20 | 38.70 | 50.70 | 60.80 | 44.30 | 52.30 | 54.50 |
| 12 | 175.70 | 163.90 | 136.60 | 191.70 | 224.70 | 155.30 | 216.20 | 192.10 |
| 13 | 3.90 | 3.92 | 3.41 | 4.38 | 4.15 | 3.50 | 4.36 | 3.67 |
| 14 | 8.67 | 9.89 | 5.33 | 5.00 | 7.67 | 4.78 | 7.78 | 8.78 |
| 15 | 26.30 | 33.00 | 21.30 | 14.40 | 15.20 | 18.60 | 30.40 | 28.00 |
| 16 | 2.78 | 1.78 | 0.89 | 0.33 | 5.67 | 1.56 | 5.12 | 0.67 |
| 17 | 2.33 | 1.44 | 1.67 | 1.67 | 4.56 | 2.67 | 4.14 | 1.89 |
| 18 | 34.40 | 32.30 | 19.90 | 12.60 | 21.60 | 21.20 | 29.60 | 16.70 |
| 19 | 22.30 | 16.90 | 17.00 | 19.20 | 27.00 | 32.90 | 18.70 | 15.10 |
| 20 | 25.40 | 22.30 | 31.90 | 10.00 | 11.70 | 27.90 | 31.40 | 41.90 |
| 21 | 0.11 | 0.11 | 0.00 | 0.00 | 0.00 | 0.00 | 1.71 | 0.44 |
| 22 | 171.10 | 160.40 | 139.70 | 49.40 | 75.40 | 112.30 | 204.70 | 180.80 |
| 23 | 33.00 | 31.30 | 33.00 | 8.00 | 8.90 | 22.80 | 40.20 | 48.80 |
| 24 | 0.11 | 0.00 | 0.00 | 0.00 | 0.00 | 0.00 | 0.75 | 0.11 |
| 25 | 70.30 | 65.40 | 53.80 | 20.90 | 36.10 | 45.60 | 83.10 | 66.20 |
| 26 | 69.70 | 70.90 | 62.30 | 94.40 | 69.40 | 66.80 | 75.40 | 68.60 |
| 27 | 1.38 | 0.89 | 1.41 | 2.40 | 2.32 | 1.54 | 0.80 | 1.21 |
| 28 | 2.77 | 2.26 | 2.76 | 1.43 | 2.60 | 3.32 | 3.19 | 3.17 |
| 30 | 18.00 | 18.10 | 18.30 | 21.60 | 16.80 | 19.10 | 17.30 | 18.80 |
| 31 | 120.60 | 106.20 | 104.30 | 51.80 | 79.30 | 109.00 | 138.90 | 125.60 |
| 32 | 50.20 | 40.80 | 50.60 | 30.90 | 43.20 | 63.40 | 55.80 | 59.30 |
| 33 | 123.80 | 102.70 | 131.30 | 70.10 | 93.60 | 152.10 | 140.10 | 159.60 |
| 34 | 294.90 | 263.10 | 271.00 | 119.60 | 169.00 | 264.40 | 344.80 | 340.30 |
| 35 | 80.30 | 74.90 | 58.30 | 55.20 | 54.00 | 52.40 | 105.00 | 67.00 |
| 36 | 18.00 | 15.00 | 19.60 | 15.40 | 33.80 | 21.60 | 16.20 | 26.60 |
| 37 | 41.00 | 35.10 | 39.90 | 27.40 | 54.90 | 36.90 | 40.00 | 47.20 |
| 38 | 23.00 | 20.10 | 19.30 | 12.00 | 21.10 | 15.30 | 23.80 | 20.70 |
| 39 | | 61 | | | 54.7 | | | |
| 40 | | 86 | | | | | | |

TABLE 108

Measured parameters in Soybean varieties (lines 18-23)

| Line/Corr. ID | Line-17 | Line-18 | Line-19 | Line-20 | Line-21 | Line-22 | Line-23 |
|---|---|---|---|---|---|---|---|
| 1 | 74.00 | 73.00 | 72.30 | 73.30 | 67.30 | 68.70 | 69.30 |
| 2 | 2.83 | 2.67 | 2.50 | 1.67 | 2.50 | 1.83 | 2.00 |
| 3 | 40.00 | 41.00 | 38.30 | 37.00 | 24.70 | 31.00 | 37.70 |
| 4 | 76.70 | 101.70 | 98.30 | 89.20 | 93.30 | 75.80 | 78.30 |
| 5 | 2.00 | 3.50 | 2.50 | 2.00 | 2.50 | 2.17 | 2.17 |
| 6 | 40.30 | 34.20 | 44.30 | 46.20 | 49.70 | 53.70 | 52.50 |
| 7 | 10.20 | 7.30 | 11.40 | 13.90 | 14.60 | 15.70 | 14.80 |
| 8 | 2.68 | 2.12 | 2.58 | 2.48 | 2.61 | 2.58 | 2.70 |
| 9 | 2.59 | 2.22 | 2.49 | 2.53 | 2.53 | 2.47 | 2.67 |
| 10 | 10.12 | 8.46 | 8.09 | 8.11 | 7.09 | 8.26 | 7.57 |
| 11 | 55.70 | 48.00 | 52.00 | 45.20 | 57.00 | 44.20 | 43.30 |
| 12 | 265.00 | 160.70 | 196.30 | 166.30 | 171.40 | 155.30 | 175.80 |
| 13 | 3.74 | 4.80 | 4.36 | 4.18 | 4.89 | 4.20 | 4.16 |
| 14 | 17.56 | 11.67 | 12.11 | 10.44 | 8.00 | 8.00 | 9.00 |
| 15 | 45.20 | 8.20 | 25.40 | 22.70 | 23.00 | 21.90 | 23.80 |
| 16 | 5.62 | 2.88 | 3.00 | 2.33 | 1.67 | 1.25 | 0.89 |
| 17 | 1.67 | 4.00 | 4.33 | 1.89 | 1.78 | 2.11 | 0.44 |
| 18 | 33.50 | 8.50 | 22.80 | 21.90 | 22.90 | 21.80 | 13.20 |
| 19 | 8.10 | 21.30 | 17.70 | 20.00 | 17.40 | 20.30 | 11.20 |
| 20 | 22.80 | 11.10 | 28.20 | 27.90 | 25.10 | 24.10 | 25.20 |
| 21 | 0.44 | 0.00 | 0.56 | 0.56 | 0.44 | 0.00 | 0.11 |
| 22 | 324.60 | 46.90 | 176.20 | 121.60 | 151.60 | 143.00 | 144.00 |
| 23 | 82.00 | 9.00 | 42.10 | 24.60 | 34.10 | 32.80 | 38.90 |
| 24 | 1.50 | 0.00 | 0.33 | 0.44 | 0.44 | 0.00 | 0.00 |
| 25 | 122.60 | 20.40 | 68.20 | 49.20 | 59.10 | 55.80 | 53.00 |
| 26 | 63.90 | 89.80 | 82.10 | 81.10 | 85.70 | 70.60 | 70.80 |
| 27 | 0.36 | 3.90 | 0.78 | 1.36 | 0.92 | 1.18 | 0.82 |
| 28 | 1.87 | 1.98 | 2.71 | 2.58 | 2.45 | 2.78 | 2.15 |
| 30 | 17.10 | 18.80 | 18.90 | 19.40 | 19.90 | 16.80 | 17.00 |
| 31 | 155.60 | 61.00 | 119.00 | 99.60 | 103.90 | 103.20 | 90.00 |
| 32 | 33.00 | 36.40 | 50.80 | 50.30 | 44.80 | 46.60 | 37.00 |
| 33 | 88.00 | 80.00 | 126.60 | 127.80 | 113.80 | 115.10 | 99.00 |
| 34 | 412.50 | 136.00 | 302.80 | 249.30 | 265.30 | 260.50 | 243.00 |
| 35 | 167.20 | 45.40 | 83.20 | 63.70 | 69.70 | 64.30 | 76.20 |
| 36 | 9.00 | 9.00 | 16.00 | 14.60 | 19.80 | 15.90 | 14.70 |
| 37 | 38.90 | 14.20 | 36.10 | 29.50 | 44.10 | 32.80 | 33.90 |
| 38 | 30.20 | 4.10 | 20.10 | 14.90 | 24.30 | 17.00 | 19.20 |
| 39 | 68.3 | 66.5 | 68.3 | | | 62.3 | |
| 40 | 71.3 | 88 | 75 | | | 80.7 | |

TABLE 109

Measured parameters in Soybean varieties (lines 24-29)

| Line/Corr. ID | Line-24 | Line-25 | Line-26 | Line-27 | Line-28 | Line-29 |
|---|---|---|---|---|---|---|
| 1 | 73.70 | 68.00 | 68.70 | 68.00 | 67.00 | 70.70 |
| 2 | 3.50 | 3.33 | 1.83 | 1.50 | 2.33 | 1.50 |
| 3 | 39.00 | 27.30 | 27.70 | 27.30 | 36.30 | 32.70 |
| 4 | 116.70 | 76.70 | 85.00 | 78.30 | 79.20 | 71.70 |
| 5 | 2.33 | 2.17 | 2.17 | 2.33 | 2.17 | 2.17 |
| 6 | 42.50 | 43.60 | 51.90 | 52.50 | 46.40 | 52.20 |
| 7 | 10.80 | 13.00 | 16.40 | 16.60 | 15.80 | 15.20 |
| 8 | 2.67 | 2.62 | 2.37 | 2.67 | 2.62 | 2.58 |
| 9 | 2.71 | 2.51 | 2.53 | 2.64 | 2.65 | 2.61 |
| 10 | 7.73 | 8.16 | 8.18 | 6.88 | 7.82 | 7.89 |
| 11 | 52.70 | 56.00 | 56.20 | 43.50 | 46.00 | 47.50 |
| 12 | 178.10 | 204.40 | 205.90 | 144.70 | 176.40 | 164.20 |
| 13 | 4.82 | 4.12 | 4.36 | 4.64 | 4.47 | 3.57 |
| 14 | 9.11 | 6.78 | 7.11 | 4.33 | 9.11 | 10.00 |
| 15 | 16.30 | 22.60 | 19.90 | 11.80 | 16.00 | 24.20 |
| 16 | 2.67 | 1.78 | 1.00 | 0.56 | 2.11 | 3.00 |
| 17 | 1.89 | 3.44 | 3.22 | 1.67 | 3.33 | 1.22 |
| 18 | 10.70 | 23.80 | 26.80 | 10.20 | 15.90 | 25.70 |
| 19 | 16.10 | 28.10 | 24.70 | 14.70 | 14.30 | 16.60 |
| 20 | 36.40 | 39.70 | 35.80 | 31.70 | 37.60 | 32.30 |
| 21 | 3.89 | 0.00 | 0.00 | 0.78 | 0.78 | 0.00 |
| 22 | 105.40 | 184.30 | 166.20 | 92.30 | 143.80 | 187.30 |
| 23 | 25.70 | 45.00 | 37.20 | 23.80 | 35.90 | 44.30 |
| 24 | 1.11 | 0.00 | 0.00 | 0.00 | 0.56 | 0.00 |
| 25 | 40.10 | 70.60 | 71.70 | 34.60 | 54.40 | 73.00 |
| 26 | 101.70 | 79.60 | 77.40 | 73.70 | 73.70 | 67.20 |
| 27 | 1.98 | 1.03 | 1.48 | 1.82 | 1.35 | 0.83 |
| 28 | 2.75 | 3.70 | 3.58 | 3.06 | 3.34 | 2.84 |
| 30 | 21.10 | 19.30 | 17.80 | 15.90 | 16.70 | 20.80 |
| 31 | 98.40 | 141.80 | 135.30 | 83.30 | 110.40 | 123.10 |
| 32 | 58.30 | 71.20 | 63.70 | 48.80 | 56.00 | 50.10 |
| 33 | 159.00 | 178.70 | 159.90 | 129.10 | 147.80 | 131.30 |
| 34 | 264.40 | 363.00 | 326.10 | 221.40 | 291.60 | 318.70 |
| 35 | 52.00 | 76.90 | 74.80 | 35.30 | 52.10 | 67.00 |
| 36 | 14.60 | 30.40 | 24.20 | 26.40 | 21.40 | 18.00 |
| 37 | 23.80 | 58.60 | 48.40 | 40.70 | 35.80 | 40.60 |
| 38 | 9.20 | 28.10 | 24.20 | 14.30 | 15.10 | 22.60 |
| 39 | 67.7 | 61.7 | | | | 64.3 |
| 40 | 75.7 | 76.3 | | | | 77.3 |

TABLE 110

Correlation between the expression level of selected genes of some embodiments of the invention in various tissues and the phenotypic performance under normal conditions across 26 soybean varieties

| Gene Name | R | P value | Exp. set | Corr. ID | Gene Name | R | P value | Exp. set | Corr. ID |
|---|---|---|---|---|---|---|---|---|---|
| LGD30 | 0.72 | 2.01E−05 | 10 | 7 | LYD944 | 0.73 | 1.33E−05 | 10 | 14 |
| LYD945 | 0.71 | 5.76E−05 | 6 | 24 | | | | | |

Table 110: Provided are the correlations (R) between the expression levels yield improving genes and their homologs in various tissues [Expression (Exp) sets, Table 104] and the phenotypic performance (yield, biomass, and plant architecture) according to the Correlation(Corr.) vectors (Table 105) under normal conditions across soybean varieties.

P = p value.

TABLE 111

Correlation between the expression level of selected genes of some embodiments of the invention in various tissues and the phenotypic performance under normal conditions across 12 soybean varieties

| Gene Name | R | P value | Exp. set | Corr. ID | Gene Name | R | P value | Exp. set | Corr. ID |
|---|---|---|---|---|---|---|---|---|---|
| LBY398 | 0.79 | 6.52E−03 | 8 | 35 | LBY398 | 0.71 | 2.02E−02 | 8 | 14 |
| LBY398 | 0.75 | 7.53E−03 | 2 | 16 | LBY398 | 0.74 | 5.72E−03 | 4 | 16 |
| LBY401 | 0.74 | 3.59E−02 | 9 | 28 | LBY398 | 0.87 | 1.00E−03 | 8 | 24 |
| LBY451 | 0.87 | 9.52E−04 | 8 | 24 | LBY401 | 0.75 | 3.20E−02 | 9 | 7 |
| LBY451 | 0.71 | 1.43E−02 | 2 | 2 | LBY401 | 0.78 | 2.31E−02 | 9 | 36 |
| LGA27 | 0.82 | 1.20E−02 | 9 | 7 | LBY451 | 0.74 | 3.74E−02 | 9 | 27 |
| LGA27 | 0.78 | 8.22E−03 | 7 | 12 | LBY452 | 0.71 | 2.13E−02 | 5 | 3 |
| LGD30 | 0.71 | 2.06E−02 | 5 | 10 | LBY452 | 0.72 | 1.84E−02 | 8 | 24 |
| LGD30 | 0.71 | 9.08E−03 | 1 | 16 | LGA27 | 0.78 | 2.12E−02 | 9 | 6 |
| LGD30 | 0.71 | 9.60E−03 | 1 | 12 | LGA27 | 0.88 | 7.74E−04 | 7 | 10 |
| LGA27 | 0.71 | 4.86E−02 | 9 | 36 | LGD30 | 0.71 | 2.18E−02 | 8 | 6 |
| LGD30 | 0.71 | 9.59E−03 | 1 | 35 | LGD30 | 0.74 | 5.95E−03 | 10 | 7 |
| LYD942 | 0.72 | 8.15E−03 | 11 | 16 | LGD30 | 0.86 | 3.46E−04 | 1 | 24 |
| LYD942 | 0.90 | 5.73E−05 | 11 | 35 | LGD30 | 0.73 | 6.85E−03 | 11 | 30 |
| LYD942 | 0.81 | 1.40E−03 | 11 | 12 | LGD30 | 0.70 | 1.08E−02 | 1 | 34 |
| LYD942 | 0.94 | 4.80E−05 | 8 | 24 | LYD942 | 0.72 | 1.78E−02 | 8 | 12 |
| LYD943 | 0.72 | 8.84E−03 | 4 | 2 | LYD942 | 0.80 | 1.71E−03 | 11 | 14 |
| LYD943 | 0.83 | 3.19E−03 | 7 | 10 | LYD942 | 0.76 | 3.93E−03 | 11 | 24 |
| LYD943 | 0.72 | 8.52E−03 | 4 | 21 | LYD942 | 0.79 | 6.52E−03 | 8 | 35 |
| LYD944 | 0.75 | 3.27E−02 | 9 | 2 | LYD943 | 0.83 | 7.66E−04 | 4 | 4 |
| LYD944 | 0.80 | 5.94E−03 | 5 | 14 | LYD943 | 0.73 | 3.90E−02 | 9 | 17 |
| LYD944 | 0.81 | 1.24E−03 | 4 | 14 | LYD943 | 0.85 | 4.90E−04 | 4 | 26 |
| LYD944 | 0.75 | 1.22E−02 | 8 | 16 | LYD944 | 0.71 | 1.42E−02 | 2 | 4 |
| LYD944 | 0.72 | 8.50E−03 | 4 | 39 | LYD944 | 0.83 | 2.81E−03 | 8 | 12 |
| LYD944 | 0.76 | 1.01E−02 | 7 | 2 | LYD944 | 0.82 | 1.17E−03 | 1 | 12 |
| LYD944 | 0.92 | 1.40E−04 | 5 | 24 | LYD944 | 0.80 | 1.62E−02 | 9 | 21 |
| LYD944 | 0.88 | 7.97E−04 | 8 | 24 | LYD944 | 0.85 | 4.60E−04 | 4 | 24 |
| LYD944 | 0.75 | 5.15E−03 | 1 | 24 | LYD944 | 0.76 | 4.15E−03 | 11 | 24 |
| LYD944 | 0.73 | 6.97E−03 | 1 | 16 | LYD944 | 0.72 | 1.98E−02 | 5 | 35 |
| LYD945 | 0.84 | 9.63E−03 | 9 | 15 | LYD944 | 0.76 | 1.10E−02 | 8 | 35 |
| LYD945 | 0.78 | 7.31E−03 | 8 | 35 | LYD944 | 0.77 | 3.42E−03 | 1 | 35 |
| LYD945 | 0.89 | 3.30E−03 | 9 | 16 | LYD944 | 0.70 | 1.12E−02 | 10 | 39 |
| LYD945 | 0.71 | 2.02E−02 | 5 | 35 | LYD945 | 0.86 | 6.52E−03 | 9 | 10 |
| LYD945 | 0.95 | 3.21E−04 | 9 | 35 | LYD945 | 0.90 | 3.44E−04 | 8 | 10 |
| LYD945 | 0.79 | 2.33E−03 | 1 | 14 | LYD945 | 0.72 | 7.81E−03 | 4 | 12 |
| LYD945 | 0.73 | 7.19E−03 | 4 | 14 | LYD945 | 0.86 | 5.97E−03 | 9 | 12 |
| LYD945 | 0.73 | 4.15E−02 | 9 | 39 | LYD945 | 0.90 | 4.25E−04 | 8 | 12 |
| LYD945 | 0.77 | 3.35E−03 | 10 | 18 | LYD945 | 0.88 | 4.20E−03 | 9 | 14 |
| LYD945 | 0.72 | 8.95E−03 | 1 | 12 | LYD945 | 0.79 | 2.40E−03 | 1 | 15 |
| LYD945 | 0.82 | 1.22E−03 | 4 | 24 | LYD945 | 0.79 | 2.15E−03 | 4 | 16 |
| LYD945 | 0.73 | 1.75E−02 | 7 | 11 | LYD945 | 0.72 | 4.53E−02 | 9 | 23 |
| LYD947 | 0.72 | 1.86E−02 | 8 | 15 | LYD945 | 0.98 | 2.00E−05 | 9 | 24 |
| LYD947 | 0.85 | 1.74E−03 | 8 | 24 | LYD945 | 0.72 | 8.82E−03 | 10 | 35 |
| LYD948 | 0.82 | 3.86E−03 | 7 | 27 | LYD945 | 0.87 | 2.40E−04 | 1 | 35 |
| LYD948 | 0.78 | 2.19E−02 | 9 | 15 | LYD945 | 0.77 | 3.12E−03 | 4 | 35 |
| LYD948 | 0.81 | 1.39E−03 | 4 | 28 | LYD945 | 0.70 | 2.29E−02 | 7 | 36 |
| LYD948 | 0.89 | 2.86E−03 | 9 | 35 | LYD947 | 0.70 | 1.13E−02 | 4 | 12 |
| LYD948 | 0.77 | 9.18E−03 | 5 | 28 | LYD947 | 0.76 | 1.00E−02 | 8 | 12 |
| LYD948 | 0.71 | 4.84E−02 | 9 | 39 | LYD947 | 0.75 | 1.16E−02 | 8 | 35 |
| LYD948 | 0.87 | 5.20E−03 | 9 | 16 | LYD948 | 0.77 | 8.56E−03 | 7 | 5 |
| LYD971 | 0.80 | 5.35E−03 | 8 | 16 | LYD948 | 0.72 | 4.59E−02 | 9 | 10 |
| LYD971 | 0.71 | 5.00E−02 | 9 | 4 | LYD948 | 0.76 | 2.90E−02 | 9 | 12 |
| LYD949 | 0.77 | 3.43E−03 | 4 | 11 | LYD948 | 0.72 | 8.95E−03 | 1 | 12 |
| LYD972 | 0.90 | 2.49E−03 | 9 | 27 | LYD948 | 0.95 | 3.40E−04 | 9 | 14 |
| LYD971 | 0.85 | 4.85E−04 | 1 | 16 | LYD948 | 0.70 | 2.29E−02 | 8 | 19 |
| LYD972 | 0.70 | 5.18E−02 | 9 | 4 | LYD948 | 0.71 | 4.95E−02 | 9 | 23 |
| LYD972 | 0.73 | 1.71E−02 | 8 | 21 | LYD948 | 0.96 | 1.10E−04 | 9 | 24 |
| LYD972 | 0.72 | 1.86E−02 | 7 | 16 | LYD948 | 0.80 | 1.67E−03 | 4 | 33 |
| LYD972 | 0.84 | 5.53E−04 | 1 | 24 | LYD948 | 0.74 | 1.45E−02 | 5 | 33 |
| LYD973 | 0.77 | 8.68E−03 | 5 | 3 | LYD971 | 0.71 | 4.71E−02 | 9 | 5 |
| LYD974 | 0.77 | 8.87E−03 | 8 | 24 | LYD971 | 0.72 | 7.80E−03 | 4 | 15 |
| LYD974 | 0.82 | 3.71E−03 | 8 | 16 | LYD971 | 0.71 | 9.76E−03 | 11 | 30 |
| LYD975 | 0.71 | 5.01E−02 | 9 | 17 | LYD972 | 0.85 | 7.77E−03 | 9 | 5 |
| LYD976 | 0.75 | 4.82E−03 | 1 | 21 | LYD972 | 0.76 | 1.07E−02 | 7 | 11 |
| LYD977 | 0.97 | 6.05E−06 | 8 | 24 | LYD972 | 0.79 | 2.37E−03 | 1 | 12 |
| LYD978 | 0.75 | 3.29E−02 | 9 | 39 | LYD972 | 0.88 | 6.66E−04 | 8 | 24 |
| LYD979 | 0.73 | 3.89E−02 | 9 | 24 | LYD972 | 0.84 | 7.22E−04 | 11 | 30 |
| LYD978 | 0.75 | 3.13E−02 | 9 | 16 | LYD972 | 0.79 | 2.04E−03 | 1 | 35 |
| LYD979 | 0.78 | 2.29E−02 | 9 | 1 | LYD973 | 0.80 | 5.21E−03 | 5 | 16 |
| LYD979 | 0.79 | 6.08E−03 | 8 | 36 | LYD974 | 0.71 | 2.20E−02 | 8 | 10 |
| LYD979 | 0.80 | 1.67E−03 | 1 | 5 | LYD974 | 0.85 | 1.83E−03 | 8 | 12 |
| LYD980 | 0.79 | 6.74E−03 | 8 | 24 | LYD974 | 0.78 | 2.32E−02 | 9 | 17 |
| LYD980 | 0.73 | 6.60E−03 | 11 | 12 | LYD976 | 0.74 | 1.35E−02 | 8 | 21 |
| LYD980 | 0.86 | 6.82E−03 | 9 | 6 | LYD976 | 0.79 | 2.34E−03 | 11 | 30 |

TABLE 111-continued

Correlation between the expression level of selected genes of some embodiments of the invention in various tissues and the phenotypic performance under normal conditions across 12 soybean varieties

| Gene Name | R | P value | Exp. set | Corr. ID | Gene Name | R | P value | Exp. set | Corr. ID |
|---|---|---|---|---|---|---|---|---|---|
| LYD980 | 0.71 | 9.82E−03 | 11 | 2 | LYD977 | 0.73 | 6.74E−03 | 11 | 21 |
| LYD980 | 0.73 | 7.22E−03 | 1 | 16 | LYD977 | 0.77 | 9.82E−03 | 8 | 35 |
| LYD981 | 0.85 | 1.94E−03 | 8 | 16 | LYD978 | 0.74 | 3.60E−02 | 9 | 1 |
| LYD981 | 0.89 | 5.53E−04 | 8 | 12 | LYD978 | 0.73 | 3.87E−02 | 9 | 12 |
| LYD981 | 0.88 | 4.17E−03 | 9 | 17 | LYD979 | 0.84 | 8.51E−03 | 9 | 14 |
| LYD981 | 0.73 | 6.69E−03 | 1 | 12 | LYD979 | 0.74 | 1.50E−02 | 7 | 16 |
| LYD981 | 0.70 | 1.07E−02 | 4 | 35 | LYD979 | 0.76 | 2.97E−02 | 9 | 16 |
| LYD981 | 0.72 | 1.93E−02 | 5 | 11 | LYD979 | 0.87 | 1.22E−03 | 8 | 17 |
| LYD982 | 0.77 | 9.20E−03 | 8 | 16 | LYD979 | 0.72 | 8.44E−03 | 10 | 36 |
| LYD982 | 0.79 | 6.26E−03 | 8 | 12 | LYD979 | 0.81 | 1.57E−02 | 9 | 39 |
| LYD983 | 0.78 | 2.27E−02 | 9 | 6 | LYD980 | 0.76 | 3.00E−02 | 9 | 7 |
| LYD983 | 0.78 | 7.25E−03 | 8 | 16 | LYD980 | 0.70 | 1.05E−02 | 11 | 11 |
| LYD983 | 0.73 | 1.64E−02 | 8 | 15 | LYD980 | 0.74 | 5.56E−03 | 1 | 12 |
| LYD983 | 0.79 | 2.45E−03 | 11 | 21 | LYD980 | 0.75 | 7.88E−03 | 2 | 16 |
| LYD983 | 0.86 | 7.16E−04 | 2 | 17 | LYD980 | 0.76 | 3.83E−03 | 11 | 24 |
| LYD983 | 0.84 | 2.40E−03 | 8 | 24 | LYD981 | 0.80 | 1.77E−03 | 11 | 2 |
| LYD983 | 0.71 | 9.35E−03 | 1 | 24 | LYD981 | 0.78 | 2.12E−02 | 9 | 2 |
| LYD985 | 0.80 | 5.34E−03 | 8 | 10 | LYD981 | 0.79 | 7.12E−03 | 8 | 10 |
| LYD986 | 0.76 | 4.13E−03 | 10 | 14 | LYD981 | 0.89 | 1.24E−04 | 4 | 12 |
| LYD986 | 0.78 | 2.70E−03 | 4 | 33 | LYD981 | 0.82 | 1.19E−03 | 1 | 16 |
| LYD986 | 0.74 | 3.44E−02 | 9 | 26 | LYD981 | 0.90 | 7.20E−05 | 4 | 16 |
| LYD986 | 0.80 | 1.95E−03 | 4 | 20 | LYD981 | 0.75 | 1.23E−02 | 5 | 36 |
| LYD986 | 0.89 | 1.17E−04 | 10 | 24 | LYD982 | 0.73 | 6.49E−03 | 1 | 16 |
| LYD987 | 0.73 | 4.07E−02 | 9 | 35 | LYD982 | 0.81 | 4.86E−03 | 8 | 24 |
| LYD987 | 0.94 | 5.89E−04 | 9 | 27 | LYD983 | 0.73 | 1.15E−02 | 2 | 3 |
| LYD987 | 0.72 | 4.52E−02 | 9 | 23 | LYD983 | 0.71 | 4.86E−02 | 9 | 7 |
| LYD983 | 0.80 | 1.70E−03 | 1 | 16 | LYD983 | 0.87 | 1.17E−03 | 8 | 10 |
| LYD985 | 0.87 | 5.42E−04 | 2 | 16 | LYD983 | 0.72 | 1.84E−02 | 5 | 10 |
| LYD985 | 0.88 | 1.70E−04 | 1 | 16 | LYD983 | 0.78 | 3.02E−03 | 1 | 12 |
| LYD945 | 0.75 | 4.77E−03 | 1 | 10 | LYD983 | 0.77 | 8.71E−03 | 8 | 12 |
| LBY451 | 0.72 | 1.89E−02 | 5 | 19 | LYD983 | 0.71 | 2.09E−02 | 8 | 23 |
| LGD30 | 0.73 | 6.96E−03 | 1 | 23 | LYD983 | 0.80 | 4.97E−03 | 8 | 35 |
| LBY398 | 0.77 | 9.05E−03 | 8 | 15 | LYD983 | 0.71 | 9.21E−03 | 1 | 35 |
| LYD942 | 0.73 | 1.70E−02 | 8 | 15 | LYD984 | 0.72 | 7.97E−03 | 1 | 12 |
| LYD945 | 0.84 | 6.59E−04 | 10 | 15 | LYD985 | 0.82 | 3.69E−03 | 8 | 12 |
| LYD977 | 0.74 | 1.50E−02 | 8 | 15 | LYD985 | 0.76 | 7.14E−03 | 2 | 12 |
| LYD976 | 0.93 | 1.07E−04 | 8 | 24 | LYD985 | 0.77 | 3.22E−03 | 1 | 12 |
| LYD949 | 0.74 | 1.37E−02 | 5 | 5 | LYD985 | 0.89 | 6.50E−04 | 8 | 16 |
| LYD949 | 0.74 | 3.43E−02 | 9 | 5 | LYD986 | 0.72 | 7.76E−03 | 10 | 15 |
| LGD30 | 0.72 | 2.01E−05 | 10 | 7 | LYD986 | 0.75 | 1.34E−02 | 8 | 16 |
| LYD945 | 0.71 | 5.76E−05 | 6 | 24 | LYD986 | 0.75 | 4.61E−03 | 4 | 28 |
| LYD944 | 0.73 | 1.33E−05 | 10 | 14 | LYD986 | 0.72 | 1.25E−02 | 2 | 28 |
| LYD987 | 0.75 | 3.23E−02 | 9 | 21 | LYD986 | 0.81 | 1.58E−03 | 4 | 30 |
| LYD987 | 0.79 | 1.88E−02 | 9 | 24 | LYD986 | 0.77 | 3.57E−03 | 10 | 35 |
| LGD30 | 0.79 | 2.18E−03 | 10 | 6 | LYD987 | 0.79 | 2.02E−02 | 9 | 14 |
| LYD948 | 0.81 | 1.38E−03 | 10 | 6 | LBY451 | 0.76 | 2.73E−02 | 8 | 40 |
| LBY451 | 0.82 | 1.22E−02 | 5 | 40 | LYD947 | 0.73 | 3.94E−02 | 5 | 40 |
| LGD30 | 0.78 | 2.32E−02 | 7 | 40 | LYD975 | 0.71 | 4.91E−02 | 5 | 40 |
| LYD949 | 0.85 | 7.40E−03 | 5 | 40 | LYD987 | 0.90 | 2.29E−03 | 5 | 40 |
| LYD986 | 0.97 | 4.05E−04 | 9 | 40 | MGP82 | 0.87 | 4.82E−03 | 9 | 6 |
| MGP58 | 0.81 | 4.68E−03 | 8 | 20 | MGP58 | 0.71 | 2.05E−02 | 8 | 30 |
| MGP54 | 0.76 | 4.02E−03 | 10 | 20 | MGP54 | 0.80 | 1.99E−03 | 10 | 23 |
| MGP58 | 0.85 | 7.01E−03 | 9 | 36 | MGP58 | 0.82 | 1.87E−03 | 2 | 20 |
| MGP58 | 0.70 | 2.30E−02 | 7 | 19 | MGP58 | 0.71 | 2.11E−02 | 5 | 20 |
| MGP58 | 0.78 | 2.57E−03 | 1 | 28 | MGP58 | 0.77 | 3.08E−03 | 10 | 20 |
| MGP82 | 0.76 | 1.07E−02 | 5 | 10 | MGP82 | 0.71 | 2.14E−02 | 8 | 24 |
| MGP58 | 0.70 | 1.54E−02 | 2 | 28 | MGP58 | 0.79 | 3.85E−03 | 2 | 34 |
| MGP54 | 0.76 | 4.47E−03 | 10 | 28 | MGP54 | 0.88 | 1.37E−04 | 10 | 34 |
| MGP53 | 0.75 | 1.18E−02 | 5 | 30 | MGP53 | 0.72 | 2.00E−02 | 5 | 33 |
| MGP58 | 0.75 | 4.84E−03 | 10 | 30 | MGP58 | 0.77 | 3.40E−03 | 10 | 33 |
| MGP58 | 0.80 | 3.30E−03 | 2 | 23 | MGP58 | 0.76 | 6.90E−03 | 2 | 33 |
| MGP54 | 0.76 | 4.11E−03 | 10 | 22 | MGP54 | 0.76 | 3.77E−03 | 10 | 33 |
| MGP58 | 0.73 | 7.61E−03 | 4 | 28 | MGP58 | 0.70 | 1.11E−02 | 1 | 33 |
| MGP58 | 0.78 | 7.95E−03 | 5 | 33 | MGP58 | 0.81 | 4.71E−03 | 5 | 28 |
| MGP58 | 0.83 | 2.67E−03 | 8 | 33 | MGP58 | 0.78 | 7.55E−03 | 8 | 28 |
| MGP58 | 0.92 | 1.17E−03 | 9 | 33 | MGP58 | 0.90 | 2.16E−03 | 9 | 28 |
| MGP54 | 0.80 | 5.62E−03 | 7 | 27 | MGP54 | 0.74 | 3.71E−02 | 9 | 27 |
| MGP58 | 0.89 | 3.11E−03 | 9 | 20 | MGP58 | 0.76 | 2.78E−02 | 9 | 37 |
| MGP82 | 0.83 | 3.01E−03 | 7 | 7 | MGP82 | 0.85 | 1.69E−03 | 7 | 6 |
| MGP82 | 0.89 | 2.86E−03 | 9 | 7 | MGP58 | 0.75 | 5.21E−03 | 10 | 32 |
| MGP54 | 0.71 | 9.29E−03 | 10 | 9 | MGP54 | 0.77 | 3.43E−03 | 10 | 32 |
| MGP58 | 0.74 | 1.47E−02 | 7 | 32 | MGP58 | 0.80 | 5.43E−03 | 5 | 32 |
| MGP58 | 0.83 | 2.68E−03 | 8 | 32 | MGP58 | 0.92 | 1.24E−03 | 9 | 32 |
| MGP58 | 0.70 | 1.05E−02 | 4 | 32 | MGP58 | 0.71 | 1.03E−02 | 1 | 32 |

TABLE 111-continued

Correlation between the expression level of selected genes of some embodiments of the invention in various tissues and the phenotypic performance under normal conditions across 12 soybean varieties

| Gene Name | R | P value | Exp. set | Corr. ID | Gene Name | R | P value | Exp. set | Corr. ID |
|---|---|---|---|---|---|---|---|---|---|
| MGP53 | 0.76 | 1.15E−02 | 5 | 32 | MGP54 | 0.73 | 6.90E−03 | 10 | 25 |
| MGP54 | 0.86 | 3.66E−04 | 10 | 8 | MGP54 | 0.88 | 1.75E−04 | 10 | 31 |
| MGP58 | 0.72 | 1.20E−02 | 2 | 32 | MGP58 | 0.75 | 7.39E−03 | 2 | 31 |

Table 111: Provided are the correlations (R) between the expression levels yield improving genes and their homologs in various tissues [Expression (Exp) sets, Table 104] and the phenotypic performance (yield, biomass, and plant architecture) according to the Correlation (Corr.) vectors (Table 105) under normal conditions across soybean varieties.
P = p value.

Example 11

Production of Tomato Transcriptome and High Throughput Correlation Analysis Using 44K Tomato Oligonucleotide Micro-Array In order to produce a high throughput correlation analysis between nitrogen use efficiency (NUE) related phenotypes and gene expression, the present inventors utilized a Tomato oligonucleotide micro-array, produced by Agilent Technologies [chem. (dot) agilent (dot) com/Scripts/PDS (dot) asp?l-Page=50879]. The array oligonucleotide represents about 44,000 Tomato genes and transcripts. In order to define correlations between the levels of RNA expression with NUE, abiotic stress tolerance (ABST), yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [davidmlane (dot) com/hyperstat/A34739 (dot) html].

I. Correlation of Tomato Varieties Across Ecotypes Grown Under Low Nitrogen, Drought and Regular Growth Conditions

Experimental Procedures

18 Tomato varieties were grown in 3 repetitive blocks, each containing 6 plants per plot were grown at net house. Briefly, the growing protocol was as follows:

1. Regular growth conditions: Tomato varieties were grown under normal conditions: 4-6 Liters/m² of water per day and fertilized with NPK (nitrogen, phosphorous and potassium at a ratio 6:6:6, respectively) as recommended in protocols for commercial tomato production.

2. Low Nitrogen fertilization conditions: Tomato varieties were grown under normal conditions (4-6 Liters/m² per day and fertilized with NPK as recommended in protocols for commercial tomato production) until flower stage. At this time, Nitrogen fertilization was stopped.

3. Drought stress: Tomato variety was grown under normal conditions (4-6 Liters/m² per day) until flower stage. At this time, irrigation was reduced to 50% compared to normal conditions.

Plants were phenotyped on a daily basis following the standard descriptor of tomato (Table 113). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Tables 114-116, herein below.

Analyzed Tomato tissues—Two tissues at different developmental stages [flower and leaf], representing different plant characteristics, were sampled and RNA was extracted as described above. For convenience, each micro-array expression information tissue type has received a Set ID as summarized in Table 112 below.

TABLE 112

Tomato transcriptome expression sets

| Expression Set | Set ID |
|---|---|
| Leaf at reproductive stage under normal conditions | 1 |
| Flower under normal conditions | 2 |
| Leaf at reproductive stage under low N conditions | 3 |
| Flower under low N conditions | 4 |
| Leaf at reproductive stage under drought conditions | 5 |
| Flower under drought conditions | 6 |

Table 112: Provided are the identification (ID) digits of each of the tomato expression sets.

The collected data parameters were as follows:

Fruit Weight (gr.)—At the end of the experiment [when 50% of the fruits were ripe (red)] all fruits from plots within blocks A-C were collected. The total fruits were counted and weighted. The average fruits weight was calculated by dividing the total fruit weight by the number of fruits.

Yield/SLA—Fruit yield divided by the specific leaf area (SLA) gives a measurement of the balance between reproductive and vegetative processes.

Yield/total leaf area—Fruit yield divided by the total leaf area, gives a measurement of the balance between reproductive and vegetative processes.

Plant vegetative Weight (FW) (gr.)—At the end of the experiment [when 50% of the fruit were ripe (red)] all plants from plots within blocks A-C were collected. Fresh weight was measured (grams).

Inflorescence Weight (gr.)—At the end of the experiment [when 50% of the fruits were ripe (red)] two Inflorescence from plots within blocks A-C were collected. The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula 1 as described above.

Plants that maintain high relative water content (RWC) compared to control lines were considered more tolerant to drought than those exhibiting reduced relative water content.

TABLE 113

Tomato correlated parameters (vectors)

| Correlated parameter with | Correlation ID |
|---|---|
| Total Leaf Area [cm$^2$], under Normal growth conditions | 1 |
| Leaflet Length [cm], under Normal growth conditions | 2 |
| Leaflet Width [cm], under Normal growth conditions | 3 |
| 100 weight green fruit [gr.], under Normal growth conditions | 4 |
| 100 weight red fruit [gr.], under Normal growth conditions | 5 |
| SLA [leaf area/plant biomass] [cm$^2$/gr], under Normal growth conditions | 6 |
| Yield/total leaf area [gr./cm$^2$], under Normal growth conditions | 7 |
| Yield/SLA [gr./(cm$^2$/gr.)], under Normal growth conditions | 8 |
| NUE [yield/SPAD] [gr./number], under Normal growth conditions | 9 |
| NUpE [biomass/SPAD] [gr./number], under Normal growth conditions | 10 |
| HI [yield/yield + biomass], under Normal growth conditions | 11 |
| NUE2 [total biomass/SPAD] [gr./number], under Normal growth conditions | 12 |
| 100 weight red fruit [gr.], under Low N growth conditions | 13 |
| Fruit Yield/Plant [gr./number], under Low N growth conditions | 14 |
| FW/Plant [gr./number], under Low N growth conditions | 15 |
| Average red fruit weight [gr.], under Low N growth conditions | 16 |
| Fruit number (ratio, Low N/Normal conditions) | 17 |
| FW [gr.] (ratio, Low N/Normal conditions) | 18 |
| SPAD, under Low N growth conditions | 19 |
| RWC, under Low N growth conditions | 20 |
| SPAD 100% RWC, under Low N growth conditions | 21 |
| SPAD (ratio, Low N/Normal) | 22 |
| SPAD 100% RWC (ratio, Low N/Normal) | 23 |
| RWC (ratio, Low N/Normal) | 24 |
| No flowers (Low N conditions) | 25 |
| Weight clusters (flowers) (Low N conditions) | 26 |
| Num. Flowers (ratio, Low N/Normal) | 27 |
| Cluster Weight (ratio, Low N/Normal) | 28 |
| NUE [yield/SPAD], under Low N growth conditions | 29 |
| NUpE [biomass/SPAD], under Low N growth conditions | 30 |
| HI [yield/yield + biomass], under Low N growth conditions | 31 |
| NUE2 [total biomass/SPAD] [gr./number], under Low N growth conditions | 32 |
| Total Leaf Area [cm$^2$], under Low N growth conditions | 33 |
| Leaflet Length [cm], under Low N growth conditions | 34 |
| Leaflet Width [cm], under Low N growth conditions | 35 |
| 100 weight green fruit [gr.], under Low N growth conditions | 36 |

TABLE 113-continued

Tomato correlated parameters (vectors)

| Correlated parameter with | Correlation ID |
|---|---|
| SLA [leaf area/plant biomass] [cm$^2$/gr], under Low N growth conditions | 37 |
| Yield/total leaf area [gr/cm$^2$], under Low N growth conditions | 38 |
| Yield/SLA [gr./(cm$^2$/gr.)], under Low N growth conditions | 39 |
| RWC, under Drought growth conditions | 40 |
| RWC (ratio, Drought/Normal) | 41 |
| Number of flowers, under Drought growth conditions | 42 |
| Weight flower clusters [gr.], under Drought growth conditions | 43 |
| Number of Flower (ratio, Drought/Normal) | 44 |
| Number of Flower (ratio, Drought/Low N) | 45 |
| Flower cluster weight (ratio, Drought/Normal) | 46 |
| Flower cluster weight (ratio, Drought/Low N) | 47 |
| Fruit Yield/Plant [gr./number], under Drought growth conditions | 48 |
| FW/Plant [gr./number], under Drought growth conditions | 49 |
| Average red fruit weight [gr.], under Drought growth conditions | 50 |
| Fruit Yield (ratio, Drought/Normal) | 51 |
| Fruit (ratio, Drought/Low N) | 52 |
| FW (ratio, Drought/Normal) | 53 |
| Red fruit weight (ratio, Drought/Normal) | 54 |
| Total Leaf Area [cm$^2$], under Drought growth conditions | 55 |
| Leaflet Length [cm]), under Drought growth conditions | 56 |
| Leaflet Width [cm], under Drought growth conditions | 57 |
| 100 weight green fruit [gr.], under Drought growth conditions | 58 |
| 100 weight red fruit [gr.], under Drought growth conditions | 59 |
| Fruit yield/Plant [gr.], under Normal growth conditions | 60 |
| FW/Plant [gr./number], under Normal growth conditions | 61 |
| Average red fruit weight [gr.], under Normal growth conditions | 62 |
| SPAD, under Normal growth conditions | 63 |
| RWC, under Normal growth conditions | 64 |
| SPAD 100% RWC, under Normal growth conditions | 65 |
| Number of flowers, under Normal growth conditions | 66 |
| Weight Flower clusters [gr.], under Normal growth conditions | 67 |

Table 113. Provided are the tomato correlated parameters,
"low N" = low nitrogen growth conditions, nitrogen deficiency as described above,
"gr." = grams;
"FW" = fresh weight;
"NUE" = nitrogen use efficiency;
"RWC" = relative water content;
"NUpE" = nitrogen uptake efficiency;
"SPAD" = chlorophyll levels;
"HI" = harvest index (vegetative weight divided on yield);
"SLA" = specific leaf area (leaf area divided by leaf dry weight).
"ratio, Low N/Normal conditions" = the ratio between values measured under low N growth conditions to the values measured under normal growth conditions;
"ratio, Drought/Normal" = the ratio between the values measured under drought growth conditions to the values measured under normal growth conditions;
"ratio, Drought/Low N" = the ratio between the values measured under drought growth conditions and the values measured under low N growth conditions;

Experimental Results

Table 113 provides the tomato correlated parameters (Vectors). The average for each of the measured parameters was calculated using the JMP software and values are summarized in Tables 114-116 below. Subsequent correlation analysis was conducted (Table 117). Results were integrated to the database.

TABLE 114

Measured parameters in Tomato accessions (lines 1-6)

| Line/Corr. ID | Line-1 | Line-2 | Line-3 | Line-4 | Line-5 | Line-6 |
|---|---|---|---|---|---|---|
| 1 | | | 426.1 | 582.4 | 291.4 | 593.6 |
| 2 | | | 6.34 | 7.99 | 5.59 | 7.70 |
| 3 | | | 3.69 | 4.77 | 3.43 | 4.56 |

TABLE 114-continued

Measured parameters in Tomato accessions (lines 1-6)

| Line/Corr. ID | Line-1 | Line-2 | Line-3 | Line-4 | Line-5 | Line-6 |
|---|---|---|---|---|---|---|
| 4 | | | 0.56 | 3.05 | 0.24 | 2.58 |
| 5 | | | 0.82 | 2.46 | 0.50 | 2.76 |
| 6 | | | 141 | 689.7 | 130.2 | 299.1 |
| 7 | | | 0.0012 | 0.0002 | 0.0017 | 0.0008 |
| 8 | | | 0.0035 | 0.0002 | 0.0037 | 0.0015 |
| 9 | 0.0166 | 0.0092 | 0.0089 | 0.0026 | 0.0101 | 0.0105 |
| 10 | 0.0307 | 0.0853 | 0.0542 | 0.0182 | 0.0464 | 0.0457 |
| 11 | 0.351 | 0.097 | 0.14 | 0.125 | 0.179 | 0.186 |
| 12 | 0.0473 | 0.0945 | 0.063 | 0.0208 | 0.0565 | 0.0562 |
| 13 | 1.06 | 6.87 | 0.65 | 0.53 | 7.17 | 0.44 |
| 14 | 0.41 | 0.66 | 0.48 | 0.46 | 1.35 | 0.35 |
| 15 | 4.04 | 1.21 | 2.25 | 2.54 | 1.85 | 3.06 |
| 16 | 0.0239 | 0.1907 | 0.0065 | 0.0053 | 0.0963 | 0.0044 |
| 17 | 0.49 | 1.93 | 0.97 | 3.80 | 2.78 | 0.78 |
| 18 | 2.65 | 0.38 | 0.74 | 3.01 | 0.83 | 1.54 |
| 19 | 38.40 | 39.40 | 47.50 | 37.00 | 44.60 | 41.70 |
| 20 | 74.10 | 99.10 | 69.50 | 63.20 | 77.40 | 77.90 |
| 21 | 28.50 | 39.00 | 33.00 | 23.40 | 34.50 | 32.50 |
| 22 | 0.77 | 1.06 | 0.85 | 0.80 | 0.93 | 0.96 |
| 23 | 0.79 | 1.37 | 0.92 | 0.75 | 1.31 | 0.97 |
| 24 | 1.02 | 1.30 | 1.08 | 0.94 | 1.41 | 1.00 |
| 25 | 19.00 | 5.30 | 9.00 | 13.00 | 10.70 | 16.70 |
| 26 | 0.53 | 0.37 | 0.31 | 0.35 | 0.47 | 0.25 |
| 27 | 3.35 | 0.28 | 1.42 | 1.70 | 1.10 | 2.00 |
| 28 | 0.457 | 1.072 | 0.442 | 0.006 | 1.076 | 0.022 |
| 29 | 0.0142 | 0.0169 | 0.0144 | 0.0196 | 0.0391 | 0.0109 |
| 30 | 0.1419 | 0.0311 | 0.068 | 0.1085 | 0.0536 | 0.0942 |
| 31 | 0.091 | 0.352 | 0.175 | 0.153 | 0.422 | 0.104 |
| 32 | 0.1562 | 0.048 | 0.0825 | 0.128 | 0.0927 | 0.1051 |
| 33 | 565.9 | 384.8 | 294.8 | 378 | 476.4 | 197.1 |
| 34 | 6.40 | 5.92 | 3.69 | 5.43 | 6.95 | 3.73 |
| 35 | 3.47 | 1.97 | 1.79 | 2.55 | 3.52 | 1.73 |
| 36 | 0.87 | 3.66 | 0.57 | 0.37 | 3.40 | 0.68 |
| 37 | 140.00 | 317.10 | 131.30 | 148.80 | 257.50 | 64.30 |
| 38 | 0.0007 | 0.0017 | 0.0016 | 0.0012 | 0.0028 | 0.0018 |
| 39 | 0.0029 | 0.0021 | 0.0036 | 0.0031 | 0.0052 | 0.0055 |
| 40 | 72.10 | 74.50 | 65.30 | 72.20 | 66.10 | 68.30 |
| 41 | 0.99 | 0.97 | 1.02 | 1.08 | 1.21 | 0.88 |
| 42 | 16.70 | 6.50 | 15.70 | 20.30 | 11.70 | 25.30 |
| 43 | 0.368 | 0.407 | 0.325 | 0.288 | 0.551 | 0.311 |
| 44 | 2.94 | 0.34 | 2.47 | 2.65 | 1.21 | 3.04 |
| 45 | 0.88 | 1.22 | 1.74 | 1.56 | 1.09 | 1.52 |
| 46 | 0.32 | 1.19 | 0.47 | 0.01 | 1.25 | 0.03 |
| 47 | 0.69 | 1.11 | 1.06 | 0.82 | 1.16 | 1.25 |
| 48 | 0.467 | 0.483 | 0.629 | 0.347 | 2.044 | 0.25 |
| 49 | 2.62 | 1.09 | 1.85 | 2.22 | 2.63 | 2.71 |
| 50 | 0.0092 | 0.1948 | 0.209 | 0.0047 | 0.102 | 0.0019 |
| 51 | 0.57 | 1.41 | 1.27 | 2.88 | 4.2 | 0.55 |
| 52 | 1.15 | 0.73 | 1.32 | 0.76 | 1.51 | 0.71 |
| 53 | 1.72 | 0.34 | 0.61 | 2.63 | 1.18 | 1.36 |
| 54 | 0.19 | 24.37 | 25.38 | 0.02 | 20.26 | 0.04 |
| 60 | 0.826 | 0.342 | 0.494 | 0.121 | 0.487 | 0.454 |
| 61 | 1.53 | 3.17 | 3.02 | 0.84 | 2.24 | 1.98 |
| 62 | 0.0479 | 0.008 | 0.0082 | 0.2861 | 0.005 | 0.0541 |
| 63 | 49.70 | 37.20 | 55.80 | 46.40 | 48.20 | 43.40 |
| 64 | 72.80 | 76.50 | 64.30 | 67.10 | 54.80 | 77.60 |
| 65 | 36.20 | 28.40 | 35.90 | 31.10 | 26.40 | 33.70 |
| 66 | 5.67 | 19.33 | 6.33 | 7.67 | 9.67 | 8.33 |
| 67 | 1.17 | 0.34 | 0.69 | 56.35 | 0.44 | 11.31 |

Table 114: Provided are the values of each of the parameters (as described above) measured in tomato accessions 1-6 (line numbers) under all growth conditions. Growth conditions are specified in the experimental procedure section.

TABLE 115

Measured parameters in Tomato accessions (lines 7-12)

| Line/Corr. ID | Line-7 | Line-8 | Line-9 | Line-10 | Line-11 | Line-12 |
|---|---|---|---|---|---|---|
| 1 | 947.6 | 233.4 | 340.7 | 339.1 | 190.1 | 421.8 |
| 2 | 7.85 | 6.22 | 6.16 | 5.65 | 4.39 | 4.44 |
| 3 | 4.44 | 3.15 | 3.37 | 3.13 | 2.40 | 2.02 |
| 4 | 6.32 | 5.75 | 0.38 | 0.30 | 1.95 | 2.53 |
| 5 | 5.32 | 5.24 | 0.61 | 0.66 | 2.70 | 0.70 |
| 6 | 1117.7 | 111.8 | 106.3 | 123.1 | 105 | 111.9 |

TABLE 115-continued

Measured parameters in Tomato accessions (lines 7-12)

| Line/Corr. ID | Line-7 | Line-8 | Line-9 | Line-10 | Line-11 | Line-12 |
|---|---|---|---|---|---|---|
| 7 | 0.0006 | 0.0019 | 0.0006 | 0.0009 | 0.0035 | 0.0004 |
| 8 | 0.0005 | 0.0039 | 0.002 | 0.0025 | 0.0063 | 0.0017 |
| 9 | 0.0123 | 0.0083 | 0.0036 | 0.0061 | 0.0166 | 0.004 |
| 10 | 0.0198 | 0.0392 | 0.0548 | 0.0539 | 0.0453 | 0.0792 |
| 11 | 0.384 | 0.174 | 0.061 | 0.101 | 0.268 | 0.048 |
| 12 | 0.0321 | 0.0474 | 0.0584 | 0.06 | 0.0618 | 0.0832 |
| 13 |  | 0.55 | 0.75 | 0.58 | 1.27 | 1.34 |
| 14 | 0.01 | 0.51 | 0.44 | 0.47 | 1.59 | 0.39 |
| 15 | 3.13 | 2.54 | 1.84 | 1.52 | 1.91 | 1.86 |
| 16 | 0.0055 | 0.0075 | 0.0058 | 0.0127 | 0.0212 | 0.0052 |
| 17 | 0.02 | 1.16 | 2.07 | 1.51 | 2.41 | 2.06 |
| 18 | 3.70 | 1.22 | 0.58 | 0.55 | 1.06 | 0.49 |
| 19 | 34.40 | 50.00 | 44.70 | 53.70 | 35.70 | 58.80 |
| 20 | 80.50 | 67.40 | 67.20 | 66.10 | 69.60 | 69.30 |
| 21 | 27.70 | 33.70 | 30.00 | 35.50 | 24.80 | 40.80 |
| 22 | 0.80 | 0.94 | 0.76 | 1.05 | 0.89 | 1.24 |
| 23 | 1.11 | 0.95 | 0.79 | 0.92 | 0.94 | 1.36 |
| 24 | 1.38 | 1.01 | 1.04 | 0.88 | 1.05 | 1.10 |
| 25 | 6.00 | 16.00 | 15.00 | 6.00 | 17.00 | 13.00 |
| 26 | 0.29 | 0.47 | 0.40 | 0.30 | 0.82 | 0.40 |
| 27 | 1.20 | 1.92 | 1.50 | 0.86 | 1.89 | 1.62 |
| 28 | 0.371 | 0.809 | 0.548 | 0.364 | 0.953 | 0.8 |
| 29 | 0.0003 | 0.0151 | 0.0145 | 0.0132 | 0.0642 | 0.0095 |
| 30 | 0.1133 | 0.0755 | 0.0614 | 0.0427 | 0.0771 | 0.0455 |
| 31 | 0.003 | 0.167 | 0.191 | 0.236 | 0.454 | 0.173 |
| 32 | 0.1136 | 0.0906 | 0.0759 | 0.0559 | 0.1413 | 0.055 |
| 33 | 453.2 | 625.5 | 748 | 454 | 164.9 | 338.3 |
| 34 | 4.39 | 6.72 | 6.66 | 4.39 | 3.90 | 5.29 |
| 35 | 1.87 | 3.54 | 3.28 | 2.52 | 2.61 | 2.61 |
| 36 | 0.45 | 0.47 | 0.54 | 0.39 | 0.97 | 0.91 |
| 37 | 144.60 | 246.10 | 405.50 | 299.30 | 86.20 | 182.30 |
| 38 | 0 | 0.0008 | 0.0006 | 0.001 | 0.0097 | 0.0011 |
| 39 | 0.0001 | 0.0021 | 0.0011 | 0.0016 | 0.0185 | 0.0021 |
| 40 | 78.10 | 18.50 | 73.20 | 62.50 | 67.20 | 75.80 |
| 41 | 1.34 | 0.28 | 1.13 | 0.83 | 1.01 | 1.20 |
| 42 | 29.70 | 17.30 | 14.70 | 29.70 | 15.00 | 10.30 |
| 43 | 0.445 | 0.555 | 0.304 | 0.315 | 0.308 | 0.311 |
| 44 | 5.95 | 2.08 | 1.47 | 4.24 | 1.67 | 1.29 |
| 45 | 4.96 | 1.08 | 0.98 | 4.94 | 0.88 | 0.79 |
| 46 | 0.56 | 0.96 | 0.42 | 0.38 | 0.36 | 0.62 |
| 47 | 1.52 | 1.19 | 0.76 | 1.04 | 0.38 | 0.78 |
| 48 | 0.045 | 0.453 | 0.292 | 1.017 | 0.6 | 0.494 |
| 49 | 3.41 | 2.11 | 1.95 | 1.76 | 1.72 | 1.92 |
| 50 | 0.0346 | 0.0063 | 0.0053 | 0.0049 | 0.0052 | 0.012 |
| 51 | 0.09 | 1.03 | 1.39 | 3.28 | 0.91 | 2.62 |
| 52 | 5.06 | 0.89 | 0.67 | 2.17 | 0.38 | 1.27 |
| 53 | 4.02 | 1.01 | 0.61 | 0.64 | 0.95 | 0.51 |
| 54 | 0.15 | 0.02 | 0.86 | 0.74 | 0.09 | 1.72 |
| 55 |  |  |  |  |  | 337.60 |
| 56 |  |  |  |  |  | 2.55 |
| 58 |  |  |  |  |  | 0.80 |
| 59 |  |  |  |  |  | 0.89 |
| 60 | 0.529 | 0.44 | 0.21 | 0.31 | 0.662 | 0.189 |
| 61 | 0.85 | 2.09 | 3.21 | 2.75 | 1.81 | 3.77 |
| 62 | 0.2306 | 0.2898 | 0.0061 | 0.0066 | 0.0577 | 0.007 |
| 63 | 42.90 | 53.30 | 58.50 | 51.10 | 40.00 | 47.60 |
| 64 | 58.20 | 66.50 | 64.70 | 75.20 | 66.20 | 63.20 |
| 65 | 25.00 | 35.50 | 37.90 | 38.40 | 26.50 | 30.10 |
| 66 | 5.00 | 8.33 | 10.00 | 7.00 | 9.00 | 8.00 |
| 67 | 0.79 | 0.58 | 0.73 | 0.83 | 0.86 | 0.50 |

Table 115: Provided are the values of each of the parameters (as described above) measured in tomato accessions 7-12 (line numbers) under all growth conditions. Growth conditions are specified in the experimental procedure section.

TABLE 116

Measured parameters in Tomato accessions (lines 13-18)

| Line/Corr. ID | Line-13 | Line-14 | Line-15 | Line-16 | Line-17 | Line-18 |
|---|---|---|---|---|---|---|
| 1 | 581.3 | 807.5 | 784.1 | 351.8 | 255.8 | 1078.1 |
| 2 | 6.77 | 7.42 | 6.71 | 5.87 | 4.16 | 10.29 |
| 3 | 3.80 | 3.74 | 2.98 | 3.22 | 2.09 | 5.91 |
| 4 | 1.42 | 2.03 | 1.39 | 2.27 | 0.45 | 0.42 |
| 5 | 2.64 | 4.67 | 2.17 | 0.49 | 0.34 | 0.75 |
| 6 | 307.9 | 419.4 | 365.8 | 212.9 | 84.9 | 469.9 |
| 7 | 0.0015 | 0.0003 | 0.0004 | 0.0009 | 0.0012 | 0.0003 |
| 8 | 0.0028 | 0.0007 | 0.0009 | 0.0015 | 0.0037 | 0.0006 |
| 9 | 0.0147 | 0.0057 | 0.008 | 0.006 | 0.0076 | 0.0049 |
| 10 | 0.0326 | 0.0399 | 0.0492 | 0.0303 | 0.0724 | 0.0388 |
| 11 | 0.311 | 0.124 | 0.139 | 0.165 | 0.095 | 0.113 |
| 12 | 0.0473 | 0.0455 | 0.0571 | 0.0363 | 0.0799 | 0.0437 |
| 13 | 0.52 | 0.57 | 0.94 | 6.17 | 3.67 | 11.32 |
| 14 | 0.32 | 0.45 | 0.14 | 0.40 | 1.44 | 0.50 |
| 15 | 2.47 | 2.62 | 1.08 | 1.17 | 0.92 | 1.09 |
| 16 | 0.0057 | 0.0475 | 0.3573 | 0.0367 | 0.6265 |  |
| 17 | 0.38 | 1.64 | 0.41 | 1.21 | 4.59 | 1.70 |
| 18 | 1.31 | 1.36 | 0.51 | 0.71 | 0.31 | 0.47 |
| 19 | 47.50 | 45.20 | 39.00 | 45.00 | 65.30 | 51.90 |
| 20 | 100.00 | 57.70 | 90.80 | 68.00 | 59.60 | 72.20 |
| 21 | 47.50 | 26.10 | 35.40 | 30.60 | 39.00 | 37.50 |
| 22 | 0.82 | 0.94 | 0.89 | 0.83 | 1.57 | 0.88 |
| 23 | 1.44 | 1.50 | 1.05 | 0.56 | 1.48 | 0.84 |
| 24 | 1.76 | 1.60 | 1.17 | 0.68 | 0.94 | 0.96 |
| 25 | 8.70 | 9.30 | 12.70 | 6.70 | 9.30 | 8.00 |
| 26 | 0.35 | 0.43 | 0.35 | 0.45 | 0.28 | 0.47 |
| 27 | 1.62 | 1.17 | 1.65 | 0.74 | 0.88 | 0.89 |
| 28 | 0.34 | 0.611 | 0.938 | 0.677 | 0.404 | 1.439 |
| 29 | 0.0068 | 0.0172 | 0.004 | 0.0129 | 0.037 | 0.0132 |
| 30 | 0.0521 | 0.1006 | 0.0307 | 0.0381 | 0.0236 | 0.029 |
| 31 | 0.115 | 0.146 | 0.116 | 0.253 | 0.61 | 0.313 |
| 32 | 0.0589 | 0.1178 | 0.0347 | 0.051 | 0.0606 | 0.0423 |
| 33 | 396 | 236.1 | 174.6 | 441.8 | 489.2 | 707.8 |
| 34 | 6.32 | 5.11 | 4.72 | 6.83 | 7.10 | 8.21 |
| 35 | 3.58 | 2.56 | 2.48 | 3.43 | 3.30 | 3.69 |
| 36 | 0.36 | 0.35 | 0.57 | 4.38 | 2.02 | 8.13 |
| 37 | 160.20 | 90.10 | 161.00 | 379.00 | 531.10 | 650.70 |
| 38 | 0.0008 | 0.0019 | 0.0008 | 0.0009 | 0.0029 | 0.0007 |
| 39 | 0.002 | 0.005 | 0.0009 | 0.001 | 0.0027 | 0.0008 |
| 40 | 62.80 | 70.70 | 55.80 | 75.20 | 63.70 | 62.30 |
| 41 | 1.11 | 1.97 | 0.72 | 0.75 | 1.01 | 0.83 |
| 42 | 18.30 | 12.00 | 20.30 | 12.70 | 12.70 | 11.30 |
| 43 | 8.36 | 0.288 | 0.342 | 0.441 | 0.268 | 0.426 |
| 44 | 3.44 | 1.50 | 2.65 | 1.41 | 1.19 | 1.26 |
| 45 | 2.12 | 1.29 | 1.61 | 1.90 | 1.36 | 1.42 |
| 46 | 8.20 | 0.41 | 0.91 | 0.67 | 0.38 | 1.31 |
| 47 | 24.12 | 0.67 | 0.97 | 0.99 | 0.95 | 0.91 |
| 48 | 0.272 | 0.679 | 0.14 | 0.529 | 0.554 | 0.414 |
| 49 | 2.21 | 3.73 | 0.75 | 1.76 | 0.63 | 1.11 |
| 50 | 0.0045 | 0.0063 | 0.3032 | 0.1376 | 0.0405 | 0.0885 |
| 51 | 0.32 | 2.48 | 0.41 | 1.62 | 1.76 | 1.42 |
| 52 | 0.84 | 1.51 | 0.98 | 1.34 | 0.38 | 0.84 |
| 53 | 1.17 | 1.94 | 0.35 | 1.06 | 0.21 | 0.48 |
| 54 | 0.17 | 0.02 | 10.50 | 27.89 | 11.79 | 9.98 |
| 55 | 130.80 | 557.90 | 176.70 | 791.90 | 517.00 | 832.30 |
| 56 | 3.38 | 7.14 | 5.48 | 8.62 | 6.35 | 6.77 |
| 57 | 2.04 | 4.17 | 3.09 | 4.69 | 3.87 | 2.91 |
| 58 | 0.28 | 0.38 | 0.63 | 2.86 | 1.16 | 4.40 |
| 59 | 0.35 | 0.63 | 2.27 | 7.40 | 2.94 | 11.60 |
| 60 | 0.852 | 0.273 | 0.347 | 0.327 | 0.314 | 0.291 |
| 61 | 1.89 | 1.93 | 2.14 | 1.65 | 3.01 | 2.29 |
| 62 | 0.0264 | 0.2611 | 0.0289 | 0.0049 | 0.0034 | 0.0089 |
| 63 | 57.90 | 48.30 | 43.60 | 54.50 | 41.60 | 59.10 |
| 64 | 56.80 | 36.00 | 77.60 | 100.00 | 63.20 | 75.10 |
| 65 | 32.90 | 17.40 | 33.80 | 54.50 | 26.30 | 44.40 |
| 66 | 5.33 | 8.00 | 7.67 | 9.00 | 10.67 | 9.00 |
| 67 | 1.02 | 0.70 | 0.38 | 0.66 | 0.70 | 0.33 |

Table 116: Provided are the values of each of the parameters (as described above) measured in tomato accessions 13-18 (line numbers) under all growth conditions. Growth conditions are specified in the experimental procedure section.

TABLE 117

Correlation between the expression level of selected genes of some embodiments of the invention invarious tissues and the phenotypic performance under normal and stress conditions across tomato ecotypes

| Gene Name | R | P value | Exp. set | Corr. ID | Gene Name | R | P value | Exp. set | Corr. ID |
|---|---|---|---|---|---|---|---|---|---|
| LYD996 | 0.93 | 2.61E−04 | 1 | 10 | LYD996 | 0.95 | 8.36E−05 | 1 | 12 |
| LYD993 | 0.91 | 1.97E−03 | 2 | 6 | LYD993 | 0.96 | 1.71E−04 | 2 | 1 |
| LYD998 | 0.79 | 1.16E−02 | 3 | 16 | LYD998 | 0.89 | 5.12E−04 | 4 | 31 |
| LYD998 | 0.74 | 1.38E−02 | 4 | 22 | LYD998 | 0.88 | 8.34E−04 | 4 | 17 |
| LYD993 | 0.95 | 2.87E−04 | 2 | 2 | LYD993 | 0.93 | 8.40E−04 | 2 | 3 |
| LYD989 | 0.91 | 1.84E−03 | 2 | 1 | LYD989 | 0.92 | 1.34E−03 | 2 | 2 |
| LYD998 | 0.88 | 8.80E−04 | 4 | 38 | LYD998 | 0.85 | 1.79E−03 | 4 | 29 |
| LYD991 | 0.83 | 2.69E−03 | 2 | 64 | LYD991 | 0.83 | 2.71E−03 | 1 | 61 |
| LYD954 | 0.81 | 1.56E−02 | 2 | 1 | LYD954 | 0.88 | 3.61E−03 | 2 | 2 |
| LBY406 | 0.72 | 1.96E−02 | 4 | 24 | LBY456 | 0.87 | 4.44E−03 | 2 | 5 |
| LYD954 | 0.92 | 1.23E−03 | 2 | 3 | LYD954 | 0.81 | 4.53E−03 | 4 | 20 |
| LBY456 | 0.72 | 4.36E−02 | 2 | 7 | LBY456 | 0.80 | 5.77E−03 | 4 | 31 |
| LBY458 | 0.73 | 1.59E−02 | 6 | 46 | LBY458 | 0.80 | 5.98E−03 | 6 | 47 |
| LYD950 | 0.80 | 1.76E−02 | 2 | 2 | LYD950 | 0.86 | 6.32E−03 | 2 | 3 |
| LBY458 | 0.79 | 1.22E−02 | 3 | 16 | LBY458 | 0.78 | 7.22E−03 | 6 | 43 |
| LBY406 | 0.71 | 2.25E−02 | 6 | 47 | LBY406 | 0.78 | 7.87E−03 | 3 | 36 |
| LYD999 | 0.74 | 1.40E−02 | 4 | 13 | LYD999 | 0.78 | 8.42E−03 | 4 | 28 |
| LBY286 | 0.86 | 1.61E−03 | 3 | 20 | LBY286 | 0.77 | 8.76E−03 | 2 | 67 |
| LYD952 | 0.79 | 6.57E−03 | 2 | 62 | LYD952 | 0.77 | 8.90E−03 | 2 | 67 |
| LYD954 | 0.71 | 2.24E−02 | 4 | 24 | LYD988 | 0.77 | 9.05E−03 | 3 | 28 |
| LYD999 | 0.80 | 1.74E−02 | 2 | 5 | LYD999 | 0.77 | 9.58E−03 | 4 | 36 |
| LBY457 | 0.80 | 5.25E−03 | 3 | 36 | LBY457 | 0.77 | 9.68E−03 | 3 | 13 |
| LYD991 | 0.76 | 1.00E−02 | 3 | 39 | LYD992 | 0.77 | 9.91E−03 | 1 | 66 |
| LYD950 | 0.88 | 9.03E−04 | 1 | 63 | LYD950 | 0.76 | 1.09E−02 | 6 | 43 |
| LYD950 | 0.81 | 4.64E−03 | 6 | 46 | LYD950 | 0.75 | 1.17E−02 | 6 | 47 |
| LYD993 | 0.83 | 2.68E−03 | 3 | 36 | LYD993 | 0.75 | 1.23E−02 | 3 | 13 |
| LYD989 | 0.73 | 2.47E−02 | 1 | 11 | LYD989 | 0.82 | 1.25E−02 | 2 | 6 |
| LYD997 | 0.71 | 5.00E−02 | 2 | 3 | LYD997 | 0.75 | 1.31E−02 | 4 | 36 |
| LBY404 | 0.71 | 2.19E−02 | 5 | 48 | LBY405 | 0.75 | 1.31E−02 | 4 | 20 |
| LBY406 | 0.83 | 1.07E−02 | 2 | 2 | LBY406 | 0.82 | 1.36E−02 | 2 | 3 |
| LBY406 | 0.73 | 4.13E−02 | 2 | 6 | LBY406 | 0.82 | 1.36E−02 | 2 | 1 |
| LYD950 | 0.70 | 2.33E−02 | 3 | 36 | LYD950 | 0.74 | 1.37E−02 | 4 | 21 |
| LBY406 | 0.71 | 2.18E−02 | 6 | 43 | LBY406 | 0.74 | 1.40E−02 | 6 | 46 |
| LBY406 | 0.76 | 1.13E−02 | 3 | 13 | LBY406 | 0.74 | 1.45E−02 | 4 | 20 |
| LBY286 | 0.71 | 2.17E−02 | 4 | 21 | LYD991 | 0.73 | 1.75E−02 | 3 | 20 |
| LYD989 | 0.89 | 3.06E−03 | 2 | 3 | LYD992 | 0.72 | 1.91E−02 | 5 | 40 |
| LYD992 | 0.86 | 1.31E−03 | 4 | 26 | LYD950 | 0.79 | 1.92E−02 | 2 | 1 |
| LYD950 | 0.75 | 3.12E−02 | 2 | 6 | LYD998 | 0.72 | 1.96E−02 | 3 | 22 |
| LYD997 | 0.72 | 1.82E−02 | 4 | 33 | LYD951 | 0.79 | 2.03E−02 | 2 | 2 |
| LYD951 | 0.86 | 6.74E−03 | 2 | 1 | LYD951 | 0.71 | 2.27E−02 | 1 | 63 |
| LYD951 | 0.79 | 2.00E−02 | 2 | 3 | LBY456 | 0.70 | 2.41E−02 | 4 | 14 |
| LBY456 | 0.77 | 8.52E−03 | 4 | 17 | LYD998 | 0.73 | 2.64E−02 | 4 | 16 |
| LYD998 | 0.88 | 8.07E−04 | 4 | 14 | LYD989 | 0.71 | 3.07E−02 | 1 | 9 |
| LYD988 | 0.79 | 6.02E−03 | 4 | 33 | LYD954 | 0.75 | 3.30E−02 | 2 | 6 |
| LYD953 | 0.71 | 4.63E−02 | 2 | 3 | LYD993 | 0.71 | 3.30E−02 | 1 | 11 |
| LYD993 | 0.74 | 1.36E−02 | 3 | 28 | LYD953 | 0.74 | 3.65E−02 | 2 | 2 |
| LYD953 | 0.75 | 3.34E−02 | 2 | 1 | LYD952 | 0.73 | 4.03E−02 | 2 | 2 |
| LYD952 | 0.79 | 1.93E−02 | 2 | 1 | LBY457 | 0.72 | 4.22E−02 | 2 | 1 |
| LBY457 | 0.79 | 6.56E−03 | 3 | 28 | LYD951 | 0.72 | 4.61E−02 | 2 | 5 |
| LYD951 | 0.79 | 1.87E−02 | 2 | 6 | LYD952 | 0.72 | 4.61E−02 | 2 | 6 |
| LYD951 | 0.80 | 5.87E−03 | 4 | 20 | MGP43 | 0.86 | 1.42E−03 | 3 | 20 |
| MGP43 | 0.78 | 8.34E−03 | 3 | 21 | MGP43 | 0.77 | 2.49E−02 | 2 | 8 |
| MGP43 | 0.74 | 2.40E−02 | 1 | 12 | MGP43 | 0.72 | 1.88E−02 | 2 | 64 |
| MGP43 | 0.79 | 1.86E−02 | 2 | 7 | MGP43 | 0.71 | 2.18E−02 | 4 | 13 |
| MGP43 | 0.76 | 1.03E−02 | 4 | 36 | MGP43 | 0.83 | 3.22E−03 | 1 | 64 |
| MGP43 | 0.88 | 9.09E−04 | 1 | 65 | | | | | |

Table 117: Provided are the correlations (R) between the expression levels yield improving genes and their homologs in various tissues [Expression (Exp) sets, Table 112] and the phenotypic performance [yield, biomass, growth rate and/or vigor components described in Tables 114-116 using the correlation (Corr.) vectors described in Table 113] under normal, low N and drought conditions across tomato ecotypes.
P = p value.

II. Correlation of Early Vigor Traits Across Collection of Tomato Ecotypes Under Salinity Stress (300 mM NaCl), Low Nitrogen and Normal Growth Conditions—Twelve tomato hybrids were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to the high salinity solution (300 mM NaCl in addition to the Full Hoagland solution), low nitrogen solution (the amount of total nitrogen was reduced in a 90% from the full Hoagland solution, final amount of 0.8 mM N), or at Normal growth solution (Full Hoagland containing 8 mM N solution, at 28±2° C.). All the plants were grown at 28±2° C.

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8.

Analyzed tomato tissues—Ten selected Tomato varieties were sample per each treatment. Two types of tissues [leaves and roots] were sampled and RNA was extracted as described above. For convenience, each micro-array expression information tissue type has received a Set ID as summarized in Table 118 below.

TABLE 118

Tomato transcriptome expression sets

| Expression Set | Set IDs |
|---|---|
| Leaf, under normal conditions | 1 + 10 |
| Root, under normal conditions | 2 + 9 |
| Leaf, under low nitrogen conditions | 3 + 8 |
| Root, under low nitrogen conditions | 4 + 7 |
| Leaf, under salinity conditions | 5 + 12 |
| Root, under salinity conditions | 6 + 11 |

Table 118. Provided are the tomato transcriptome experimental sets.

Tomato vigor related parameters—following 5 weeks of growing, plant were harvested and analyzed for leaf number, plant height, chlorophyll levels (SPAD units), different indices of nitrogen use efficiency (NUE) and plant biomass. Next, analyzed data was saved to text files and processed using the JMP statistical analysis software (SAS institute). Data parameters collected are summarized in Table 119, herein below.

Leaf number—number of opened leaves.

RGR Leaf Number—was calculated based on Formula 8 (above).

Shoot/Root ratio—was calculated based on Formula 30 (above).

NUE total biomass—nitrogen use efficiency (NUE) calculated as total biomass divided by nitrogen concentration.

NUE root biomass—nitrogen use efficiency (NUE) of root growth calculated as root biomass divided by nitrogen concentration.

NUE shoot biomass—nitrogen use efficiency (NUE) of shoot growth calculated as shoot biomass divided by nitrogen concentration.

Percent of reduction of root biomass compared to normal—the difference (reduction in percent) between root biomass under normal and under low nitrogen conditions.

Percent of reduction of shoot biomass compared to normal—the difference (reduction in percent) between shoot biomass under normal and under low nitrogen conditions.

Percent of reduction of total biomass compared to normal—the difference (reduction in percent) between total biomass (shoot and root) under normal and under low nitrogen conditions.

Plant height—Plants were characterized for height during growing period at 5 time points. In each measure, plants were measured for their height using a measuring tape. Height was measured from ground level to top of the longest leaf.

SPAD [SPAD unit]—Chlorophyll content was determined using a Minolta SPAD 502 chlorophyll meter and measurement was performed 64 days post sowing. SPAD meter readings were done on young fully developed leaf. Three measurements per leaf were taken per plot.

Root Biomass [DW, gr.]/SPAD—root biomass divided by SPAD results.

Shoot Biomass [DW, gr.]/SPAD—shoot biomass divided by SPAD results.

Total Biomass (Root+Shoot) [DW, gr.]/SPAD—total biomass divided by SPAD results.

TABLE 119

Tomato correlated parameters (vectors)

| Correlated parameter with | Correlation ID |
|---|---|
| Plant height [cm], under Low N growth conditions | 1 |
| SPAD [SPAD unit], under Low N growth conditions | 3 |
| Leaf number [ratio] (Low N conditions/Normal conditions) | 4 |
| Plant Height [ratio] (Low N conditions/Normal conditions) | 5 |
| SPAD [ratio] (Low N conditions/Normal conditions) | 6 |
| Leaf number [number] (Low N conditions) | 7 |
| NUE Shoot Biomass DW/SPAD [gr./SPAD unit] (Low N conditions, Normal conditions and salinity conditions) | 8 |
| NUE Root Biomass DW/SPAD [gr./SPAD unit] (Low N conditions, Normal conditions and salinity conditions) | 9 |
| NUE Total Biomass (Root + Shoot DW)/SPAD [gr./SPAD unit] (Low N conditions, Normal conditions and salinity conditions) | 10 |
| N level/Leaf [SPAD unit/leaf] (Low N conditions, Normal conditions and salinity conditions) | 11 |
| Shoot/Root [ratio] (Low N conditions and Normal conditions) | 12 |
| NUE shoots (shoot Biomass DW/SPAD) [gr./SPAD unit] (Low N conditions and Normal conditions) | 13 |
| NUE roots (Root Biomass DW/SPAD) [gr./SPAD unit] (Low N growth conditions and Normal growth conditions) | 14 |
| NUE total biomass (Total Biomass DW/SPAD) [gr./SPAD unit] (Low N growth conditions and Normal growth conditions) | 15 |
| Leaf number [number], under salinity stress growth conditions | 16 |
| Plant height [cm], under salinity stress growth conditions | 17 |
| Plant biomass [gr.], under salinity stress growth conditions | 18 |
| Leaf number [ratio] (Salinity conditions/Normal conditions) | 19 |
| Leaf number [ratio] (Salinity conditions/Low N conditions) | 20 |
| Plant Height [ratio] (Salinity conditions/Normal conditions) | 21 |
| Plant Height [ratio] (Salinity conditions/Low N conditions) | 22 |
| Percent of reduction of shoot biomass compared to normal [%][ratio] (Low N conditions/Normal conditions) | 23 |
| Percent of reduction of root biomass compared to normal [%][ratio] (Low N conditions/Normal conditions) | 24 |
| Leaf number [number] under Normal growth conditions | 25 |
| Plant height [cm] under Normal growth conditions | 26 |
| SPAD [SPAD unit] under Normal growth conditions | 27 |

Table 119. Provided are the tomato correlated parameters.
"NUE" = nitrogen use efficiency;
"DW" = dry weight; "cm" = centimeter;
"num"—number;
"SPAD" = chlorophyll levels;
"N" = nitrogen;
"low N" = low nitrogen growth conditions as described above;
"gr." = gram;
"Low N conditions/Normal conditions" = the ratio between the values measured under low N growth conditions to the values measured under normal growth conditions.
"Salinity conditions/Normal conditions" = the ratio between the values measured under salinity stress and the values measured under normal growth conditions.
"Salinity conditions/Low N conditions" = the ratio between the values measured under salinity stress growth conditions and the values measured under low N growth conditions.

Experimental Results 10 different Tomato varieties were grown and characterized for parameters as described above (Table 119). The average for each of the measured parameters was calculated using the JMP software and values are summarized in Tables 120-125 below. Subsequent correlation analysis was conducted (Table 126). Follow, results were integrated to the database.

TABLE 120

Measured parameters in Tomato accessions under normal conditions (lines 1-6)

| Line/Corr. ID | Line-1 | Line-2 | Line-3 | Line-4 | Line-5 | Line-6 |
|---|---|---|---|---|---|---|
| 8 | 0.0052 | 0.0061 | 0.0052 |  | 0.0144 | 0.0084 |
| 9 | 0.0012 | 0.0005 | 0.0006 |  | 0.0011 | 0.001 |
| 10 | 0.0064 | 0.0066 | 0.0058 |  | 0.0155 | 0.0093 |
| 11 | 9.29 | 10.18 | 8.87 |  | 8.43 | 9.83 |
| 12 | 5.40 | 12.65 | 10.02 |  | 15.42 | 8.83 |
| 13 | 4.69 | 6.17 | 4.37 |  | 13.08 | 7.39 |
| 14 | 1.12 | 0.54 | 0.47 |  | 1.00 | 0.84 |
| 15 | 7.47 | 9.10 | 8.63 |  | 8.85 | 7.22 |
| 25 | 6.56 |  | 6.89 | 7.33 | 6.22 | 6.33 |
| 26 | 45.30 |  | 47.80 | 40.80 | 55.30 | 56.20 |
| 27 | 34.30 |  | 25.30 | 28.10 | 31.40 | 30.20 |

Table 120: Provided are the values of each of the parameters (as described above) measured in Tomato accessions (Line) under normal growth conditions. Growth conditions are specified in the experimental procedure section.

TABLE 121

Measured parameters in Tomato accessions under normal conditions (lines 7-12)

| Line/Corr. ID | Line-7 | Line-8 | Line-9 | Line-10 | Line-11 | Line-12 |
|---|---|---|---|---|---|---|
| 8 | 0.0054 | 0.0174 | 0.0072 | 0.0109 | 0.0117 | 0.0094 |
| 9 | 0.0011 | 0.0014 | 0.001 | 0.001 | 0.0025 | 0.0017 |
| 10 | 0.0065 | 0.0188 | 0.0082 | 0.0119 | 0.0143 | 0.011 |
| 11 | 8.57 | 6.57 | 6.97 | 8.71 | 7.35 | 9.37 |
| 12 | 7.52 | 12.61 | 7.99 | 14.31 | 4.80 | 6.29 |
| 13 | 5.65 | 17.94 | 5.56 | 11.96 | 10.37 | 10.10 |
| 14 | 0.83 | 0.94 | 0.81 | 1.08 | 2.25 | 1.82 |
| 15 | 7.87 | 9.09 | 7.91 | 8.55 | 8.68 | 6.24 |
| 25 | 6.44 | 5.89 | 5.56 | 6.11 | 5.67 |  |
| 26 | 48.70 | 55.80 | 37.40 | 49.60 | 46.30 |  |
| 27 | 32.40 | 32.60 | 28.80 | 30.90 | 29.00 |  |

Table 121: Provided are the values of each of the parameters (as described above) measured in Tomato accessions (Line) under normal growth conditions. Growth conditions are specified in the experimental procedure section.

TABLE 122

Measured parameters in Tomato accessions under low nitrogen conditions (lines 1-6)

| Line/Corr. ID | Line-1 | Line-2 | Line-3 | Line-4 | Line-5 | Line-6 |
|---|---|---|---|---|---|---|
| 1 | 36.80 |  | 39.90 | 34.40 | 47.00 | 46.40 |
| 3 | 34.60 |  | 24.90 | 28.60 | 31.60 | 29.70 |
| 4 | 0.85 |  | 0.90 | 0.98 | 1.09 | 0.88 |
| 5 | 0.81 |  | 0.83 | 0.84 | 0.85 | 0.83 |
| 6 | 1.01 |  | 0.98 | 1.02 | 1.00 | 0.98 |
| 7 | 5.56 |  | 6.22 | 7.22 | 6.78 | 5.56 |
| 8 | 0.0041 | 0.0042 | 0.003 |  | 0.0072 | 0.0049 |
| 9 | 0.0008 | 0.0008 | 0.0003 |  | 0.0008 | 0.0005 |
| 10 | 0.005 | 0.005 | 0.0034 |  | 0.008 | 0.0055 |
| 11 | 10.90 | 11.50 | 11.40 |  | 10.40 | 11.20 |
| 12 | 5.01 | 6.41 | 11.39 |  | 9.49 | 11.60 |
| 13 | 35.40 | 38.40 | 24.10 |  | 65.00 | 46.70 |
| 14 | 6.99 | 7.73 | 2.54 |  | 7.04 | 5.04 |
| 15 | 58.50 | 69.70 | 63.80 |  | 69.30 | 71.10 |
| 23 | 75.40 | 62.20 | 55.10 |  | 49.70 | 63.20 |
| 24 | 62.60 | 143.70 | 54.20 |  | 70.50 | 59.70 |

Table 122: Provided are the values of each of the parameters (as described above) measured in Tomato accessions (Line) under low nitrogen growth conditions. Growth conditions are specified in the experimental procedure section.

TABLE 123

Measured parameters in Tomato accessions under low nitrogen conditions (lines 7-12)

| Line/Corr. ID | Line-7 | Line-8 | Line-9 | Line-10 | Line-11 | Line-12 |
|---|---|---|---|---|---|---|
| 1 | 45.40 | 47.70 | 39.30 | 41.80 | 41.00 |  |
| 3 | 31.80 | 30.30 | 30.30 | 31.30 | 28.80 |  |
| 4 | 1.02 | 0.87 | 1.06 | 0.91 | 1.12 |  |
| 5 | 0.93 | 0.85 | 1.05 | 0.84 | 0.88 |  |
| 6 | 0.98 | 0.93 | 1.05 | 1.01 | 0.99 |  |
| 7 | 6.56 | 5.11 | 5.89 | 5.56 | 6.33 |  |
| 8 | 0.0052 | 0.0115 | 0.0069 | 0.0068 | 0.0067 | 0.0056 |
| 9 | 0.0009 | 0.0014 | 0.001 | 0.0009 | 0.0009 | 0.0015 |
| 10 | 0.006 | 0.0129 | 0.0079 | 0.0077 | 0.0076 | 0.007 |
| 11 | 8.90 | 7.90 | 8.00 | 10.30 | 8.60 | 14.50 |
| 12 | 8.20 | 10.38 | 10.52 | 8.24 | 7.97 | 3.91 |
| 13 | 46.70 | 120.10 | 60.10 | 66.30 | 56.50 | 60.30 |
| 14 | 8.01 | 15.09 | 9.02 | 8.78 | 7.25 | 15.94 |
| 15 | 60.50 | 73.90 | 68.80 | 66.70 | 70.80 | 49.70 |
| 23 | 82.70 | 66.90 | 108.00 | 55.40 | 54.40 | 59.70 |
| 24 | 96.10 | 106.50 | 111.90 | 81.60 | 32.20 | 87.50 |

Table 123: Provided are the values of each of the parameters (as described above) measured in Tomato accessions (Line) under low nitrogen growth conditions. Growth conditions are specified in the experimental procedure section.

TABLE 124

Measured parameters in Tomato accessions under salinity conditions (lines 1-6)

| Line/Corr. ID | Line-1 | Line-2 | Line-3 | Line-4 | Line-5 | Line-6 |
|---|---|---|---|---|---|---|
| 8 | 0.0005 | 0.0007 | 0.0007 |  | 0.0012 | 0.0017 |
| 9 | 0.0001 | 0.0001 | 0.0001 |  | 0.0001 | 0.0001 |
| 10 | 0.0007 | 0.0006 | 0.0008 |  | 0.0014 | 0.0018 |
| 11 | 11.40 | 10.40 | 11.60 |  | 10.80 | 10.80 |
| 16 | 3.56 |  | 3.94 | 5.00 | 4.00 | 3.56 |
| 17 | 5.60 |  | 6.46 | 8.47 | 8.56 | 8.87 |
| 18 | 0.36 |  | 0.44 | 0.26 | 0.71 | 0.46 |
| 19 | 0.54 |  | 0.57 | 0.68 | 0.64 | 0.56 |
| 20 | 0.64 |  | 0.63 | 0.69 | 0.59 | 0.64 |
| 21 | 0.12 |  | 0.14 | 0.21 | 0.15 | 0.16 |
| 22 | 0.15 |  | 0.16 | 0.25 | 0.18 | 0.19 |

Table 124: Provided are the values of each of the parameters (as described above) measured in Tomato accessions (Line) under salinity growth conditions. Growth conditions are specified in the experimental procedure section.

TABLE 125

Measured parameters in Tomato accessions under salinity conditions (lines 7-12)

| Line/Corr. ID | Line-7 | Line-8 | Line-9 | Line-10 | Line-11 | Line-12 |
|---|---|---|---|---|---|---|
| 8 | 0.001 | 0.0012 | 0.0007 | 0.001 | 0.001 | 0.0007 |
| 9 | 0.0001 | 0.0001 | 0.0001 | 0.0001 |  | 0.0001 |
| 10 | 0.0011 | 0.0013 | 0.0008 | 0.0011 |  | 0.0007 |
| 11 | 7.00 | 9.20 | 8.50 | 10.40 | 8.80 | 12.40 |
| 16 | 4.39 | 3.17 | 3.72 | 4.00 | 4.28 |  |
| 17 | 7.56 | 8.64 | 5.57 | 5.82 | 9.36 |  |
| 18 | 0.54 | 0.66 | 0.40 | 0.52 | 0.45 |  |
| 19 | 0.68 | 0.54 | 0.67 | 0.65 | 0.75 |  |
| 20 | 0.67 | 0.62 | 0.63 | 0.72 | 0.68 |  |
| 21 | 0.16 | 0.15 | 0.15 | 0.12 | 0.20 |  |
| 22 | 0.17 | 0.18 | 0.14 | 0.14 | 0.23 |  |

Table 125: Provided are the values of each of the parameters (as described above) measured in Tomato accessions (Line) under salinity growth conditions. Growth conditions are specified in the experimental procedure section.

TABLE 126

Correlation between the expression level of selected genes of some embodiments of the invention in various tissues and the phenotypic performance under low nitrogen, normal or salinity stress conditions across Tomato accessions

| Gene Name | R | P value | Exp. set | Corr. ID | Gene Name | R | P value | Exp. set | Corr. ID |
|---|---|---|---|---|---|---|---|---|---|
| LBY286 | 0.88 | 1.84E−03 | 6 | 8 | LBY286 | 0.85 | 6.97E−03 | 6 | 10 |
| LBY286 | 0.75 | 3.32E−02 | 4 | 5 | LBY286 | 0.74 | 3.64E−02 | 4 | 4 |
| LBY286 | 0.72 | 2.72E−02 | 3 | 23 | LBY310 | 0.76 | 1.77E−02 | 4 | 11 |
| LBY404 | 0.75 | 3.33E−02 | 5 | 9 | LBY405 | 0.85 | 7.34E−03 | 1 | 25 |
| LBY405 | 0.89 | 1.39E−03 | 4 | 11 | LBY405 | 0.79 | 2.05E−02 | 4 | 7 |
| LBY405 | 0.80 | 1.83E−02 | 3 | 7 | LBY405 | 0.74 | 3.48E−02 | 2 | 25 |
| LBY406 | 0.70 | 2.42E−02 | 6 | 19 | LBY406 | 0.75 | 1.34E−02 | 6 | 22 |
| LBY406 | 0.75 | 1.94E−02 | 4 | 11 | LBY406 | 0.72 | 2.72E−02 | 6 | 8 |
| LBY406 | 0.78 | 2.29E−02 | 5 | 9 | LBY406 | 0.76 | 2.74E−02 | 4 | 7 |
| LBY406 | 0.84 | 2.58E−03 | 6 | 21 | LBY406 | 0.72 | 3.01E−02 | 2 | 11 |
| LBY406 | 0.76 | 2.91E−02 | 6 | 10 | LBY456 | 0.87 | 2.56E−03 | 2 | 12 |
| LBY456 | 0.81 | 8.43E−03 | 4 | 11 | LBY457 | 0.79 | 6.05E−03 | 6 | 18 |
| LBY456 | 0.74 | 3.61E−02 | 2 | 25 | LBY457 | 0.83 | 1.13E−02 | 6 | 10 |
| LBY456 | 0.71 | 4.79E−02 | 2 | 26 | LBY456 | 0.75 | 1.99E−02 | 2 | 15 |
| LBY457 | 0.71 | 2.10E−02 | 6 | 17 | LBY458 | 0.85 | 3.74E−03 | 4 | 8 |
| LBY457 | 0.72 | 4.53E−02 | 4 | 1 | LBY458 | 0.76 | 2.81E−02 | 3 | 5 |
| LBY457 | 0.77 | 1.61E−02 | 6 | 8 | LBY457 | 0.86 | 5.97E−03 | 2 | 26 |
| LBY458 | 0.84 | 4.97E−03 | 4 | 8 | LBY458 | 0.82 | 6.36E−03 | 4 | 13 |
| LBY458 | 0.79 | 1.07E−02 | 4 | 9 | LBY458 | 0.79 | 1.07E−02 | 4 | 9 |
| LBY458 | 0.86 | 3.27E−03 | 4 | 10 | LBY458 | 0.84 | 4.29E−03 | 4 | 10 |
| LBY458 | 0.81 | 8.06E−03 | 4 | 14 | LBY458 | 0.81 | 7.76E−03 | 4 | 14 |
| LBY458 | 0.84 | 4.95E−03 | 4 | 13 | LYD951 | 0.75 | 3.10E−02 | 4 | 5 |
| LBY458 | 0.79 | 1.11E−02 | 3 | 23 | LYD950 | 0.75 | 3.12E−02 | 4 | 3 |
| LYD950 | 0.74 | 2.38E−02 | 4 | 11 | LYD950 | 0.93 | 6.54E−04 | 6 | 10 |
| LYD950 | 0.73 | 4.04E−02 | 2 | 27 | LYD951 | 0.71 | 3.08E−02 | 6 | 8 |
| LYD950 | 0.97 | 8.50E−06 | 6 | 8 | LYD952 | 0.90 | 2.10E−03 | 4 | 7 |
| LYD950 | 0.76 | 2.89E−02 | 5 | 9 | LYD950 | 0.70 | 5.11E−02 | 2 | 25 |
| LYD951 | 0.80 | 1.61E−02 | 4 | 4 | LYD954 | 0.73 | 3.82E−02 | 4 | 7 |
| LYD951 | 0.74 | 3.41E−02 | 3 | 7 | LYD953 | 0.71 | 4.83E−02 | 3 | 6 |
| LYD952 | 0.85 | 7.05E−03 | 3 | 7 | LYD988 | 0.83 | 5.30E−03 | 4 | 13 |
| LYD953 | 0.71 | 4.99E−02 | 3 | 7 | LYD988 | 0.78 | 1.27E−02 | 2 | 8 |
| LYD954 | 0.71 | 2.21E−02 | 6 | 18 | LYD988 | 0.80 | 9.96E−03 | 4 | 10 |
| LYD988 | 0.75 | 2.03E−02 | 4 | 14 | LYD991 | 0.77 | 1.55E−02 | 4 | 13 |
| LYD988 | 0.80 | 9.76E−03 | 4 | 8 | LYD991 | 0.74 | 2.16E−02 | 4 | 9 |
| LYD988 | 0.76 | 1.64E−02 | 2 | 10 | LYD988 | 0.79 | 1.11E−02 | 2 | 13 |
| LYD989 | 0.71 | 2.08E−02 | 6 | 17 | LYD991 | 0.73 | 2.47E−02 | 4 | 10 |
| LYD991 | 0.72 | 2.84E−02 | 4 | 8 | LYD992 | 0.71 | 3.08E−02 | 2 | 13 |
| LYD991 | 0.80 | 9.12E−03 | 4 | 14 | LYD992 | 0.78 | 1.31E−02 | 4 | 8 |
| LYD991 | 0.71 | 2.16E−02 | 5 | 18 | LYD992 | 0.83 | 5.82E−03 | 1 | 9 |
| LYD992 | 0.78 | 1.36E−02 | 4 | 8 | LYD995 | 0.71 | 3.16E−02 | 4 | 9 |
| LYD992 | 0.78 | 1.26E−02 | 4 | 10 | LYD992 | 0.78 | 1.31E−02 | 4 | 10 |
| LYD992 | 0.86 | 3.19E−03 | 1 | 14 | LYD992 | 0.83 | 5.21E−03 | 4 | 13 |
| LYD992 | 0.72 | 3.02E−02 | 2 | 13 | LYD993 | 0.73 | 1.60E−02 | 6 | 17 |
| LYD992 | 0.79 | 1.05E−02 | 4 | 14 | LYD992 | 0.79 | 1.05E−02 | 4 | 14 |
| LYD992 | 0.84 | 5.02E−03 | 4 | 13 | LYD995 | 0.78 | 1.41E−02 | 4 | 8 |
| LYD995 | 0.74 | 2.25E−02 | 4 | 8 | LYD995 | 0.75 | 2.06E−02 | 4 | 10 |
| LYD995 | 0.82 | 7.31E−03 | 4 | 14 | LYD995 | 0.81 | 7.67E−03 | 4 | 13 |
| LYD995 | 0.72 | 2.88E−02 | 2 | 8 | LYD995 | 0.72 | 1.92E−02 | 6 | 18 |
| LYD995 | 0.74 | 1.50E−02 | 5 | 18 | LYD995 | 0.84 | 4.99E−03 | 4 | 14 |
| LYD995 | 0.73 | 2.48E−02 | 4 | 9 | LYD997 | 0.97 | 1.46E−05 | 4 | 8 |
| LYD995 | 0.72 | 2.79E−02 | 2 | 13 | LYD996 | 0.80 | 9.60E−03 | 4 | 12 |
| LYD995 | 0.84 | 4.19E−03 | 4 | 13 | LYD996 | 0.72 | 4.38E−02 | 3 | 7 |
| LYD995 | 0.78 | 1.28E−02 | 4 | 10 | LYD995 | 0.71 | 3.18E−02 | 2 | 10 |
| LYD996 | 0.71 | 3.35E−02 | 4 | 24 | LYD997 | 0.86 | 2.85E−03 | 2 | 8 |
| LYD997 | 0.85 | 3.55E−03 | 2 | 10 | LYD997 | 0.86 | 2.99E−03 | 2 | 10 |
| LYD997 | 0.97 | 1.47E−05 | 4 | 8 | LYD997 | 0.97 | 1.32E−05 | 4 | 10 |
| LYD997 | 0.89 | 1.12E−03 | 4 | 14 | LYD997 | 0.97 | 8.74E−06 | 4 | 13 |
| LYD997 | 0.97 | 1.31E−05 | 4 | 10 | LYD997 | 0.85 | 3.88E−03 | 4 | 9 |
| LYD997 | 0.87 | 2.49E−03 | 2 | 8 | LYD999 | 0.74 | 2.32E−02 | 4 | 8 |
| LYD997 | 0.79 | 1.11E−02 | 4 | 15 | LYD997 | 0.80 | 9.73E−03 | 4 | 15 |
| LYD997 | 0.85 | 3.85E−03 | 4 | 9 | LYD997 | 0.89 | 1.15E−03 | 4 | 14 |
| LYD997 | 0.97 | 9.85E−06 | 4 | 13 | LYD998 | 0.82 | 7.30E−03 | 3 | 24 |
| LYD997 | 0.88 | 1.72E−03 | 2 | 13 | LYD997 | 0.87 | 2.11E−03 | 2 | 13 |
| LYD998 | 0.76 | 2.73E−02 | 6 | 9 | LYD999 | 0.71 | 3.10E−02 | 4 | 14 |
| LYD999 | 0.73 | 2.48E−02 | 4 | 10 | LYD999 | 0.75 | 2.03E−02 | 2 | 13 |
| LYD999 | 0.80 | 8.98E−03 | 4 | 13 | MGP43 | 0.75 | 3.15E−02 | 1 | 25 |

Table 126: Provided are the correlations (R) between the genes expression levels in various tissues (Expression set Table 118) and the phenotypic performance (measured in Tables 120-125) according to the correlation (Con.) vectors (IDs) specified in Table 119.
"R" = Pearson correlation coefficient;
"P" = p value.

Example 12

Production of Cotton Transcriptome and High Throughput Correlation Analysis with Yield and ABST Related Parameters Using 60K Cotton Oligonucleotide Micro-Arrays In order to produce a high throughput correlation analysis between plant phenotype and gene expression level, the present inventors utilized a cotton oligonucleotide micro-array, produced by Agilent Technologies [chem. (dot) agilent (dot) com/Scripts/PDS (dot) asp?lPage=50879]. The array oligonucleotide represents about 60,000 cotton genes and transcripts. In order to define correlations between the levels of RNA expression with abiotic stress tolerance (ABST) and yield and components or vigor related parameters, various plant characteristics of 13 different cotton ecotypes were analyzed and further used for RNA expression analysis. The correlation between the RNA levels and the characterized parameters was analyzed using Pearson correlation test [davidmlane (dot) com/hyperstat/A34739 (dot) html].

Correlation of Cotton Varieties Across Ecotypes Grown Under Regular and Drought Growth Conditions

Experimental Procedures

13 Cotton ecotypes were grown in 5-11 repetitive plots, in field. Briefly, the growing protocol was as follows:

Regular growth conditions: cotton plants were grown in the field using commercial fertilization and irrigation protocols (normal growth conditions) which included 623 m$^3$ water per dunam (1000 square meters) per entire growth period, fertilization of 24 units of 12% nitrogen, 12 units of 6% phosphorous and 12 units of 6% potassium per entire growth period. Plot size was of 5 meter long, two rows, 8 plants per meter.

Drought growth conditions: cotton seeds were sown in soil and grown under normal condition until first squares were visible (40 days from sowing), drought treatment was irrigated with 75% water in comparison to the normal treatment [472 m$^3$ water per dunam (1000 square meters) per entire growth period].

It should be noted that one unit of phosphorous refers to one kg of P$_2$O$_5$ per dunam; and that one unit of potassium refers to one kg of K$_2$O per dunam;

Analyzed Cotton tissues—Eight tissues [mature leaf, lower and upper main stem, flower, main mature boll, fruit, fiber (Day) and fiber (Night)] from plants growing under normal conditions were sampled and RNA was extracted as described above. Eight tissues [mature leaf (Day), mature leaf (Night), lower main stem, upper main stem, main flower, main mature boll, fiber (Day) and fiber (night)] from plants growing under drought conditions were sampled and RNA was extracted as described above.

Each micro-array expression information tissue type has received a Set ID as summarized in Table 127-129 below.

TABLE 127

Cotton transcriptome expression sets under normal conditions (normal expression set 1)

| Expression Set | Set ID |
|---|---|
| Fruit at 10 DPA at reproductive stage under normal growth conditions | 1 |
| Lower main stem at reproductive stage under normal growth conditions | 2 |
| Main flower at reproductive stage under normal growth conditions | 3 |
| Main mature boll at reproductive stage under normal growth conditions | 4 |
| Mature leaf (day) at reproductive stage under normal conditions | 5 |
| Mature leaf (night) at reproductive stage under normal conditions | 6 |
| Fiber (day) at reproductive stage under normal conditions | 7 |
| Fiber (night) at reproductive stage under normal conditions | 8 |
| Upper main stem at reproductive stage under normal growth conditions | 9 |

Table 127: Provided are the cotton transcriptome expression sets. Lower main stem = the main stem adjacent to main mature boll; Upper main stem = the main stem adjacent to the main flower; Main flower = reproductive organ on the third position on the main stem (position 3); Fruit at 10 DPA = reproductive organ ten days after anthesis on the main stem (position 2); Main mature boll = reproductive organ on the first position on the main stem (position 1); Mature leaf = Full expanded leaf in the upper canopy; Fiber = fiber at elongation stage 10 DAP (DAP = days after pollination).

TABLE 128

Additional Cotton transcriptome expression sets under normal conditions (normal expression set 2)

| Expression Set | Set ID |
|---|---|
| Mature leaf at reproductive stage during day under normal growth conditions | 1 |
| Fiber at reproductive stage during day under normal growth conditions | 2 |
| Fiber at reproductive stage during night under normal growth conditions | 3 |

Table 128: Provided are the cotton transcriptome expression sets. Mature leaf = Full expanded leaf in the upper canopy; Fiber = fiber at elongation stage 10 DAP (DAP = days after pollination), was sampled either at day or night hours.

TABLE 129

Cotton transcriptome expression sets under drought conditions

| Expression Set | Set ID |
|---|---|
| Lower main stem at reproductive stage under drought growth conditions | 1 |
| Main flower at reproductive stage under drought growth conditions | 2 |
| Main mature boll at reproductive stage under drought growth conditions | 3 |
| Mature leaf during night at reproductive stage under drought growth conditions | 4 |
| Fiber at reproductive stage during day under drought growth conditions | 5 |
| Fiber at reproductive stage during night under drought growth conditions | 6 |
| Upper main stem at reproductive stage under drought growth conditions | 7 |
| Mature leaf during day at reproductive stage under drought growth conditions | 8 |

Table 129: Provided are the cotton transcriptome expression sets. Lower main stem = the main stem adjacent to main mature boll; Main flower = reproductive organ on the third position on the main stem (position 3); Main mature boll = reproductive organ on the first position on the main stem (position 1); Mature leaf = Full expanded leaf in the upper canopy; Fiber = fiber at elongation stage 10 DAP (DAP = days after pollination) was sampled either at day or night hours. Upper main stem = the main stem adjacent to the main flower;

Cotton yield components and vigor related parameters assessment—13 Cotton ecotypes in 5-11 repetitive plots, each plot containing approximately 80 plants were grown in field. Plants were regularly fertilized and watered during plant growth until harvesting (as recommended for commercial growth). Plants were continuously phenotyped during the growth period and at harvest (Table 130-131). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]). Next, analyzed data was saved to text files and processed using the JMP statistical analysis software (SAS institute).

The following parameters were measured and collected:

Total Bolls yield (RP) [gr.]—Total boll weight (including fiber) per plot.

Total bolls yield per plant (RP) [gr.]—Total boll weight (including fiber) per plot divided by the number of plants.

Fiber yield (RP) [gr.]—Total fiber weight per plot.

Fiber yield per plant (RP) [gr.]—Total fiber weight in plot divided by the number of plants.

Fiber yield per boll (RP) [gr.]—Total fiber weight in plot divided by the number of bolls.

Estimated Avr Fiber yield (MB) po 1 (H) [gr.]—Weight of the fiber on the main branch in position 1 at harvest.

Estimated Avr Fiber yield (MB) po 3 (H) [gr.]—Weight of the fiber on the main branch in position 3 at harvest.

Estimated Avr Bolls FW (MB) po 1 (H) [gr.]—Weight of the fiber on the main branch in position 1 at harvest.

Estimated Avr Bolls FW (MB) po 3 (H) [gr.]—Weight of the fiber on the main branch in position 3 at harvest.

Fiber Length (RP)—Measure Fiber Length in inch from the rest of the plot.

Fiber Length Position 1 (SP)—Fiber length at position 1 from the selected plants. Measure Fiber Length in inch.

Fiber Length Position 3 (SP)—Fiber length at position 3 from the selected plants. Measure Fiber Length in inch.

Fiber Strength (RP)—Fiber Strength from the rest of the plot. Measured in grams per denier.

Fiber Strength Position 3 (SP)—Fiber strength at position 3 from the selected plants. Measured in grams per denier.

Micronaire (RP)—fiber fineness and maturity from the rest of the plot. The scale that was used was 3.7-4.2—for Premium; 4.3-4.9—Base Range; above 5—Discount Range.

Micronaire Position 1 (SP)—fiber fineness and maturity from position 1 from the selected plants. The scale that was used was 3.7-4.2—for Premium; 4.3-4.9—Base Range; above 5—Discount Range.

Micronaire Position 3 (SP)—fiber fineness and maturity from position 3 from the selected plants. The scale that was used was 3.7-4.2—for Premium; 4.3-4.9—Base Range; above 5—Discount Range.

Short Fiber Content (RP (%)—short fiber content from the rest of the plot

Uniformity (RP) (%)—fiber uniformity from the rest of the plot

Carbon isotope discrimination—(%)—isotopic ratio of 13C to 12C in plant tissue was compared to the isotopic ratio of 13C to 12C in the atmosphere.

Leaf temp (V) (° celsius)—leaf temperature was measured at vegetative stage using Fluke IR thermometer 568 device. Measurements were done on 4 plants per plot.

Leaf temp (IODPA) (° celsius)—Leaf temperature was measured 10 days post anthesis using Fluke IR thermometer 568 device. Measurements were done on 4 plants per plot.

Stomatal conductance (IODPA)—(mmol $m^{-2}$ $s^{-1}$)—plants were evaluated for their stomata conductance using SC-1 Leaf Porometer (Decagon devices) 10 days post anthesis. Stomata conductance readings were done on fully developed leaf, for 2 leaves and 2 plants per plot.

Stomatal conductance (17DPA)—(mmol $m^{-2}$ $s^{-1}$)—plants were evaluated for their stomata conductance using SC-1 Leaf Porometer (Decagon devices) 17 days post anthesis. Stomata conductance readings were done on fully developed leaf, for 2 leaves and 2 plants per plot.

% Canopy coverage (IODPA) (F)—percent Canopy coverage 10 days post anthesis and at flowering stage. The % Canopy coverage is calculated using Formula 32 above.

Leaf area (10 DPA) (cm2)—Total green leaves area 10 days post anthesis (DPA).

PAR_LAI (10 DPA)—Photosynthetically active radiation 10 days post anthesis.

SPAD (17DPA) [SPAD unit]—Plants were characterized for SPAD rate 17 days post anthesis.

Chlorophyll content was determined using a Minolta SPAD 502 chlorophyll meter. Four measurements per leaf were taken per plot.

SPAD (pre F)—Plants were characterized for SPAD rate during pre-flowering stage. Chlorophyll content was determined using a Minolta SPAD 502 chlorophyll meter. Four measurements per leaf were taken per plot.

SPAD rate—the relative growth rate (RGR) of SPAD (Formula 4) as described above.

Leaf mass fraction (10 DPA) [$cm^2$/gr.]—leaf mass fraction 10 days post anthesis. The leaf mass fraction is calculated using Formula 33 above.

Lower Stem width (H) [mm]—This parameter was measured at harvest. Lower internodes from 8 plants per plot were separated from the plant and the diameter was measured using a caliber. The average internode width per plant was calculated by dividing the total stem width by the number of plants.

Upper Stem width (H) [mm]—This parameter was measured at harvest. Upper internodes from 8 plants per plot were separated from the plant and the diameter was measured using a caliber. The average internode width per plant was calculated by dividing the total stem width by the number of plants.

Plant height (H) [cm]—plants were measured for their height at harvest using a measuring tape. Height of main stem was measured from ground to apical mersitem base. Average of eight plants per plot was calculated.

Plant height growth [cm/day]—the relative growth rate (RGR) of Plant Height (Formula 3 above) as described above.

Shoot DW (V) [gr.]—Shoot dry weight at vegetative stage after drying at 70° C. in oven for 48 hours. Total weight of 3 plants in a plot.

Shoot DW (IODPA) [gr.]—Shoot dry weight at 10 days post anthesis, after drying at 70° C. in oven for 48 hours. Total weight of 3 plants in a plot.

Bolls num per plant (RP) [num]—Average bolls number per plant from the rest of the plot.

Reproductive period duration [num]—number of days from flowering to harvest for each plot.

Closed Bolls num per plant (RP) [num]—Average closed bolls number per plant from the rest of the plot.

Closed Bolls num per plant (SP) [num]—Average closed bolls number per plant from selected plants.

Open Bolls num per plant (SP) [num]—Average open bolls number per plant from selected plants. average of eight plants per plot.

Num of lateral branches with open bolls (H) [num]—count of number of lateral branches with open bolls at harvest, average of eight plants per plot.

Num of nodes with open bolls (MS) (H) [num]—count of number of nodes with open bolls on main stem at harvest, average of eight plants per plot.

Seeds yield per plant (RP) [gr.]—Total weight of seeds in plot divided in plants number.

Estimated Avr Seeds yield (MB) po 1 (H) [gr.]—Total weight of seeds in position one per plot divided by plants number.

Estimated Avr Seeds yield (MB) po 3 (H) [gr.]—Total weight of seeds in position three per plot divided by plants number.

Estimated Avr Seeds num (MB) po 1 (H) [num]—Total number of seeds in position one per plot divided by plants number.

Estimated Avr Seeds num (MB) po 3 (H) [num]—Total number of seeds in position three per plot divided by plants number.

1000 seeds weight (RP) [gr.]—was calculated based on Formula 14.

Experimental Results 13 different cotton varieties were grown and characterized for different parameters as specified in Tables 130-132. The average for each of the measured parameters was calculated using the JMP software (Tables 133-138) and a subsequent correlation analysis between the various transcriptome sets (Table 127-129) and the average parameters, was conducted (Tables 139-15). Results were then integrated to the database.

TABLE 130

Cotton correlated parameters under normal growth conditions (vectors) (parameters set 1)

| Correlated parameter with | Correlation ID |
|---|---|
| Total Bolls yield (SP) [gr.] | 1 |
| estimated Avr Bolls FW (MB) po 1 (H) [gr.] | 2 |
| estimated Avr Bolls FW (MB) po 3 (H) [gr.] | 3 |
| estimated Avr Fiber yield (MB) po 1 (H) [gr.] | 4 |
| estimated Avr Fiber yield (MB) po 3 (H) [gr.] | 5 |
| Seeds yield per plant (RP) [gr.] | 6 |
| estimated Avr Seeds yield (MB) po 1 (H) [gr.] | 7 |
| estimated Avr Seeds yield (MB) po 3 (H) [gr.] | 8 |
| 1000 seeds weight (RP) [gr.] | 9 |
| estimated Avr Seeds num (MB) po 1 (H) [num] | 10 |
| estimated Avr Seeds num (MB) po 3 (H) [num] | 11 |
| Fiber yield per boll (RP) [gr.] | 12 |
| Fiber yield per plant (RP) [gr.] | 13 |
| Closed Bolls num per plant (RP) [num] | 14 |
| Closed Bolls num per plant (SP) [num] | 15 |
| Open Bolls num per plant (SP) [num] | 16 |
| Bolls num per plant (RP) [num] | 17 |
| bolls num in position 1 [num] | 18 |
| bolls num in position 3 [num] | 19 |
| Fiber Length (RP) [in] | 20 |
| Fiber Length Position 3 (SP) [in] | 21 |
| Fiber Strength (RP) [in] | 22 |
| Fiber Strength Position 3 (SP) [gr./denier] | 23 |
| Micronaire (RP) [scoring 3.7-5] | 24 |
| Micronaire Position 3 (SP) [scoring 3.7-5] | 25 |
| Num of nodes with open bolls (MS) (H) [num] | 26 |
| Num of lateral branches with open bolls (H) [num] | 27 |
| Reproductive period duration [num] | 28 |
| Plant height (H) [cm] | 29 |
| Plant height growth [cm/day] | 30 |
| Upper Stem width (H) [mm] | 31 |
| Lower Stem width (H) [mm] | 32 |
| Shoot DW (V) [gr.] | 33 |
| Shoot DW (10 DPA) [gr.] | 34 |
| Shoot FW (V) [gr.] | 35 |

TABLE 130-continued

Cotton correlated parameters under normal growth conditions (vectors) (parameters set 1)

| Correlated parameter with | Correlation ID |
|---|---|
| Shoot FW(10 DPA) [gr.] | 36 |
| SPAD rate [SPAD unit/day] | 37 |
| SPAD (pre F) [SPAD unit] | 38 |
| SPAD (17 DPA) [SPAD unit] | 39 |
| PAR_LAI (10 DPA) [μmol m$^{-2}$ S$^{-2}$] | 40 |
| Leaf area (10 DPA) [cm$^2$] | 41 |
| % Canopy coverage (10 DPA) [%] | 42 |
| Leaf mass fraction (10 DPA) [cm$^2$/gr.] | 43 |

Table 130. Provided are the Cotton correlated parameters (vectors).
"RP"—Rest of plot;
"SP" = selected plants;
"gr." = grams;
"H" = Harvest;
"in"—inch;
"SP"—Selected plants;
"SPAD" = chlorophyll levels;
"FW" = Plant Fresh weight;
"DPA"—Days post anthesis;
"mm"—millimeter;
"cm"—centimeter;
"num"—number;
"Avr" = average;
"DPA" = days post anthesis;
"v" = vegetative stage;
"H" = harvest stage;

TABLE 131

Cotton correlated parameters under normal growth conditions (vectors) (parameters set 2)

| Correlated parameter with | Correlation ID |
|---|---|
| Total Bolls yield (RP) [gr.] | 1 |
| Total Bolls yield per plant (RP) [gr.] | 2 |
| Fiber yield (RP) [gr.] | 3 |
| Fiber yield per plant (RP) [gr.] | 4 |
| Fiber yield per boll (RP) [gr.] | 5 |
| Estimated Avr Fiber yield (MB) po 1 (H) [gr.] | 6 |
| Estimated Avr Fiber yield (MB) po 3 (H) [gr.] | 7 |
| Estimated Avr Bolls FW (MB) po 1 (H) [gr.] | 8 |
| Estimated Avr Bolls FW (MB) po 3 (H) [gr.] | 9 |
| Fiber Length (RP) [in] | 10 |
| Fiber Length Position 1 (SP) [in] | 11 |
| Fiber Length Position 3 (SP) [in] | 12 |
| Fiber Strength (RP) [in] | 13 |
| Fiber Strength Position 3 (SP) [gr/denier] | 14 |
| Micronaire (RP) [scoring 3.7-5] | 15 |
| Micronaire Position 1 (SP) [scoring 3.7-5] | 16 |
| Micronaire Position 3 (SP) [scoring 3.7-5] | 17 |
| Short Fiber Content (RP) [%] | 18 |
| Uniformity (RP) [%] | 19 |
| Carbon isotope discrimination (‰) | 20 |
| Leaf temp (V) [° C.] | 21 |
| Leaf temp (10 DPA) [° C.] | 22 |
| Stomatal conductance (10 DPA) [mmol m$^{-2}$ s$^{-1}$] | 23 |
| Stomatal conductance (17 DPA) [mmol m$^{-2}$ s$^{-1}$] | 24 |
| % Canopy coverage (10 DPA) [%] | 25 |
| Leaf area (10 DPA) [cm$^2$] | 26 |
| PAR_LAI (10 DPA) [μmol m$^{-2}$ S$^{-2}$] | 27 |
| SPAD (17 DPA) [SPAD unit] | 28 |
| SPAD (pre F) [SPAD unit] | 29 |
| SPAD rate [SPAD unit/day] | 30 |
| Leaf mass fraction (10 DPA) [cm$^2$/gr.] | 31 |
| Lower Stem width (H) [mm] | 32 |
| Upper Stem width (H) [mm] | 33 |
| Shoot DW (V) [gr.] | 34 |
| Shoot DW (10 DPA) [gr.] | 35 |
| Bolls num per plant (RP) [number] | 36 |
| Reproductive period duration [number] | 37 |

TABLE 131-continued

Cotton correlated parameters under normal growth conditions (vectors) (parameters set 2)

| Correlated parameter with | Correlation ID |
|---|---|
| Closed Bolls num per plant (RP) [number] | 38 |
| Closed Bolls num per plant (SP) [number] | 39 |
| Open Bolls num per plant (SP) [number] | 40 |
| Num of lateral branches with open bolls (H) [number] | 41 |
| Num of nodes with open bolls (MS) (H) [number] | 42 |
| Seeds yield per plant (RP) [gr.] | 43 |
| Estimated Avr Seeds yield (MB) po 1 (H) [number] | 44 |
| Estimated Avr Seeds yield (MB) po 3 (H) [gr.] | 45 |
| Estimated Avr Seeds num (MB) po 1 (H) [number] | 46 |
| Estimated Avr Seeds num (MB) po 3 (H) [number] | 47 |
| 1000 seeds weight (RP) [gr.] | 48 |
| Plant height (H) [cm] | 49 |
| Plant height growth [cm/day] | 50 |

Table 131. Provided are the Cotton correlated parameters (vectors).
"RP"—Rest of plot; "SP" = selected plants;
"gr." = grams;
"H" = Harvest;
"in"—inch;
"SP"—Selected plants;
"SPAD" = chlorophyll levels;
"FW" = Plant Fresh weight;
"DPA"—Days post anthesis;
"mm"—millimeter;
"cm"—centimeter;
"num"—number;
"Avr" = average;
"DPA" = days post anthesis;
"v" = vegetative stage;
"H" = harvest stage;

TABLE 132

Cotton correlated parameters under drought growth conditions (vectors)

| Correlated parameter with | Correlation ID |
|---|---|
| Total Bolls yield (RP) [gr.] | 1 |
| Total Bolls yield per plant (RP) [gr.] | 2 |
| Fiber yield (RP) [gr.] | 3 |
| Fiber yield per plant (RP) [gr.] | 4 |
| Fiber yield per boll (RP) [gr.] | 5 |
| Estimated Avr Fiber yield (MB) po 1 (H) [gr.] | 6 |
| Estimated Avr Fiber yield (MB) po 3 (H) [gr.] | 7 |
| Estimated Avr Bolls FW (MB) po 1 (H) [gr.] | 8 |
| Estimated Avr Bolls FW (MB) po 3 (H) [gr.] | 9 |
| Fiber Length (RP) [in] | 10 |
| Fiber Length Position 1 (SP) [in] | 11 |
| Fiber Length Position 3 (SP) [in] | 12 |
| Fiber Strength (RP) [in] | 13 |
| Fiber Strength Position 3 (SP) [gr./denier] | 14 |
| Micronaire (RP) [scoring 3.7-5] | 15 |
| Micronaire Position 1 (SP) [scoring 3.7-5] | 16 |
| Micronaire Position 3 (SP) [scoring 3.7-5] | 17 |
| Short Fiber Content (RP) [%] | 18 |
| Uniformity (RP) [%] | 19 |
| Carbon isotope discrimination (‰) | 20 |
| Leaf temp (V) [° C.] | 21 |
| Leaf temp (10 DPA) [° C.] | 22 |
| Stomatal conductance (10 DPA) [mmol m$^{-2}$ s$^{-1}$] | 23 |
| Stomatal conductance (17 DPA) [mmol m$^{-2}$ s$^{-1}$] | 24 |
| % Canopy coverage (10 DPA) [%] | 25 |
| Leaf area (10 DPA) [cm2] | 26 |
| PAR_LAI (10 DPA) [μmol m$^{-2}$ S$^{-2}$] | 27 |
| SPAD (17 DPA) [SPAD unit] | 28 |
| SPAD (pre F) [SPAD unit] | 29 |
| SPAD rate [SPAD unit/day] | 30 |
| Leaf mass fraction (10 DPA) [cm²/gr.] | 31 |
| Lower Stem width (H) [mm] | 32 |
| Upper Stem width (H) [mm] | 33 |
| Plant height (H) [cm] | 34 |
| Plant height growth [cm/day] | 35 |
| Shoot DW (V) [gr.] | 36 |
| Shoot DW (10 DPA) [gr.] | 37 |
| Bolls num per plant (RP) [num] | 38 |
| Reproductive period duration [num] | 39 |
| Closed Bolls num per plant (RP) [num] | 40 |
| Closed Bolls num per plant (SP) [num] | 41 |
| Open Bolls num per plant (SP) [num] | 42 |
| Num of lateral branches with open bolls (H) [num] | 43 |
| Num of nodes with open bolls (MS) (H) [num] | 44 |
| Estimated Avr Seeds yield (MB) po_1 (H) [num] | 45 |
| Estimated Avr Seeds yield (MB) po 3 (H) [gr.] | 46 |
| Estimated Avr Seeds num (MB) po 1 (H) [num] | 47 |
| Estimated Avr Seeds num (MB) po 3 (H) [num] | 48 |
| 1000 seeds weight (RP) [gr.] | 49 |
| Seeds yield per plant (RP) [gr.] | 50 |

Table 132. Provided are the Cotton correlated parameters (vectors).
"RP"—Rest of plot;
"SP" = selected plants;
"gr." = grams;
"H" = Harvest;
"in"—inch;
"SP"—Selected plants;
"SPAD" = chlorophyll levels;
"FW" = Plant Fresh weight;
"DPA"—Days post anthesis;
"mm"—millimeter;
"cm"—centimeter;
"num"—number;
"Avr" = average;
"DPA" = days post anthesis;
"v" = vegetative stage;
"H" = harvest stage;

TABLE 133

Measured parameters in Cotton accessions (1-7) under normal conditions (parameters set 1)

| Line/Corr. ID | Line-1 | Line-2 | Line-3 | Line-4 | Line-5 | Line-6 | Line-7 |
|---|---|---|---|---|---|---|---|
| 1 | 505.40 | 564.20 | 544.20 | 585.50 | 536.50 | 317.20 | 488.30 |
| 2 | 6.62 | 4.88 | 7.08 | 5.34 | 4.08 | 3.58 | 5.66 |
| 3 | 6.42 | 2.93 | 5.95 | 4.16 | 2.72 | 2.73 | 5.13 |
| 4 | 2.53 | 1.88 | 2.69 | 2.02 | 1.50 | 0.38 | 2.04 |
| 5 | 2.46 | 1.13 | 2.34 | 1.69 | 1.06 | 0.50 | 1.87 |
| 6 | 32.50 | 34.90 | 32.50 | 35.10 | 36.30 | 26.70 | 33.10 |
| 7 | 3.33 | 2.70 | 3.83 | 2.99 | 2.43 | 3.02 | 3.03 |
| 8 | 3.29 | 1.58 | 3.06 | 2.19 | 1.64 | 2.29 | 2.76 |
| 9 | 105.20 | 113.60 | 98.50 | 84.70 | 111.70 | 82.50 | 91.60 |
| 10 | 31.60 | 24.20 | 36.00 | 31.30 | 20.90 | 32.60 | 30.80 |
| 11 | 31.20 | 15.50 | 33.30 | 26.10 | 14.90 | 31.30 | 32.60 |
| 12 | 2.30 | 1.37 | 2.22 | 1.81 | 1.12 | 0.40 | 1.80 |
| 13 | 25.20 | 26.00 | 25.40 | 27.90 | 25.40 | 4.70 | 24.00 |
| 14 | 4.23 | NA | NA | NA | NA | NA | 4.56 |
| 15 | 5.55 | 2.08 | 3.39 | 2.09 | 3.07 | 2.41 | 5.89 |
| 16 | 12.00 | 22.60 | 11.80 | 18.80 | 27.70 | 16.40 | 15.00 |
| 17 | 11.00 | 19.10 | 11.80 | 15.50 | 22.60 | 11.80 | 13.40 |
| 18 | 5.00 | 5.00 | 5.00 | 5.00 | 5.00 | 5.00 | 5.00 |
| 19 | 5.00 | 5.00 | 5.00 | 5.00 | 5.00 | 5.00 | 5.00 |
| 20 | 1.16 | 1.28 | 1.15 | 1.12 | 1.41 | 1.07 | 0.90 |
| 21 | 1.15 | 1.29 | 1.14 | 1.10 | 1.44 | 0.96 | 0.84 |
| 22 | 28.80 | 34.50 | 25.90 | 29.20 | 39.70 | 22.60 | 22.60 |
| 23 | 29.60 | 36.50 | 26.20 | 29.60 | 39.50 | 20.10 | 21.60 |
| 24 | 4.31 | 3.63 | 3.95 | 4.37 | 4.10 | 6.05 | 5.01 |
| 25 | 4.57 | 3.88 | 3.99 | 4.71 | 4.75 | 5.69 | 5.25 |
| 26 | 8.15 | 10.90 | 9.00 | 11.04 | 10.14 | 7.85 | 8.48 |
| 27 | 1.02 | 1.46 | 0.81 | 0.96 | 1.21 | 1.69 | 1.29 |

TABLE 133-continued

Measured parameters in Cotton accessions (1-7) under normal conditions (parameters set 1)

| Line/Corr. ID | Line-1 | Line-2 | Line-3 | Line-4 | Line-5 | Line-6 | Line-7 |
|---|---|---|---|---|---|---|---|
| 28 | 121.30 | 108.10 | 108.00 | 103.80 | 102.90 | 108.00 | 126.00 |
| 29 | 112.80 | 110.80 | 100.60 | 115.40 | 103.30 | 98.50 | 121.90 |
| 30 | 1.86 | 2.00 | 1.73 | 1.72 | 1.66 | 1.72 | 2.09 |
| 31 | 3.02 | 3.64 | 3.32 | 3.13 | 3.23 | 2.73 | 2.80 |
| 32 | 12.80 | 13.70 | 11.80 | 12.40 | 13.00 | 10.90 | 13.00 |
| 33 | 39.20 | 64.70 | 44.80 | 38.10 | 46.20 | 36.70 | 48.20 |
| 34 | 169.20 | 183.60 | 171.10 | 172.70 | 190.00 | 149.00 | 193.10 |
| 35 | 168.90 | 256.00 | 194.80 | 155.70 | 154.60 | 172.10 | 193.30 |
| 36 | 842.50 | 792.60 | 804.20 | 767.00 | 745.20 | 725.90 | 922.60 |
| 37 | 0.0402 | −0.0587 | −0.2552 | −0.2192 | 0.1028 | −0.2906 | −0.1422 |
| 38 | 32.10 | 35.30 | 36.00 | 35.80 | 35.00 | 32.90 | 35.90 |
| 39 | 34.30 | 33.50 | 31.40 | 29.70 | 37.10 | 27.40 | 33.40 |
| 40 | 5.67 | 6.87 | 6.45 | 5.86 | 5.61 | 6.59 | 4.09 |
| 41 | 7007.7 | 6622.3 | 5544.7 | 8196.0 | 8573.3 | 8155.3 | 5291.3 |
| 42 | 84.00 | 94.90 | 92.90 | 89.20 | 84.90 | 87.20 | 79.90 |
| 43 | 41.10 | 36.50 | 34.00 | 48.00 | 44.60 | 54.70 | 28.10 |

Table 133: Provided are the values of each of the parameters (as described above) measured in Cotton accessions (ecotype) under normal conditions. Growth conditions are specified in the experimental procedure section.

TABLE 134

Additional measured parameters in Cotton accessions (8-13) under normal conditions (parameters set 1)

| Line/Corr. ID | Line-8 | Line-9 | Line-10 | Line-11 | Line-12 | Line-13 |
|---|---|---|---|---|---|---|
| 1 | 620.50 | 715.10 | 421.30 | 531.80 | 405.30 | 715.70 |
| 2 | 3.13 | 6.37 | 6.14 | NA | 4.95 | 6.95 |
| 3 | 3.31 | 4.71 | 5.44 | 4.14 | 4.60 | 6.25 |
| 4 | 1.14 | 2.47 | 2.29 | NA | 1.77 | 2.92 |
| 5 | 1.19 | 1.91 | 2.02 | 1.12 | 1.65 | 2.65 |
| 6 | 39.50 | 39.70 | 30.20 | 47.60 | 37.80 | 35.90 |
| 7 | 1.87 | 3.21 | 3.00 | NA | 2.82 | 3.87 |
| 8 | 2.06 | 2.25 | 2.65 | 2.73 | 2.55 | 3.56 |
| 9 | 116.70 | 99.60 | 99.50 | 97.70 | 102.70 | 109.90 |
| 10 | 15.50 | 31.50 | 29.30 | NA | 25.60 | 34.60 |
| 11 | 18.20 | 25.10 | 29.00 | 29.10 | 25.90 | 32.70 |
| 12 | 1.24 | 2.23 | 1.99 | 1.18 | 1.74 | 2.39 |
| 13 | 26.60 | 30.80 | 23.10 | 20.50 | 26.00 | 29.10 |
| 14 | NA | NA | 3.16 | 1.11 | NA | NA |
| 15 | 2.34 | 3.75 | 3.31 | 1.84 | 2.74 | 3.09 |
| 16 | 30.30 | 17.90 | 12.40 | 19.60 | 14.70 | 15.70 |
| 17 | 21.90 | 13.90 | 11.60 | 17.30 | 15.00 | 12.10 |
| 18 | 5.00 | 5.00 | 5.00 | NA | 5.00 | 5.00 |
| 19 | 5.00 | 5.00 | 5.00 | 5.00 | 5.00 | 5.00 |
| 20 | 1.38 | 1.18 | 1.12 | 1.12 | 1.18 | 1.18 |
| 21 | 1.41 | 1.14 | 1.07 | 1.11 | 1.20 | 1.20 |
| 22 | 42.60 | 28.90 | 25.90 | 29.00 | 30.80 | 29.80 |
| 23 | 42.70 | 28.40 | 23.70 | 30.30 | 32.00 | 30.50 |
| 24 | 3.88 | 3.98 | 4.10 | 4.55 | 4.76 | 4.92 |
| 25 | 4.48 | 4.19 | 4.51 | 4.21 | 4.25 | 4.74 |
| 26 | 11.29 | 10.83 | 8.73 | 12.33 | 9.19 | 10.65 |
| 27 | 1.13 | 0.80 | 0.58 | 0.13 | 0.15 | 0.71 |
| 28 | 102.70 | 104.40 | 126.00 | 145.20 | 109.50 | 106.20 |
| 29 | 102.20 | 127.30 | 105.80 | 151.30 | 117.60 | 119.20 |
| 30 | 1.63 | 2.07 | 1.86 | 1.57 | 1.87 | 1.94 |
| 31 | 2.99 | 3.45 | 2.88 | 3.40 | 3.28 | 3.29 |
| 32 | 13.10 | 14.30 | 11.80 | 14.50 | 12.60 | 14.00 |
| 33 | 50.80 | 51.70 | 39.70 | 35.30 | 42.10 | 42.10 |
| 34 | 196.40 | 199.80 | 179.40 | 134.30 | 198.50 | 165.50 |
| 35 | 230.40 | 176.70 | 176.50 | 163.70 | 164.70 | 170.90 |
| 36 | 802.20 | 861.60 | 931.00 | 591.60 | 911.40 | 791.80 |
| 37 | −0.083 | −0.1316 | −0.2426 | −0.5146 | −0.2441 | −0.2368 |
| 38 | 33.60 | 35.30 | 38.10 | 32.80 | 34.40 | 35.30 |
| 39 | 33.80 | 31.90 | 32.90 | 22.10 | 28.10 | 31.10 |
| 40 | 5.63 | 5.62 | 5.33 | 7.41 | 7.54 | 5.51 |
| 41 | 8854.50 | 5650.70 | 6003.30 | 6691.80 | 9005.00 | 7268.00 |
| 42 | 85.20 | 83.60 | 84.50 | 95.90 | 95.90 | 83.90 |
| 43 | 45.40 | 28.10 | 33.50 | 47.90 | 45.90 | 44.00 |

Table 134: Provided are the values of each of the parameters (as described above) measured in Cotton accessions (ecotype) under normal conditions. Growth conditions are specified in the experimental procedure section.

TABLE 135

Measured parameters in Cotton accessions (1-7) under normal conditions (parameters set 2)

| Line/Corr. ID | Line-1 | Line-2 | Line-3 | Line-4 | Line-5 | Line-6 | Line-7 |
|---|---|---|---|---|---|---|---|
| 1 | 2379.00 | 2148.90 | 2050.20 | 2156.30 | 1934.20 | 1221.20 | 1773.30 |
| 2 | 62.60 | 65.40 | 63.20 | 68.00 | 64.80 | 32.50 | 60.80 |
| 3 | 956.30 | 854.00 | 822.70 | 882.30 | 756.70 | 165.00 | 700.30 |
| 4 | 25.20 | 26.00 | 25.40 | 27.90 | 25.40 | 4.70 | 24.00 |
| 5 | 2.30 | 1.37 | 2.22 | 1.81 | 1.12 | 0.40 | 1.80 |
| 6 | 2.53 | 1.88 | 2.69 | 2.02 | 1.50 | 0.38 | 2.04 |
| 7 | 2.46 | 1.13 | 2.34 | 1.69 | 1.06 | 0.50 | 1.87 |
| 8 | 6.62 | 4.88 | 7.08 | 5.34 | 4.08 | 3.58 | 5.66 |
| 9 | 6.42 | 2.93 | 5.95 | 4.16 | 2.72 | 2.73 | 5.13 |
| 10 | 1.16 | 1.28 | 1.15 | 1.12 | 1.41 | 1.07 | 0.90 |
| 11 | 1.18 | 1.28 | 1.16 | 1.18 | 1.41 | 0.98 | 0.96 |
| 12 | 1.15 | 1.29 | 1.14 | 1.10 | 1.44 | 0.96 | 0.84 |
| 13 | 28.80 | 34.50 | 25.90 | 29.20 | 39.70 | 22.60 | 22.60 |
| 14 | 29.60 | 36.50 | 26.20 | 29.60 | 39.50 | 20.10 | 21.60 |
| 15 | 4.31 | 3.63 | 3.95 | 4.37 | 4.10 | 6.05 | 5.01 |
| 16 | 4.67 | 3.67 | 4.59 | 5.20 | 4.06 | 6.30 | 5.62 |
| 17 | 4.57 | 3.88 | 3.99 | 4.71 | 4.75 | 5.69 | 5.25 |
| 18 | 8.08 | 6.22 | 10.17 | 10.80 | 4.84 | 11.80 | 12.60 |
| 19 | 82.40 | 83.60 | 80.90 | 81.00 | 84.20 | 78.50 | 77.30 |
| 20 | −28.295 | −28.43 | −28.221 | −28.169 | −28.813 | −28.766 | −28.373 |
| 21 | 30.50 | 30.30 | 30.50 | 30.70 | 30.20 | 30.70 | 31.00 |
| 22 | 37.10 | 37.00 | 35.70 | 35.60 | 35.60 | 36.10 | 36.10 |
| 23 | NA | NA | NA | NA | NA | NA | NA |
| 24 | NA | NA | NA | NA | NA | NA | NA |
| 25 | 84.00 | 94.90 | 92.90 | 89.20 | 84.90 | 87.20 | 79.90 |
| 26 | 7007.70 | 6622.30 | 5544.70 | 8196.00 | 8573.30 | 8155.30 | 5291.30 |
| 27 | 5.67 | 6.87 | 6.45 | 5.86 | 5.61 | 6.59 | 4.09 |
| 28 | 34.30 | 33.50 | 31.40 | 29.70 | 37.10 | 27.40 | 33.40 |
| 29 | 32.10 | 35.30 | 36.00 | 35.80 | 35.00 | 32.90 | 35.90 |
| 30 | 0.0402 | −0.0587 | −0.2552 | −0.2192 | 0.1028 | −0.2906 | −0.1422 |
| 31 | 41.10 | 36.50 | 34.00 | 48.00 | 44.60 | 54.70 | 28.10 |
| 32 | 12.80 | 13.70 | 11.80 | 12.40 | 13.00 | 10.90 | 13.00 |
| 33 | 3.02 | 3.64 | 3.32 | 3.13 | 3.23 | 2.73 | 2.80 |
| 34 | 39.20 | 64.70 | 44.80 | 38.10 | 46.20 | 36.70 | 48.20 |
| 35 | 169.20 | 183.60 | 171.10 | 172.70 | 190.00 | 149.00 | 193.10 |
| 36 | 11.00 | 19.10 | 11.80 | 15.50 | 22.60 | 11.80 | 13.40 |
| 37 | 121.30 | 108.10 | 108.00 | 103.80 | 102.90 | 108.00 | 126.00 |
| 38 | 4.23 | NA | NA | NA | NA | NA | 4.56 |
| 39 | 5.55 | 2.08 | 3.39 | 2.09 | 3.07 | 2.41 | 5.89 |
| 40 | 12.00 | 22.60 | 11.80 | 18.80 | 27.70 | 16.40 | 15.00 |
| 41 | 1.02 | 1.46 | 0.81 | 0.96 | 1.21 | 1.69 | 1.29 |
| 42 | 8.15 | 10.90 | 9.00 | 11.04 | 10.14 | 7.85 | 8.48 |
| 43 | 32.50 | 34.90 | 32.50 | 35.10 | 36.30 | 26.70 | 33.10 |
| 44 | 3.33 | 2.70 | 3.83 | 2.99 | 2.43 | 3.02 | 3.03 |
| 45 | 3.29 | 1.58 | 3.06 | 2.19 | 1.64 | 2.29 | 2.76 |
| 46 | 31.6 | 24.2 | 36 | 31.3 | 20.9 | 32.6 | 30.8 |
| 47 | 31.2 | 15.5 | 33.3 | 26.1 | 14.9 | 31.3 | 32.6 |
| 48 | 105.2 | 113.6 | 98.5 | 84.7 | 111.7 | 82.5 | 91.6 |
| 49 | 112.8 | 110.8 | 100.6 | 115.4 | 103.3 | 98.5 | 121.9 |
| 50 | 1.86 | 2 | 1.73 | 1.72 | 1.66 | 1.72 | 2.09 |

Table 135: Provided are the values of each of the parameters (as described above) measured in cotton accessions (Line). Growth conditions are specified in the experimental procedure section.

TABLE 136

Measured parameters in Cotton accessions (8-13) under normal conditions (parameters set 2)

| Line/Corr. ID | Line-8 | Line-9 | Line-10 | Line-11 | Line-12 | Line-13 |
|---|---|---|---|---|---|---|
| 1 | 1920.00 | 2326.80 | 1794.80 | 2030.70 | 2211.00 | 2239.00 |
| 2 | 68.80 | 80.20 | 59.10 | 70.40 | 68.80 | 75.50 |
| 3 | 772.00 | 918.40 | 700.30 | 592.00 | 834.70 | 864.30 |
| 4 | 26.60 | 30.80 | 23.10 | 20.50 | 26.00 | 29.10 |
| 5 | 1.24 | 2.23 | 1.99 | 1.18 | 1.74 | 2.39 |
| 6 | 1.14 | 2.47 | 2.29 | NA | 1.77 | 2.92 |
| 7 | 1.19 | 1.91 | 2.02 | 1.12 | 1.65 | 2.65 |
| 8 | 3.13 | 6.37 | 6.14 | NA | 4.95 | 6.95 |
| 9 | 3.31 | 4.71 | 5.44 | 4.14 | 4.60 | 6.25 |
| 10 | 1.38 | 1.18 | 1.12 | 1.12 | 1.18 | 1.18 |
| 11 | 1.40 | 1.20 | 1.07 | 1.14 | 1.20 | 1.20 |
| 12 | 1.41 | 1.14 | 1.07 | 1.11 | 1.20 | 1.20 |
| 13 | 42.60 | 28.90 | 25.90 | 29.00 | 30.80 | 29.80 |
| 14 | 42.70 | 28.40 | 23.70 | 30.30 | 32.00 | 30.50 |
| 15 | 3.88 | 3.98 | 4.10 | 4.55 | 4.76 | 4.92 |
| 16 | 4.09 | 4.29 | 4.36 | 4.07 | 4.67 | 4.64 |
| 17 | 4.48 | 4.19 | 4.51 | 4.21 | 4.25 | 4.74 |
| 18 | 4.79 | 9.12 | 11.57 | 8.10 | 7.80 | 8.55 |
| 19 | 84.60 | 82.00 | 80.60 | 82.00 | 82.50 | 82.70 |
| 20 | −29.38 | −28.214 | −28.806 | −28.061 | −28.201 | −28.569 |
| 21 | 30.70 | 30.30 | 29.60 | 30.40 | 29.80 | 30.50 |
| 22 | 35.20 | 36.20 | 36.80 | 35.60 | 35.60 | 36.60 |
| 23 | NA | NA | NA | NA | NA | NA |
| 24 | NA | NA | NA | NA | NA | NA |
| 25 | 85.20 | 83.60 | 84.50 | 95.90 | 95.90 | 83.90 |
| 26 | 8854.50 | 5650.70 | 6003.30 | 6691.80 | 9005.00 | 7268.00 |
| 27 | 5.63 | 5.62 | 5.33 | 7.41 | 7.54 | 5.51 |
| 28 | 33.80 | 31.90 | 32.90 | 22.10 | 28.10 | 31.10 |
| 29 | 33.60 | 35.30 | 38.10 | 32.80 | 34.40 | 35.30 |
| 30 | −0.083 | −0.1316 | −0.2426 | −0.5146 | −0.2441 | −0.2368 |
| 31 | 45.40 | 28.10 | 33.50 | 47.90 | 45.90 | 44.00 |
| 32 | 13.10 | 14.30 | 11.80 | 14.50 | 12.60 | 14.00 |
| 33 | 2.99 | 3.45 | 2.88 | 3.40 | 3.28 | 3.29 |
| 34 | 50.80 | 51.70 | 39.70 | 35.30 | 42.10 | 42.10 |
| 35 | 196.40 | 199.80 | 179.40 | 134.30 | 198.50 | 165.50 |
| 36 | 21.90 | 13.90 | 11.60 | 17.30 | 15.00 | 12.10 |
| 37 | 102.70 | 104.40 | 126.00 | 145.20 | 109.50 | 106.20 |
| 38 | NA | NA | 3.16 | 1.11 | NA | NA |
| 39 | 2.34 | 3.75 | 3.31 | 1.84 | 2.74 | 3.09 |
| 40 | 30.30 | 17.90 | 12.40 | 19.60 | 14.70 | 15.70 |
| 41 | 1.13 | 0.80 | 0.58 | 0.13 | 0.15 | 0.71 |
| 42 | 11.29 | 10.83 | 8.73 | 12.33 | 9.19 | 10.65 |
| 43 | 39.50 | 39.70 | 30.20 | 47.60 | 37.80 | 35.90 |
| 44 | 1.87 | 3.21 | 3.00 | NA | 2.82 | 3.87 |
| 45 | 2.06 | 2.25 | 2.65 | 2.73 | 2.55 | 3.56 |
| 46 | 15.5 | 31.5 | 29.3 | NA | 25.6 | 34.6 |
| 47 | 18.2 | 25.1 | 29 | 29.1 | 25.9 | 32.7 |
| 48 | 116.7 | 99.6 | 99.5 | 97.7 | 102.7 | 109.9 |
| 49 | 102.2 | 127.3 | 105.8 | 151.3 | 117.6 | 119.2 |
| 50 | 1.63 | 2.07 | 1.86 | 1.57 | 1.87 | 1.94 |

Table 136: Provided are the values of each of the parameters (as described above) measured in cotton accessions (Line). Growth conditions are specified in the experimental procedure section.

TABLE 137

Measured parameters in Cotton accessions (1-7) under drought conditions

| Line/Corr. ID | Line-1 | Line-2 | Line-3 | Line-4 | Line-5 | Line-6 | Line-7 |
|---|---|---|---|---|---|---|---|
| 1 | 1573 | 1378.9 | 1634.8 | 1597.2 | 1358.9 | 745 | 1246 |
| 2 | 48.70 | 43.50 | 48.20 | 52.20 | 45.90 | 19.40 | 42.60 |
| 3 | 622.00 | 554.20 | 659.30 | 683.30 | 494.70 | 76.00 | 467.30 |
| 4 | 19.20 | 17.50 | 19.40 | 20.50 | 16.70 | 2.20 | 16.00 |
| 5 | 2.06 | 1.08 | 2.00 | 1.82 | 0.84 | 0.27 | 1.43 |
| 6 | 2.63 | 1.20 | 2.53 | NA | NA | NA | NA |
| 7 | 2.34 | 1.57 | 2.32 | NA | NA | 0.47 | 1.44 |
| 8 | 6.76 | 3.05 | 6.51 | NA | NA | NA | NA |
| 9 | 6.15 | 4.25 | 5.90 | NA | NA | 3.51 | 4.18 |
| 10 | 1.10 | 1.22 | 1.09 | 1.07 | 1.39 | 0.93 | 0.82 |
| 11 | 1.13 | 1.24 | 1.15 | 1.05 | 1.40 | 0.91 | 0.94 |
| 12 | 1.10 | 1.06 | 1.05 | 1.08 | 1.35 | 0.95 | 0.87 |
| 13 | 28.00 | 35.30 | 24.90 | 29.40 | 40.90 | 17.90 | 22.00 |
| 14 | 27.10 | 30.70 | 23.00 | 27.80 | 39.90 | 17.00 | 26.30 |
| 15 | 4.28 | 4.17 | 4.09 | 4.71 | 3.70 | 6.39 | 5.56 |
| 16 | 4.98 | 4.58 | 4.73 | 5.37 | 4.83 | 7.42 | 5.84 |
| 17 | 4.63 | 3.85 | 4.36 | 5.13 | 4.57 | 7.34 | 5.52 |
| 18 | 9.10 | 7.70 | 10.60 | 10.70 | 4.70 | 16.40 | 17.30 |
| 19 | 81.60 | 82.80 | 80.20 | 80.80 | 84.40 | 76.40 | 75.70 |
| 20 | −28.081 | −28.655 | −28.723 | −27.658 | −28.28 | −27.948 | −28.233 |
| 21 | 33.00 | 33.60 | 33.00 | 34.60 | 33.10 | 33.40 | 33.00 |
| 22 | 35.20 | 38.60 | 37.00 | 34.70 | 38.50 | 37.90 | 37.40 |
| 23 | 481.10 | 427.70 | 581.70 | 512.40 | 450.70 | 610.10 | NA |
| 24 | 392.20 | 369.50 | 405.90 | 482.50 | 224.20 | 381.40 | 554.40 |
| 25 | 68.90 | 68.20 | 76.30 | 65.20 | 79.60 | 77.90 | 71.90 |
| 26 | 3928.30 | 5090.00 | 6094.30 | 6011.00 | 5919.00 | 4668.20 | 4397.70 |
| 27 | 3.66 | 2.91 | 3.76 | 3.33 | 4.38 | 4.26 | 2.87 |
| 28 | 47.40 | 46.80 | 48.50 | 49.30 | 53.50 | 46.40 | 48.60 |
| 29 | 36.30 | 38.80 | 39.80 | 40.70 | 39.30 | 37.40 | 39.20 |
| 30 | 0.34 | 0.17 | 0.22 | 0.28 | 0.45 | 0.24 | 0.28 |
| 31 | 28.90 | 37.40 | 33.10 | 41.00 | 39.80 | 33.40 | 27.00 |
| 32 | 11.40 | 11.70 | 10.80 | 10.80 | 11.00 | 9.90 | 11.30 |
| 33 | 2.89 | 3.09 | 3.08 | 3.17 | 3.25 | 2.84 | 2.60 |
| 34 | 92.90 | 87.20 | 79.80 | 85.60 | 71.30 | 77.20 | 99.40 |
| 35 | 0.99 | 0.96 | 0.99 | 0.98 | 0.97 | 1.00 | NA |
| 36 | 37.20 | 51.20 | 46.90 | 45.60 | 40.00 | 28.20 | 41.40 |
| 37 | 140.20 | 140.80 | 184.70 | 147.40 | 149.50 | 116.50 | 161.30 |
| 38 | 9.30 | 14.50 | 9.80 | 12.50 | 19.90 | 8.00 | 10.60 |
| 39 | 100.20 | 99.80 | 99.30 | 96.20 | 92.90 | 99.40 | 127.00 |
| 40 | NA | NA | NA | NA | NA | NA | 4.24 |
| 41 | 3.77 | 3.70 | 3.63 | 2.92 | 2.50 | 3.20 | 4.76 |
| 42 | 9.80 | 14.10 | 10.60 | 12.20 | 23.20 | 10.30 | 11.90 |
| 43 | 1.04 | 0.88 | 1.17 | 1.08 | 1.38 | 1.05 | 1.23 |
| 44 | 6.98 | 7.23 | 7.17 | 7.42 | 8.23 | 5.97 | 7.60 |
| 45 | 3.45 | 1.66 | 3.55 | NA | NA | NA | NA |
| 46 | 3.30 | 2.30 | 3.16 | NA | NA | 2.56 | 2.16 |
| 47 | 32.60 | 15.60 | 33.50 | NA | NA | NA | NA |
| 48 | 33.40 | 21.80 | 34.60 | NA | NA | 32.10 | 27.50 |
| 49 | 99.10 | 105.40 | 94.20 | 80.70 | 109.00 | 80.40 | 92.90 |
| 50 | 24.90 | 24.00 | 25.50 | 27.10 | 27.50 | 16.50 | 24.00 |

Table 137: Provided are the values of each of the parameters (as described above) measured in Barley accessions (Line). Growth conditions are specified in the experimental procedure section.

TABLE 138

Measured parameters in additional Cotton accessions (8-13) under drought conditions

| Line/Corr. ID | Line-8 | Line-9 | Line-10 | Line-11 | Line-12 | Line-13 |
|---|---|---|---|---|---|---|
| 1 | 1583.1 | 1552.1 | 1419.2 | 1533.2 | 1489.2 | 1606.4 |
| 2 | 52.40 | 49.10 | 46.00 | 50.70 | 42.40 | 57.10 |
| 3 | 592.60 | 598.80 | 558.00 | 428.00 | 563.70 | 614.70 |
| 4 | 19.60 | 18.90 | 18.30 | 14.10 | 16.10 | 20.20 |
| 5 | 1.00 | 1.82 | 2.02 | 1.01 | 1.59 | 2.02 |
| 6 | 1.31 | 2.11 | NA | 1.13 | 1.75 | 2.15 |
| 7 | 0.86 | 1.95 | 1.82 | 0.97 | 1.64 | 1.86 |
| 8 | 3.58 | 5.50 | NA | 4.20 | 4.88 | 5.90 |
| 9 | 2.43 | 5.17 | 5.14 | 3.36 | 4.45 | 5.03 |
| 10 | 1.33 | 1.11 | 1.06 | 1.04 | 1.10 | 1.13 |
| 11 | 1.33 | 1.13 | 1.07 | 1.06 | 1.07 | 1.13 |

TABLE 138-continued

Measured parameters in additional Cotton accessions (8-13) under drought conditions

| Line/Corr. ID | Line-8 | Line-9 | Line-10 | Line-11 | Line-12 | Line-13 |
|---|---|---|---|---|---|---|
| 12 | 1.32 | 1.11 | 0.99 | 1.07 | 1.08 | 1.09 |
| 13 | 43.10 | 28.10 | 26.10 | 28.40 | 29.20 | 30.00 |
| 14 | 43.50 | 27.80 | 22.30 | 28.90 | 31.90 | 30.30 |
| 15 | 4.07 | 4.32 | 4.26 | 4.71 | 4.98 | 4.69 |
| 16 | 4.46 | 5.10 | 5.07 | 4.88 | 4.88 | 4.51 |
| 17 | 3.98 | 4.63 | 4.28 | 4.69 | 5.35 | 4.21 |
| 18 | 4.70 | 10.10 | 12.30 | 8.90 | 8.60 | 9.30 |
| 19 | 84.00 | 80.90 | 79.50 | 81.40 | 80.80 | 82.20 |
| 20 | −28.403 | −27.778 | −27.808 | −26.931 | −27.501 | −27.862 |
| 21 | 33.20 | 32.60 | 32.90 | 33.70 | 33.50 | 33.60 |
| 22 | 37.00 | 36.50 | 37.20 | 36.30 | 36.20 | 35.70 |
| 23 | 327.50 | 407.00 | 510.50 | 541.80 | 382.80 | 555.90 |
| 24 | 218.80 | 426.90 | 420.70 | 384.40 | 434.20 | 498.80 |
| 25 | 71.60 | 68.80 | 59.40 | 81.20 | 79.90 | 60.40 |
| 26 | 6847.00 | 4819.70 | 3690.00 | 7521.90 | 6199.30 | 5593.00 |
| 27 | 3.61 | 3.08 | 2.58 | 4.15 | 4.03 | 2.46 |
| 28 | 48.80 | 51.20 | 52.10 | 43.80 | 45.80 | 49.00 |
| 29 | 38.50 | 39.10 | 41.90 | 37.40 | 37.70 | 37.90 |
| 30 | 0.31 | 0.37 | 0.30 | 0.08 | 0.18 | 0.31 |
| 31 | 41.90 | 30.60 | 30.10 | 46.00 | 39.50 | 34.20 |
| 32 | 11.90 | 12.50 | 10.60 | 11.80 | 11.30 | 12.00 |
| 33 | 3.17 | 3.37 | 2.91 | 3.46 | 3.50 | 3.22 |
| 34 | 74.80 | 97.70 | 85.50 | 104.40 | 93.00 | 93.40 |
| 35 | 0.99 | 0.99 | 0.99 | 0.99 | 0.99 | 0.98 |
| 36 | 49.80 | 44.30 | 36.50 | 43.20 | 38.00 | 37.80 |
| 37 | 162.80 | 159.80 | 123.20 | 192.80 | 156.60 | 163.70 |
| 38 | 19.60 | 11.40 | 9.10 | 14.00 | 10.20 | 11.00 |
| 39 | 92.90 | 97.70 | 127.00 | 98.80 | 98.50 | 98.80 |
| 40 | NA | NA | NA | NA | NA | NA |
| 41 | 1.62 | 3.62 | 4.67 | 2.30 | 3.21 | 3.57 |
| 42 | 22.80 | 12.70 | 9.90 | 14.50 | 11.70 | 12.80 |
| 43 | 0.89 | 0.96 | 0.88 | 0.21 | 0.37 | 0.88 |
| 44 | 9.39 | 7.68 | 7.06 | 10.31 | 7.55 | 8.19 |
| 45 | 2.15 | 2.82 | NA | 3.18 | 2.74 | 3.20 |
| 46 | 1.38 | 2.64 | 2.51 | 2.31 | 2.53 | 2.65 |
| 47 | 18.70 | 29.50 | NA | 31.20 | 27.30 | 29.00 |
| 48 | 13.90 | 29.20 | 28.10 | 24.80 | 27.80 | 26.00 |
| 49 | 108.70 | 95.50 | 98.70 | 99.00 | 97.20 | 109.60 |
| 50 | 30.40 | 25.90 | 23.30 | 31.70 | 23.90 | 30.60 |

Table 138. Provided are the values of each of the parameters (as described above) measured in Barley accessions (Line). Growth conditions are specified in the experimental procedure section.

TABLE 139

Correlation between the expression level of selected genes of some embodiments of the invention in various tissues and the phenotypic performance under normal conditions (set 1) across Cotton accessions

| Gene Name | R | P value | Exp. set | Corr. ID | Gene Name | R | P value | Exp. set | Corr. ID |
|---|---|---|---|---|---|---|---|---|---|
| CT4 | 0.79 | 5.99E−02 | 8 | 24 | CT4 | 0.73 | 4.50E−03 | 4 | 25 |
| CT4 | 0.74 | 1.54E−02 | 1 | 34 | CT4 | 0.84 | 2.35E−03 | 1 | 15 |
| CT4 | 0.76 | 8.09E−02 | 7 | 25 | CT4 | 0.75 | 8.44E−02 | 7 | 27 |
| LBY413 | 0.77 | 3.38E−03 | 3 | 30 | LBY413 | 0.76 | 3.76E−03 | 3 | 33 |
| LBY413 | 0.97 | 9.88E−04 | 8 | 30 | LBY413 | 0.79 | 6.07E−02 | 8 | 38 |
| LBY413 | 0.91 | 1.24E−02 | 8 | 36 | LBY413 | 0.83 | 4.31E−02 | 8 | 15 |
| LBY413 | 0.96 | 5.18E−04 | 2 | 28 | LBY413 | 0.77 | 4.13E−02 | 2 | 38 |
| LBY413 | 0.95 | 1.15E−03 | 2 | 36 | LBY413 | 0.73 | 6.03E−02 | 2 | 15 |
| LBY413 | 0.70 | 7.72E−03 | 4 | 28 | LBY413 | 0.88 | 1.92E−02 | 6 | 25 |
| LBY413 | 0.87 | 2.28E−02 | 6 | 8 | LBY413 | 0.84 | 3.67E−02 | 6 | 28 |
| LBY413 | 0.94 | 4.82E−03 | 6 | 24 | LBY413 | 0.92 | 9.51E−03 | 6 | 3 |
| LBY413 | 0.73 | 1.02E−01 | 6 | 29 | LBY413 | 0.88 | 2.10E−02 | 6 | 11 |
| LBY413 | 0.72 | 8.80E−03 | 9 | 8 | LBY413 | 0.81 | 1.48E−03 | 9 | 3 |
| LBY413 | 0.72 | 7.77E−03 | 9 | 5 | LBY413 | 0.79 | 3.94E−03 | 9 | 2 |
| LBY413 | 0.91 | 3.60E−05 | 9 | 15 | LBY413 | 0.76 | 7.73E−02 | 5 | 7 |
| LBY413 | 0.85 | 1.47E−02 | 5 | 8 | LBY413 | 0.83 | 4.27E−02 | 5 | 10 |
| LBY413 | 0.92 | 3.21E−03 | 5 | 3 | LBY413 | 0.84 | 3.60E−02 | 5 | 4 |
| LBY413 | 0.83 | 1.94E−02 | 5 | 5 | LBY413 | 0.86 | 1.32E−02 | 5 | 12 |
| LBY413 | 0.71 | 7.55E−02 | 5 | 13 | LBY413 | 0.87 | 2.60E−02 | 5 | 2 |
| LBY413 | 0.88 | 8.79E−03 | 5 | 11 | LBY413 | 0.85 | 1.87E−03 | 1 | 24 |
| LBY413 | 0.91 | 1.13E−02 | 7 | 30 | LBY413 | 0.85 | 3.13E−02 | 7 | 25 |
| LBY413 | 0.78 | 6.76E−02 | 7 | 37 | LBY413 | 0.85 | 3.42E−02 | 7 | 27 |

TABLE 139-continued

Correlation between the expression level of selected genes of some embodiments of the invention in various tissues and the phenotypic performance under normal conditions (set 1) across Cotton accessions

| Gene Name | R | P value | Exp. set | Corr. ID | Gene Name | R | P value | Exp. set | Corr. ID |
|---|---|---|---|---|---|---|---|---|---|
| LBY413 | 0.79 | 5.99E−02 | 7 | 35 | LBY413 | 0.74 | 9.57E−02 | 7 | 34 |
| LBY413 | 0.94 | 6.14E−03 | 7 | 15 | LBY413 | 0.98 | 3.69E−04 | 7 | 33 |
| LBY413 | 0.72 | 1.05E−01 | 7 | 11 | | | | | |

Table 139. Provided are the correlations (R) between the expression levels of the genes of some embodiments of the invention and their homologues in tissues [mature leaf, lower and upper main stem, flower, main mature boll and fruit; Expression sets (Exp), Table 127] and the phenotypic performance in various yield, biomass, growth rate and/or vigor components [Correlation vector (corr.) according to Table 130] under normal conditions across Cotton accessions. P = p value.

TABLE 140

Correlation between the expression level of selected genes of some embodiments of the invention in additional tissues and the phenotypic performance under normal conditions (set 2) across Cotton accessions

| Gene Name | R | P value | Exp. set | Corr. ID | Gene Name | R | P value | Exp. set | Corr. ID |
|---|---|---|---|---|---|---|---|---|---|
| CT4 | 0.71 | 9.24E−03 | 2 | 39 | LBY413 | 0.88 | 1.87E−04 | 2 | 39 |
| LBY413 | 0.71 | 9.97E−03 | 2 | 28 | LBY413 | 0.84 | 5.99E−04 | 2 | 30 |
| LBY413 | 0.71 | 3.18E−02 | 1 | 34 | LBY413 | 0.72 | 2.80E−02 | 1 | 8 |
| LBY413 | 0.72 | 2.90E−02 | 1 | 46 | LBY413 | 0.81 | 8.80E−03 | 1 | 20 |
| LBY413 | 0.73 | 4.66E−03 | 3 | 39 | LBY413 | 0.91 | 1.60E−05 | 3 | 50 |
| LBY413 | 0.72 | 8.44E−03 | 3 | 8 | LBY413 | 0.72 | 5.48E−03 | 3 | 9 |

Table 140. Provided are the correlations (R) between the expression levels of the genes of some embodiments of the invention and their homologues in various tissues ["Exp. Set"-Expression set specified in Table 128] and the phenotypic performance in various yield, biomass, growth rate and/or vigor components according to the "Corr. ID" (correlation vectors ID) specified in Table 131. "R" = Pearson correlation coefficient; "P" = p value

TABLE 141

Correlation between the expression level of selected genes of some embodiments of the invention in various tissues and the phenotypic performance under drought conditions across Cotton accessions

| Gene Name | R | P value | Exp. set | Corr. ID | Gene Name | R | P value | Exp. set | Corr. ID |
|---|---|---|---|---|---|---|---|---|---|
| CT4 | 0.75 | 1.95E−02 | 7 | 17 | CT4 | 0.76 | 1.03E−02 | 3 | 38 |
| CT4 | 0.87 | 1.21E−03 | 3 | 42 | CT4 | 0.70 | 1.08E−02 | 2 | 37 |
| CT4 | 0.78 | 3.90E−02 | 1 | 38 | CT4 | 0.86 | 1.24E−02 | 1 | 44 |
| CT4 | 0.75 | 5.10E−02 | 1 | 32 | CT4 | 0.83 | 1.96E−02 | 1 | 42 |
| CT4 | 0.94 | 1.39E−03 | 1 | 14 | CT4 | 0.76 | 4.63E−02 | 1 | 12 |
| CT4 | 0.85 | 1.48E−02 | 1 | 13 | CT4 | 0.91 | 4.42E−05 | 5 | 15 |
| CT4 | 0.85 | 4.71E−04 | 5 | 17 | CT4 | 0.74 | 5.55E−03 | 5 | 16 |
| LBY413 | 0.72 | 1.04E−01 | 4 | 8 | LBY413 | 0.78 | 6.62E−02 | 4 | 6 |
| LBY413 | 0.72 | 1.07E−01 | 6 | 8 | LBY413 | 0.77 | 8.92E−03 | 6 | 5 |
| LBY413 | 0.76 | 1.15E−02 | 6 | 29 | LBY413 | 0.74 | 9.51E−02 | 6 | 6 |
| LBY413 | 0.77 | 9.58E−03 | 6 | 39 | LBY413 | 0.71 | 2.13E−02 | 6 | 41 |
| LBY413 | 0.74 | 2.19E−02 | 7 | 39 | LBY413 | 0.87 | 2.40E−03 | 7 | 34 |
| LBY413 | 0.85 | 3.93E−03 | 7 | 41 | LBY413 | 0.75 | 4.74E−03 | 2 | 15 |
| LBY413 | 0.81 | 1.55E−03 | 2 | 17 | LBY413 | 0.70 | 1.11E−02 | 2 | 24 |
| LBY413 | 0.86 | 3.26E−04 | 2 | 16 | LBY413 | 0.70 | 7.73E−02 | 2 | 47 |
| LBY413 | 0.80 | 1.91E−03 | 2 | 20 | LBY413 | 0.86 | 1.41E−02 | 1 | 11 |
| LBY413 | 0.72 | 8.26E−03 | 5 | 34 | | | | | |

Table 141. Provided are the correlations (R) between the expression levels of the genes of some embodiments of the invention and their homologues in various tissues ["Exp. Set"-Expression set specified in Table 129] and the phenotypic performance in various yield, biomass, growth rate and/or vigor components according to the "Corr. ID" (correlation vectors ID) specified in Table 132. "R" = Pearson correlation coefficient; "P" = p value

Example 13

Production of Bean Transcriptome and High Throughput Correlation Analysis with Yield Parameters Using 60K Bean (*Phaseolus Vulgaris* L.) Oligonucleotide Micro-Arrays In order to produce a high throughput correlation analysis, the present inventors utilized a Bean oligonucleotide microarray, produced by Agilent Technologies [chem. (dot) agilent (dot) com/Scripts/PDS (dot) asp?lPage=50879]. The array oligonucleotide represents about 60,000 Bean genes and transcripts. In order to define correlations between the levels of RNA expression with yield components or plant architecture related parameters or plant vigor related parameters, various plant characteristics of 40 different commercialized bean varieties were analyzed and further used for RNA expression analysis. The correlation between the RNA levels and the characterized parameters was analyzed using Pearson correlation test [davidmlane (dot) com/hyperstat/A34739 (dot) html].

Experimental Procedures

Normal (Standard) growth conditions of Bean plants included 524 m$^3$ water per dunam (1000 square meters) per entire growth period and fertilization of 16 units nitrogen per dunam per entire growth period. The nitrogen can be obtained using URAN® 21% (Nitrogen Fertilizer Solution; PCS Sales, Northbrook, Ill., USA).

Analyzed Bean Tissues

Six tissues [leaf, Stem, lateral stem, lateral branch flower bud, lateral branch pod with seeds and meristem] growing under normal conditions [field experiment, normal growth conditions which included irrigation with water 2-3 times a week with 524 m$^3$ water per dunam (1000 square meters) per entire growth period, and fertilization of 16 units nitrogen per dunam given in the first month of the growth period] were sampled and RNA was extracted as described above.

For convenience, each micro-array expression information tissue type has received a Set ID as summarized in Table 142 below.

TABLE 142

Bean transcriptome expression sets

| Expression Set | Set ID |
|---|---|
| Lateral branch flower bud at flowering stage under normal growth conditions | 1 |
| Lateral branch pod with seeds at pod setting stage under normal growth conditions | 2 |
| Lateral stem at pod setting stage under normal growth conditions | 3 |
| Lateral stem at flowering stage under normal growth conditions | 4 |
| Leaf at pod setting stage under normal growth conditions | 5 |
| Leaf at flowering stage under normal growth conditions | 6 |
| Leaf at vegetative stage under normal growth conditions | 7 |
| Meristem at vegetative stage under normal growth conditions | 8 |
| stem at vegetative stage under normal growth conditions | 9 |

Table 142: Provided are the bean transcriptome expression sets. Lateral branch flower bud = flower bud from vegetative branch; Lateral branch pod with seeds = pod with seeds from vegetative branch; Lateral stem = stem from vegetative branch.

Bean Yield Components and Vigor Related Parameters Assessment

40 Bean varieties were grown in five repetitive plots, in field. Briefly, the growing protocol was as follows: Bean seeds were sown in soil and grown under normal conditions until harvest. Plants were continuously phenotyped during the growth period and at harvest (Table 143). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The collected data parameters were as follows:

% Canopy coverage—percent Canopy coverage at grain filling stage, R1 flowering stage and at vegetative stage. The % Canopy coverage is calculated using Formula 32 above.

1000 seed weight [gr.]—At the end of the experiment all seeds from all plots were collected and weighted and the weight of 1000 were calculated.

Days till 50% flowering [days]—number of days till 50% flowering for each plot.

Avr (average) shoot DW (gr.)—At the end of the experiment, the shoot material was collected, measured and divided by the number of plants.

Big pods FW per plant (PS) [gr.]—1 meter big pods fresh weight at pod setting divided by the number of plants.

Big pods number per plant (PS)—number of pods at development stage of R3-4 period above 4 cm per plant at pod setting.

Small pods FW per plant (PS) [gr.]—1 meter small pods fresh weight at pod setting divided by the number of plants.

Small pods number per plant (PS)—number of pods at development stage of R3-4 period below 4 cm per plant at pod setting.

Pod Area [cm$^2$]—At development stage of R3-4 period pods of three plants were weighted, photographed and images were processed using the below described image processing system. The pod area above 4 cm and below 4 cm was measured from those images and was divided by the number of pods.

Pod Length and Pod width [cm]—At development stage of R3-4 period pods of three plants were weighted, photographed and images were processed using the below described image processing system. The sum of pod lengths/or width (longest axis) was measured from those images and was divided by the number of pods.

Number of lateral branches per plant [value/plant]—number of lateral branches per plant at vegetative stage (average of two plants per plot) and at harvest (average of three plants per plot).

Relative growth rate [cm/day]: the relative growth rate (RGR) of Plant Height was calculated using Formula 3 above.

Leaf area per plant (PS) [cm$^2$]=Total leaf area of 3 plants in a plot at pod setting. Measurement was performed using a Leaf area-meter.

Specific leaf area (PS) [cm$^2$/gr.]—leaf area per leaf dry weight at pod set.

Leaf form—Leaf length (cm)/leaf width (cm); average of two plants per plot.

Leaf number per plant (PS)—Plants were characterized for leaf number during pod setting stage. Plants were measured for their leaf number by counting all the leaves of 3 selected plants per plot.

Plant height [cm]—Plants were characterized for height during growing period at 3 time points. In each measure, plants were measured for their height using a measuring tape. Height of main stem was measured from first node above ground to last node before apex.

Seed yield per area (H)[gr.]—1 meter seeds weight at harvest.

Seed yield per plant (H)[gr.]—Average seeds weight per plant at harvest in 1 meter plot.

Seeds number per area (H)—1 meter plot seeds number at harvest.

Total seeds per plant (H)—Seeds number on lateral branch per plant+Seeds number on main branch per plant at harvest, average of three plants per plot.

Total seeds weight per plant (PS) [gr.]—Seeds weight on lateral branch+Seeds weight on main branch at pod set per plant, average of three plants per plot.

Small pods FW per plant (PS)—Average small pods (below 4 cm) fresh weight per plant at pod setting per meter.

Small pods number per plant (PS)—Number of Pods below 4 cm per plant at pod setting, average of two plants per plot.

SPAD—Plants were characterized for SPAD rate during growing period at grain filling stage and vegetative stage.

Chlorophyll content was determined using a Minolta SPAD 502 chlorophyll meter and measurement was performed 64 days post sowing. SPAD meter readings were done on young fully developed leaf. Three measurements per leaf were taken per plot.

Stem width (R2F)[mm]—width of the stem of the first node at R2 flowering stage, average of two plants per plot.

Total pods number per plant (H), (PS)—Pods number on lateral branch per plant+Pods number on main branch per plant at pod setting and at harvest, average of three plants per plot.

Total pods DW per plant (H) [gr.]—Pods dry weight on main branch per plant+Pods dry weight on lateral branch per plant at harvest, average of three plants per plot.

Total pods FW per plant (PS) [gr.]—Average pods fresh weight on lateral branch+Pods weight on main branch at pod setting.

Pods weight per plant (RP) (H) [gr.]—Average pods weight per plant at harvest in 1 meter.

Total seeds per plant (H), (PS)—Seeds number on lateral branch per plant+Seeds number on main branch per plant at pod setting and at harvest, average of three plants per plot.

Total seeds number per pod (H), (PS)—Total seeds number per plant divided in total pods num per plant, average of three plants per plot.

Vegetative FW and DW per plant (PS) [gr./plant]—total weight of the vegetative portion above ground (excluding roots and pods) before and after drying at 70° C. in oven for 48 hours at pod set, average of three plants per plot.

Vigor till flowering [gr./day]—Relative growth rate (RGR) of shoot DW=Regression coefficient of shoot DW along time course (two measurements at vegetative stage and one measurement at flowering stage).

Vigor post flowering [gr./day]—Relative growth rate (RGR) of shoot DW=Regression coefficient of shoot DW measurements along time course (one measurement at flowering stage and two measurements at grain filling stage).

Experimental Results 40 different bean varieties lines 1-40 were grown and characterized for 49 parameters as specified above. Among the 40 varieties, 16 varieties are "fine" and "extra fine". The average for each of the measured parameters was calculated using the JMP software and values are summarized in Tables 144-148 below. Subsequent correlation analysis between the various transcriptome sets and the average parameters was conducted (Table 151). Follow, results were integrated to the database. Correlations were calculated across all 40 lines. The phenotypic data of all 40 lines is provided in Tables 144-148 below. The correlation data of all 40 lines is provided in Table 151 below. The phenotypic data of "fine" and "extra fine" lines is provided in Tables 149-150 below. The correlation data of "fine" and "extra fine" lines is provided in Table 152 below.

TABLE 143

| Bean correlated parameters (vectors) | |
|---|---|
| Correlated parameter with | Correlation ID |
| % Canopy coverage (GF) | 1 |
| % Canopy coverage (R1F) | 2 |
| % Canopy coverage (V) | 3 |
| SPAD (GF) | 4 |
| SPAD (V) | 5 |
| PAR_LAI (EGF) | 6 |
| PAR_LAI (LGF) | 7 |
| PAR_LAI (R1F) | 8 |
| Leaf area per plant (PS) [cm$^2$] | 9 |
| Leaf form | 10 |
| Leaf Length [cm] | 11 |
| Leaf num per plant (PS) | 12 |
| Leaf Width [cm] | 13 |
| Specific leaf area (PS) [cm$^2$/gr.] | 14 |
| Stem width (R2F) [mm] | 15 |
| Avr shoot DW (EGF) [gr.] | 16 |
| Avr shoot DW (R2F) [gr.] | 17 |
| Avr shoot DW (V) [gr.] | 18 |
| Num of lateral branches per plant (H) | 19 |
| Num of lateral branches per plant (V) | 20 |
| Vegetative DW per plant (PS) [gr.] | 21 |
| Vegetative FW per plant (PS) [gr.] | 22 |
| Height Rate [cm/day] | 23 |
| Plant height (GF) [cm] | 24 |
| Plant height (V2-V3) [cm] | 25 |
| Plant height (V4-V5) [cm] | 26 |
| Vigor till flowering [gr./day] | 27 |
| Vigor post flowering [gr./day] | 28 |
| Mean (Pod Area) | 29 |
| Mean (Pod Average Width) | 30 |
| Mean (Pod Length) | 31 |
| Pods weight per plant (RP) (H) [gr.] | 32 |
| Small pods FW per plant (PS) (RP) [gr.] | 33 |
| Small pods num per plant (PS) | 34 |
| Big pods num per plant (PS) [gr.] | 35 |
| Big pods FW per plant (PS) (RP) [gr.] | 36 |
| Total pods DW per plant (H) [gr.] | 37 |
| Total pods weight per plant (PS) [gr.] | 38 |
| Total pods num per plant (H) | 39 |
| Total pods num per plant (PS) | 40 |
| 1000 seed weight [gr.] | 41 |
| Seed yield per area (H) (RP) [gr.] | 42 |
| Seed yield per plant (RP) (H) [gr.] | 43 |
| Total seeds weight per plant (PS) [gr.] | 44 |
| Seeds num per area (H) (RP) | 45 |
| Total seeds num per pod (H) | 46 |
| Total seeds num per pod (PS) | 47 |
| Total seeds per plant (H) [number] | 48 |
| Total seeds per plant (PS) [number] | 49 |

Table 143. Provided are the Bean correlated parameters (vectors),
"gr." = grams;
"SPAD" = chlorophyll levels;
"PAR" = Photosynthetically active radiation;
"FW" = Plant Fresh weight;
"normal" = standard growth conditions;
"GF" = Grain filling;
"R1F" = Flowering in R1 stage;
"V" = Vegetative stage;
"EGF" = Early grain filling;
"R2F" = Flowering in R2 stage;
"PS" = Pod setting;
"RP" = Rest of the plot;
"H" = Harvest;
"LGF" = Late grain filling;
"V2-V3" = Vegetative stages 2-3;
"V4-V5" = Vegetative stages 4-5.

TABLE 144

Measured parameters in bean varieties (lines 1-8)

| Line/Corr. ID | Line-1 | Line-2 | Line-3 | Line-4 | Line-5 | Line-6 | Line-7 | Line-8 |
|---|---|---|---|---|---|---|---|---|
| 1 | 88.70 | 87.40 | 78.20 | 91.00 | NA | 80.80 | 76.70 | 90.30 |
| 2 | 89.60 | 82.80 | 66.40 | 78.90 | 79.30 | 72.30 | 82.80 | 90.50 |
| 3 | 70.50 | 61.60 | 56.50 | 58.60 | 65.40 | 39.00 | 70.50 | 83.60 |
| 4 | 40.20 | 38.40 | 34.50 | 36.20 | 38.60 | 37.70 | 40.50 | NA |
| 5 | 36.00 | 40.00 | 30.80 | 39.40 | 33.70 | 31.40 | 35.40 | 40.10 |
| 6 | 8.44 | 6.39 | 4.85 | 7.85 | 6.10 | 5.78 | 7.82 | 7.61 |
| 7 | 6.15 | 4.76 | 3.97 | 5.84 | NA | 4.38 | 4.03 | 4.01 |
| 8 | 3.27 | 3.42 | 2.05 | 3.06 | 3.21 | 1.33 | 4.11 | 5.01 |
| 9 | 211.70 | 242.10 | 183.00 | 307.10 | 306.50 | 133.10 | 253.10 | 308.10 |
| 10 | 1.64 | 1.59 | 1.53 | 1.32 | 1.59 | 1.58 | 1.47 | 1.56 |
| 11 | 13.30 | 12.30 | 11.80 | 11.60 | 12.20 | 11.10 | 13.20 | 13.10 |
| 12 | 4.73 | 4.67 | 4.67 | 6.07 | 5.00 | 4.73 | 5.00 | 6.17 |
| 13 | 8.16 | 7.75 | 7.69 | 8.83 | 7.67 | 7.03 | 8.97 | 8.42 |
| 14 | 226.30 | 226.10 | 211.40 | 222.30 | 207.30 | 213.00 | 201.00 | 207.30 |
| 15 | 5.79 | 5.65 | 6.14 | 5.84 | 6.01 | 5.39 | 6.10 | 5.83 |
| 16 | 16.20 | 28.60 | 14.00 | 18.70 | 23.20 | 19.30 | 18.40 | 27.80 |
| 17 | 7.33 | 10.29 | 7.58 | 8.28 | 9.42 | 6.37 | 11.51 | 11.85 |
| 18 | 0.30 | 0.42 | 0.30 | 0.33 | 0.41 | 0.24 | 0.44 | 0.44 |
| 19 | 7.93 | 6.06 | 7.00 | 6.20 | 7.27 | 7.93 | 6.93 | 7.00 |
| 20 | 4.90 | 5.17 | 5.50 | 4.90 | 5.30 | 5.80 | 6.60 | 6.60 |
| 21 | 16.30 | NA | 14.80 | 13.50 | 11.40 | 18.80 | 16.40 | 12.60 |
| 22 | 91.60 | 62.40 | 81.50 | 65.60 | 64.50 | 61.80 | 85.80 | 71.10 |
| 23 | 0.97 | 0.90 | 0.85 | 0.85 | 0.76 | 0.91 | 1.33 | 0.85 |
| 24 | 36.80 | 32.00 | 30.80 | 34.80 | 34.40 | 31.50 | 51.70 | 37.70 |
| 25 | 4.39 | 5.81 | 4.53 | 4.80 | 5.19 | 3.67 | 6.41 | 5.75 |
| 26 | 11.40 | 10.60 | 8.30 | 11.20 | 14.80 | 7.60 | 17.50 | 16.60 |
| 27 | 0.44 | 0.61 | 0.27 | 0.46 | 0.52 | 0.35 | 1.10 | 1.18 |
| 28 | 0.92 | 1.26 | 1.04 | 2.03 | 1.97 | 1.67 | 0.87 | 0.84 |
| 29 | 6.53 | 7.60 | 9.59 | 4.29 | 5.83 | 3.69 | 8.53 | 8.04 |
| 30 | 0.71 | 0.75 | 0.87 | 0.59 | 0.58 | 0.48 | 0.73 | 0.83 |
| 31 | 11.00 | 10.50 | 13.40 | 7.70 | 9.60 | 8.30 | 13.10 | 11.30 |
| 32 | 11.70 | 20.30 | 15.10 | 15.20 | 20.20 | 16.00 | 14.40 | 23.10 |
| 33 | 0.62 | 2.16 | 1.52 | 2.06 | 0.72 | 1.15 | 0.87 | 0.60 |
| 34 | 0.50 | 3.75 | 0.25 | 6.00 | 4.75 | 9.50 | 1.75 | 1.50 |
| 35 | 24.20 | 36.00 | 25.20 | 35.20 | 19.50 | 65.00 | 28.50 | 26.50 |
| 36 | NA | NA | NA | 67.40 | NA | 38.20 | NA | 76.40 |
| 37 | 12.80 | 15.60 | 15.40 | 20.70 | 16.50 | 13.90 | 19.20 | 30.40 |
| 38 | 33.00 | 122.70 | 60.40 | 105.00 | 40.20 | 61.10 | 50.40 | 33.10 |
| 39 | 27.10 | 19.40 | 17.60 | 24.70 | 17.90 | 46.10 | 18.50 | 38.30 |
| 40 | 33.10 | 24.70 | 29.70 | 33.90 | 16.80 | 31.60 | 27.50 | 20.90 |
| 41 | 94.40 | 151.20 | 145.90 | 117.60 | 154.20 | 69.60 | 142.30 | 123.70 |
| 42 | 342.40 | 243.20 | 284.40 | 457.20 | 493.70 | 196.70 | 457.70 | 430.60 |
| 43 | 6.31 | 4.73 | 8.70 | 8.29 | 9.28 | 4.53 | 8.40 | 9.20 |
| 44 | NA | NA | NA | 3.45 | NA | 0.50 | NA | 0.17 |
| 45 | 3635.20 | 1588.70 | 1958.30 | 3879.60 | 3207.60 | 2875.20 | 3218.20 | 3485.80 |
| 46 | 3.32 | 3.32 | 3.92 | 4.68 | 3.94 | 2.81 | 4.46 | 3.93 |
| 47 | 2.64 | 2.22 | 3.94 | 2.35 | 4.13 | 1.02 | 3.66 | 0.63 |
| 48 | 90.50 | 64.20 | 70.20 | 111.30 | 67.70 | 128.60 | 81.00 | 151.80 |
| 49 | 87.60 | 51.90 | 117.20 | 79.00 | 68.90 | 29.40 | 92.60 | 9.20 |

Table 144. Provided are the values of each of the parameters (as described above) measured in Bean accessions (Line). Growth conditions are specified in the experimental procedure section.

TABLE 145

Measured parameters in bean varieties (lines 9-16)

| Line/Corr. ID | Line-9 | Line-10 | Line-11 | Line-12 | Line-13 | Line-14 | Line-15 | Line-16 |
|---|---|---|---|---|---|---|---|---|
| 1 | 82.40 | 70.00 | 84.90 | 70.80 | 78.10 | 84.30 | NA | NA |
| 2 | 76.90 | 76.70 | 85.90 | 82.10 | 77.80 | 73.80 | 76.40 | 71.70 |
| 3 | 69.40 | 68.80 | 53.70 | 64.00 | 71.80 | 46.90 | 51.90 | 61.00 |
| 4 | 43.60 | NA | 40.80 | 41.60 | 44.50 | 39.40 | NA | NA |
| 5 | 30.40 | 38.60 | 37.50 | 36.30 | 35.10 | 35.80 | 35.00 | 35.70 |
| 6 | 6.20 | 4.58 | 6.34 | 6.79 | 6.48 | 6.29 | 6.60 | 5.85 |
| 7 | 4.20 | 2.58 | 4.66 | 3.69 | 3.40 | 4.95 | NA | NA |
| 8 | 4.26 | 2.88 | 2.22 | 2.99 | 2.84 | 1.58 | 1.74 | 2.73 |
| 9 | 161.60 | 193.30 | 145.60 | 204.90 | 194.50 | 157.50 | 155.00 | 194.40 |
| 10 | 1.46 | 1.40 | 1.55 | 1.51 | 1.45 | 1.53 | 1.52 | 1.58 |
| 11 | 12.20 | 12.20 | 12.10 | 12.20 | 12.30 | 12.00 | 12.30 | 14.00 |
| 12 | 3.21 | 4.47 | 4.00 | 4.20 | 4.73 | 5.00 | 5.42 | 4.11 |
| 13 | 8.33 | 8.72 | 7.83 | 8.10 | 8.51 | 7.85 | 8.13 | 8.84 |
| 14 | 218.90 | 205.60 | 187.80 | 243.00 | 169.30 | 257.80 | 238.20 | 208.40 |

TABLE 145-continued

Measured parameters in bean varieties (lines 9-16)

| Line/Corr. ID | Line-9 | Line-10 | Line-11 | Line-12 | Line-13 | Line-14 | Line-15 | Line-16 |
|---|---|---|---|---|---|---|---|---|
| 15 | 5.69 | 5.99 | 5.67 | 5.50 | 5.26 | 4.91 | 6.00 | 6.04 |
| 16 | 15.80 | 31.40 | 26.40 | 24.70 | 20.10 | 14.40 | 18.00 | 22.60 |
| 17 | 9.34 | 10.13 | 8.74 | 8.66 | 9.26 | 5.42 | 7.40 | 13.47 |
| 18 | 0.38 | 0.45 | 0.33 | 0.39 | 0.35 | 0.21 | 0.35 | 0.48 |
| 19 | 7.60 | 7.60 | 5.73 | 6.47 | 6.87 | 9.67 | 7.53 | 7.58 |
| 20 | 4.80 | 6.50 | 4.90 | 4.80 | 5.70 | 5.10 | 5.70 | 6.75 |
| 21 | 13.70 | NA | 18.30 | 14.80 | 14.50 | 17.00 | 10.00 | 7.10 |
| 22 | 74.90 | 57.60 | 87.50 | 74.50 | 68.20 | 77.50 | 56.80 | 70.00 |
| 23 | 1.12 | 0.84 | 0.83 | 0.87 | 0.94 | 0.72 | 1.06 | 0.83 |
| 24 | 43.70 | 34.60 | 32.90 | 38.30 | 37.60 | 28.90 | 39.80 | 33.00 |
| 25 | 6.25 | 7.10 | 5.16 | 5.95 | 5.94 | 3.92 | 4.50 | 5.85 |
| 26 | 14.10 | 14.40 | 10.40 | 13.20 | 12.10 | 8.40 | 9.70 | 11.20 |
| 27 | 0.51 | 0.51 | 0.63 | 0.52 | 0.54 | 0.38 | 0.39 | 1.16 |
| 28 | 0.95 | 1.31 | 2.16 | 1.46 | 1.04 | 1.35 | NA | NA |
| 29 | 6.95 | 6.62 | 8.59 | 7.34 | 7.29 | 5.73 | 5.70 | 10.09 |
| 30 | 0.72 | 0.63 | 0.84 | 0.73 | 0.78 | 0.62 | 0.68 | 0.87 |
| 31 | 10.10 | 10.00 | 11.60 | 10.70 | 10.50 | 11.00 | 9.10 | 11.80 |
| 32 | 14.90 | 17.80 | 13.50 | 11.90 | 14.50 | 17.10 | 15.10 | 20.40 |
| 33 | 1.57 | 0.00 | 1.22 | 1.68 | 1.76 | 0.80 | 1.27 | 1.79 |
| 34 | 6.00 | 6.00 | 1.50 | 1.75 | 4.50 | 1.00 | 5.00 | 3.50 |
| 35 | 39.20 | 33.20 | 31.00 | 28.20 | 35.20 | 38.80 | 35.50 | 28.00 |
| 36 | NA | NA | NA | NA | NA | 49.40 | 43.70 | 71.50 |
| 37 | 19.10 | 29.80 | 24.10 | 15.10 | 13.10 | 15.30 | 10.80 | 26.00 |
| 38 | 92.90 | 3.30 | 66.40 | 97.90 | 105.60 | 41.20 | 81.80 | 67.20 |
| 39 | 22.50 | 24.50 | 22.30 | 18.40 | 15.80 | 38.30 | 18.90 | 24.20 |
| 40 | 22.30 | 19.30 | 22.90 | 24.90 | 25.00 | 46.00 | 24.30 | 18.00 |
| 41 | 149.20 | 191.90 | 124.60 | 151.50 | 149.50 | 66.30 | 93.70 | 148.00 |
| 42 | 528.80 | 449.30 | 403.10 | 381.90 | 521.60 | 198.10 | 371.10 | 260.00 |
| 43 | 9.46 | 10.86 | 8.19 | 6.86 | 8.72 | 4.02 | 6.55 | 6.99 |
| 44 | NA | NA | NA | NA | NA | 2.88 | 0.39 | 0.86 |
| 45 | 3534.00 | 2342.20 | 3232.80 | 2522.40 | 3492.60 | 3012.20 | 3953.80 | 1768.20 |
| 46 | 3.54 | 3.85 | 5.33 | 4.00 | 3.91 | 3.09 | 3.77 | 3.78 |
| 47 | 3.58 | 1.45 | 4.82 | 3.54 | 3.50 | 1.61 | 0.81 | 0.74 |
| 48 | 77.40 | 95.90 | 120.80 | 72.50 | 60.40 | 138.20 | 70.50 | 92.20 |
| 49 | 79.80 | 29.20 | 96.70 | 88.40 | 87.90 | 77.90 | 20.00 | 14.00 |

Table 145. Provided are the values of each of the parameters (as described above) measured in Bean accessions (Line). Growth conditions are specified in the experimental procedure section.

TABLE 146

Measured parameters in bean varieties (lines 17-24)

| Line/Corr. ID | Line-17 | Line-18 | Line-19 | Line-20 | Line-21 | Line-22 | Line-23 | Line-24 |
|---|---|---|---|---|---|---|---|---|
| 1 | 85.40 | NA | 73.90 | 74.30 | 73.40 | 66.50 | 84.40 | 87.00 |
| 2 | 88.80 | 91.50 | 91.60 | 82.00 | 91.80 | 72.90 | 83.10 | 93.00 |
| 3 | 68.90 | 82.90 | 59.80 | 55.80 | 76.90 | 65.30 | 64.10 | 73.50 |
| 4 | 35.20 | NA | NA | 41.70 | 42.10 | 43.00 | 42.30 | 31.10 |
| 5 | 32.50 | 34.70 | 35.80 | 32.80 | 37.20 | 35.10 | 34.20 | 31.90 |
| 6 | 6.51 | 6.70 | 6.74 | 5.91 | 5.56 | 6.77 | 7.02 | 8.15 |
| 7 | 4.89 | NA | 3.73 | 3.69 | 3.58 | 2.88 | 5.16 | 4.49 |
| 8 | 3.82 | 5.59 | 2.25 | 2.40 | 4.79 | 3.34 | 3.63 | 3.43 |
| 9 | 211.60 | 529.10 | 192.00 | 206.40 | 305.90 | 273.50 | 180.70 | 197.20 |
| 10 | 1.49 | 1.35 | 1.63 | 1.53 | 1.45 | 1.58 | 1.70 | 1.57 |
| 11 | 12.60 | 10.70 | 12.60 | 12.30 | 11.10 | 12.00 | 12.80 | 14.00 |
| 12 | 4.40 | 8.33 | 5.87 | 4.83 | 4.27 | 6.13 | 4.13 | 3.80 |
| 13 | 8.47 | 7.92 | 7.78 | 8.04 | 7.69 | 7.61 | 7.52 | 8.93 |
| 14 | 216.30 | 246.70 | 248.20 | 192.00 | 200.60 | 237.70 | 220.60 | 223.70 |
| 15 | 5.39 | 5.98 | 5.29 | 5.24 | 6.13 | 5.54 | 5.54 | 5.76 |
| 16 | 23.50 | 26.60 | 15.60 | 33.60 | 35.10 | 31.00 | 18.70 | 32.50 |
| 17 | 8.30 | 11.98 | 8.02 | 10.31 | 13.50 | 9.34 | 6.97 | 10.69 |
| 18 | 0.39 | 0.93 | 0.24 | 0.34 | 0.59 | 0.38 | 0.36 | 0.51 |
| 19 | 8.87 | 5.73 | 9.20 | 6.87 | 7.60 | 8.87 | 9.00 | 7.53 |
| 20 | 4.20 | 7.40 | 5.50 | 4.62 | 3.89 | 6.00 | 6.00 | 5.00 |
| 21 | 8.30 | 9.80 | 12.30 | 11.50 | 17.90 | 13.70 | NA | 18.30 |
| 22 | 60.40 | 68.00 | 47.70 | 76.10 | 79.70 | 70.80 | 70.90 | 108.70 |
| 23 | 0.83 | 0.90 | 0.81 | 1.00 | 1.06 | 1.07 | 1.18 | 0.71 |
| 24 | 32.30 | 39.70 | 30.40 | 38.70 | 43.10 | 41.30 | 44.60 | 30.00 |
| 25 | 4.28 | 9.29 | 4.67 | 5.55 | 7.06 | 6.16 | 5.54 | 7.22 |
| 26 | 10.50 | 25.30 | 11.20 | 12.70 | 18.30 | 15.30 | 11.70 | 13.30 |
| 27 | 0.41 | 0.65 | 0.45 | 0.65 | 0.85 | 0.58 | 0.35 | 0.73 |
| 28 | 1.22 | 1.37 | 1.52 | NA | 0.54 | 1.39 | 0.84 | 0.87 |

TABLE 146-continued

Measured parameters in bean varieties (lines 17-24)

| Line/Corr. ID | Line-17 | Line-18 | Line-19 | Line-20 | Line-21 | Line-22 | Line-23 | Line-24 |
|---|---|---|---|---|---|---|---|---|
| 29 | 7.45 | 9.97 | 4.15 | 6.94 | 6.86 | 6.87 | 7.37 | 11.11 |
| 30 | 0.73 | 1.02 | 0.47 | 0.70 | 0.68 | 0.70 | 0.72 | 0.96 |
| 31 | 11.00 | 10.50 | 9.10 | 10.10 | 10.00 | 11.40 | 11.40 | 13.40 |
| 32 | 16.40 | 16.40 | 19.50 | 21.20 | 18.00 | 18.90 | 15.90 | 21.30 |
| 33 | 1.57 | 0.87 | 0.00 | 2.40 | 2.68 | 0.73 | 1.23 | 0.84 |
| 34 | 3.00 | 1.50 | 8.75 | 5.00 | 7.00 | 0.50 | 1.75 | 0.50 |
| 35 | 26.20 | 19.00 | 49.80 | 31.00 | 37.80 | 22.20 | 23.20 | 24.20 |
| 36 | NA | NA | NA | 110.00 | NA | 49.90 | 49.10 | NA |
| 37 | 23.60 | 29.90 | 21.90 | 32.00 | 27.10 | 23.50 | 18.90 | 35.40 |
| 38 | 73.40 | 54.00 | 3.00 | 85.80 | 144.80 | 43.00 | 82.60 | 38.90 |
| 39 | 24.40 | 13.80 | 44.10 | 25.70 | 23.40 | 33.90 | 30.00 | 25.50 |
| 40 | 23.70 | 13.80 | 30.30 | 31.70 | 26.60 | 27.30 | 22.20 | 24.80 |
| 41 | 144.60 | 380.80 | 72.80 | 186.30 | 185.60 | 107.40 | 121.30 | 205.40 |
| 42 | 550.80 | 595.40 | 431.50 | 568.40 | 526.20 | 533.60 | 482.20 | 456.90 |
| 43 | 9.63 | 10.35 | 7.92 | 12.65 | 11.08 | 9.62 | 9.05 | 12.66 |
| 44 | NA | NA | NA | 2.76 | NA | 2.30 | 1.53 | NA |
| 45 | 3804.20 | 1569.60 | 5946.60 | 3054.60 | 3368.60 | 4920.20 | 3978.60 | 2220.60 |
| 46 | 4.33 | 3.26 | 3.87 | 3.75 | 4.05 | 3.78 | 3.66 | 4.16 |
| 47 | 0.68 | 2.63 | 1.58 | 1.72 | 3.15 | 3.15 | 2.52 | 2.45 |
| 48 | 108.60 | 45.90 | 168.40 | 101.10 | 94.30 | 128.80 | 98.50 | 107.70 |
| 49 | 18.50 | 34.70 | 50.10 | 71.10 | 79.60 | 84.60 | 58.50 | 75.20 |

Table 146. Provided are the values of each of the parameters (as described above) measured in Bean accessions (Line). Growth conditions are specified in the experimental procedure section.

TABLE 147

Measured parameters in bean varieties (lines 25-32)

| Line/Corr. ID | Line-25 | Line-26 | Line-27 | Line-28 | Line-29 | Line-30 | Line-31 | Line-32 |
|---|---|---|---|---|---|---|---|---|
| 1 | 78.40 | NA | NA | 83.90 | NA | NA | NA | 83.40 |
| 2 | 62.50 | 80.30 | 86.60 | 82.50 | 80.60 | 85.00 | 83.40 | 84.20 |
| 3 | 34.50 | 53.00 | 90.00 | 62.30 | 77.30 | 70.90 | 63.40 | 61.30 |
| 4 | 40.00 | NA | NA | 34.00 | NA | NA | NA | 37.80 |
| 5 | 35.60 | 35.00 | 34.50 | 30.80 | 41.00 | 35.60 | 38.40 | 37.00 |
| 6 | 4.86 | 6.67 | 7.40 | 6.21 | 5.81 | 6.62 | 6.42 | 8.40 |
| 7 | 3.58 | NA | NA | 4.78 | NA | NA | NA | 4.67 |
| 8 | 1.27 | 2.60 | 6.30 | 3.50 | 4.11 | 4.15 | 3.07 | 2.66 |
| 9 | 175.30 | 216.50 | 324.10 | 175.80 | 296.70 | 394.10 | 242.20 | 200.60 |
| 10 | 1.61 | 1.49 | 1.58 | 1.67 | 1.62 | 1.69 | 1.59 | 1.59 |
| 11 | 12.80 | 12.60 | 12.20 | 10.40 | 12.70 | 12.50 | 11.20 | 13.10 |
| 12 | 4.44 | 4.53 | 7.17 | 7.00 | 5.78 | 7.22 | 6.19 | 5.13 |
| 13 | 7.95 | 8.50 | 7.73 | 6.26 | 7.91 | 7.36 | 7.05 | 8.23 |
| 14 | 199.90 | 211.00 | 250.40 | 236.90 | 211.70 | 257.50 | 203.50 | 211.40 |
| 15 | 6.69 | 6.01 | 6.05 | 5.09 | 5.14 | 5.71 | 5.65 | 6.28 |
| 16 | 29.30 | 25.70 | 21.90 | 21.80 | 38.30 | 39.70 | 17.00 | 18.80 |
| 17 | 10.57 | 9.51 | 11.21 | 6.31 | 11.87 | 10.37 | 11.99 | 10.57 |
| 18 | 0.45 | 0.47 | 0.54 | 0.21 | 0.58 | 0.68 | 0.48 | 0.36 |
| 19 | 5.22 | 7.93 | 6.94 | 8.27 | 6.25 | 7.89 | 6.53 | 8.20 |
| 20 | 4.33 | 4.40 | 6.92 | 7.60 | 5.38 | 9.00 | 6.40 | 8.40 |
| 21 | 17.50 | 7.70 | 8.80 | 11.70 | 13.20 | 15.20 | 12.90 | 18.50 |
| 22 | 105.60 | 57.20 | 66.80 | 61.80 | 75.60 | 82.70 | 69.10 | 86.80 |
| 23 | 0.78 | 1.05 | 1.30 | 0.94 | 1.03 | 1.04 | 0.98 | 0.88 |
| 24 | 29.40 | 41.60 | 53.20 | 34.70 | 41.50 | 44.40 | 37.50 | 35.70 |
| 25 | 4.83 | 4.95 | 6.16 | 4.33 | 6.06 | 7.28 | 6.53 | 4.61 |
| 26 | 9.40 | 16.20 | 23.20 | 7.80 | 17.00 | 21.00 | 19.10 | 10.50 |
| 27 | NA | 0.44 | 0.69 | 0.39 | 0.66 | NA | 0.64 | 0.54 |
| 28 | 0.97 | 1.56 | 1.65 | 0.93 | 1.28 | NA | NA | 0.37 |
| 29 | 7.07 | 8.68 | 7.53 | 5.68 | 7.05 | 13.18 | 7.89 | 6.26 |
| 30 | 0.76 | 0.80 | 0.74 | 0.66 | 0.72 | 1.26 | 0.73 | 0.69 |
| 31 | 10.00 | 11.90 | 11.70 | 8.80 | 9.70 | 11.40 | 12.20 | 10.50 |
| 32 | 21.70 | 19.00 | 17.90 | 11.80 | 17.90 | 19.40 | 17.00 | 11.20 |
| 33 | 2.32 | 1.06 | 1.47 | 1.40 | 0.00 | 1.99 | 0.90 | 0.61 |
| 34 | 3.50 | 0.75 | 2.00 | 6.25 | 6.75 | 0.25 | 2.25 | 0.83 |
| 35 | 43.50 | 19.80 | 28.20 | 32.00 | 29.20 | 21.80 | 32.80 | 34.20 |
| 36 | 82.60 | NA | 76.20 | NA | 44.80 | NA | NA | 61.70 |
| 37 | 26.10 | 21.50 | 13.00 | 18.20 | 25.10 | 19.20 | 18.90 | 9.80 |
| 38 | 109.60 | 71.70 | 91.00 | 85.30 | 4.50 | 69.80 | 62.20 | 36.40 |
| 39 | 38.60 | 23.70 | 22.10 | 25.20 | 17.00 | 11.60 | 24.10 | 23.50 |
| 40 | 30.70 | 18.60 | 23.20 | 25.30 | 19.30 | 17.10 | 24.90 | 32.40 |
| 41 | 154.50 | 158.50 | 120.70 | 96.80 | 207.70 | 307.20 | 116.10 | 94.60 |
| 42 | 243.60 | 611.10 | 290.80 | 426.60 | 701.10 | 487.70 | 501.10 | 102.60 |

TABLE 147-continued

Measured parameters in bean varieties (lines 25-32)

| Line/Corr. ID | Line-25 | Line-26 | Line-27 | Line-28 | Line-29 | Line-30 | Line-31 | Line-32 |
|---|---|---|---|---|---|---|---|---|
| 43 | 7.97 | 10.63 | 5.42 | 7.37 | 11.01 | 12.46 | 8.24 | 1.94 |
| 44 | 6.16 | NA | 1.01 | NA | 3.36 | NA | NA | 3.74 |
| 45 | 1317.00 | 3861.60 | 2416.50 | 4403.00 | 3368.50 | 1595.00 | 4356.20 | 1164.40 |
| 46 | 2.32 | 3.95 | 3.08 | 4.79 | 4.35 | 4.10 | 4.27 | 3.02 |
| 47 | 3.07 | 1.78 | 0.35 | 3.65 | 2.88 | 3.44 | 4.93 | 2.48 |
| 48 | 85.40 | 90.10 | 65.10 | 118.10 | 73.10 | 46.30 | 103.20 | 70.30 |
| 49 | 94.70 | 33.50 | 12.50 | 91.10 | 54.50 | 56.80 | 97.10 | 81.40 |

Table 147. Provided are the values of each of the parameters (as described above) measured in Bean accessions (Line). Growth conditions are specified in the experimental procedure section.

TABLE 148

Measured parameters in bean varieties (lines 33-40)

| Line/Corr. ID | Line-33 | Line-34 | Line-35 | Line-36 | Line-37 | Line-38 | Line-39 | Line-40 |
|---|---|---|---|---|---|---|---|---|
| 1 | NA | NA | 88.30 | 79.60 | NA | 75.10 | 86.50 | 83.60 |
| 2 | 73.10 | 86.20 | 85.40 | 71.40 | 87.70 | 68.10 | 78.60 | 83.70 |
| 3 | 38.20 | 80.10 | 69.50 | 40.30 | 77.00 | 26.20 | 52.90 | 83.10 |
| 4 | NA | NA | 37.30 | 31.10 | NA | 34.70 | 32.20 | 39.60 |
| 5 | 34.20 | 31.80 | 33.70 | 26.10 | 34.10 | 29.30 | 32.20 | 37.90 |
| 6 | 5.11 | 7.14 | 7.54 | 4.66 | 5.71 | 4.56 | 6.59 | 6.65 |
| 7 | NA | NA | 5.54 | 4.20 | NA | 4.00 | 4.92 | 4.87 |
| 8 | 1.14 | 4.89 | 4.29 | 1.28 | 4.73 | 0.76 | 2.32 | 5.49 |
| 9 | 174.00 | 442.20 | 197.30 | 146.90 | 210.40 | 61.70 | 288.80 | 463.80 |
| 10 | 1.66 | 1.56 | 1.41 | 1.59 | 1.59 | 1.48 | 1.54 | 1.43 |
| 11 | 11.80 | 13.40 | 11.50 | 11.60 | 13.40 | 12.90 | 12.50 | 11.60 |
| 12 | 4.53 | 7.87 | 5.83 | 5.11 | 5.47 | 3.64 | 6.72 | 7.80 |
| 13 | 7.10 | 8.56 | 8.12 | 7.33 | 8.47 | 8.68 | 8.12 | 8.13 |
| 14 | 255.60 | 271.10 | 234.40 | 228.00 | 266.50 | 251.60 | 239.50 | 223.10 |
| 15 | 5.55 | 5.18 | 5.94 | 5.64 | 5.00 | 4.63 | 7.15 | 6.32 |
| 16 | 14.80 | 30.40 | 17.90 | 18.50 | 27.10 | 15.10 | 42.90 | 33.70 |
| 17 | 7.35 | 8.81 | 8.99 | 7.44 | 10.39 | 5.21 | 11.57 | 14.47 |
| 18 | 0.20 | 0.88 | 0.34 | 0.30 | 0.53 | 0.21 | 0.52 | 0.77 |
| 19 | 6.93 | 6.67 | 7.40 | 8.67 | 6.67 | 10.67 | 6.60 | 7.33 |
| 20 | 6.20 | 5.00 | 6.20 | 6.00 | 5.60 | 4.60 | 6.83 | 6.50 |
| 21 | 10.80 | 14.30 | 11.90 | 17.40 | NA | 14.30 | 27.60 | 14.80 |
| 22 | 52.80 | 71.50 | 80.20 | 116.90 | 59.80 | 71.50 | 156.70 | 80.60 |
| 23 | 0.79 | 0.94 | 0.98 | 0.96 | 1.03 | 0.71 | 1.02 | 1.59 |
| 24 | 29.50 | 45.00 | 36.70 | 34.90 | 39.60 | 26.20 | 40.50 | 60.90 |
| 25 | 3.46 | 9.08 | 4.25 | 4.98 | 6.69 | 3.50 | 5.44 | 6.36 |
| 26 | 8.70 | 25.70 | 13.10 | 8.70 | 17.20 | 5.90 | 12.50 | 22.70 |
| 27 | 0.42 | 0.61 | 0.54 | 0.36 | 0.68 | 0.25 | 0.79 | 0.89 |
| 28 | 1.39 | NA | 1.58 | 1.43 | NA | 1.34 | 1.36 | 2.03 |
| 29 | 4.30 | 7.94 | 7.68 | 8.22 | 6.09 | 5.23 | 7.74 | 8.83 |
| 30 | 0.50 | 0.87 | 0.82 | 0.81 | 0.60 | 0.59 | 1.02 | 1.08 |
| 31 | 8.70 | 8.40 | 10.40 | 11.70 | 9.10 | 10.50 | 9.20 | 8.90 |
| 32 | 12.80 | 17.10 | 15.60 | 20.20 | 18.70 | 19.50 | 23.90 | 23.30 |
| 33 | 0.00 | 0.00 | 1.36 | 1.66 | 0.00 | 1.03 | 1.70 | 0.90 |
| 34 | 9.50 | 5.50 | 2.00 | 0.00 | 9.00 | 3.25 | 1.50 | 1.50 |
| 35 | 46.50 | 23.80 | 34.00 | 23.50 | 31.00 | 68.80 | 36.80 | 19.50 |
| 36 | 23.70 | NA | 54.00 | 89.20 | 60.90 | NA | NA | NA |
| 37 | 23.50 | 31.40 | 17.50 | 24.60 | 25.50 | 28.10 | 37.90 | 29.00 |
| 38 | 1.80 | 3.00 | 83.20 | 52.40 | 3.80 | 40.40 | 69.00 | 53.50 |
| 39 | 63.60 | 13.90 | 19.50 | 24.50 | 18.50 | 43.90 | 27.00 | 20.10 |
| 40 | 26.90 | 13.70 | 23.00 | 22.30 | 11.90 | 43.40 | 32.00 | 22.30 |
| 41 | 82.90 | 442.80 | 140.30 | 111.80 | 172.60 | 70.70 | 332.30 | 234.20 |
| 42 | 170.90 | 623.80 | 418.30 | 334.60 | 551.90 | 330.60 | 604.80 | 695.50 |
| 43 | 3.70 | 10.27 | 8.21 | 9.76 | 10.68 | 10.16 | 16.19 | 15.15 |
| 44 | 0.30 | NA | 1.68 | 1.54 | 1.01 | NA | NA | NA |
| 45 | 2036.80 | 1410.20 | 2980.60 | 2987.20 | 3196.80 | 4661.80 | 1823.80 | 3141.00 |
| 46 | 1.82 | 3.39 | 3.76 | 5.30 | 4.92 | 5.12 | 2.89 | 4.23 |
| 47 | 1.12 | 1.79 | 2.47 | 1.83 | 1.28 | 1.42 | 1.91 | 3.05 |
| 48 | 111.90 | 47.90 | 73.20 | 126.70 | 93.20 | 224.00 | 76.30 | 84.70 |
| 49 | 31.70 | 22.90 | 57.10 | 45.40 | 16.50 | 62.30 | 59.30 | 58.80 |

Table 148. Provided are the values of each of the parameters (as described above) measured in Bean accessions (Line). Growth conditions are specified in the experimental procedure section.

TABLE 149

Measured parameters in bean varieties ("fine" and "extra fine") (lines 1-8)

| Line/Corr. ID | Line-1 | Line-4 | Line-6 | Line-8 | Line-14 | Line-15 | Line-19 | Line-22 |
|---|---|---|---|---|---|---|---|---|
| 1 | 88.70 | 91.00 | 80.80 | 90.30 | 84.30 | NA | 73.90 | 66.50 |
| 2 | 89.60 | 78.90 | 72.30 | 90.50 | 73.80 | 76.40 | 91.60 | 72.90 |
| 3 | 70.50 | 58.60 | 39.00 | 83.60 | 46.90 | 51.90 | 59.80 | 65.30 |
| 4 | 40.20 | 36.20 | 37.70 | NA | 39.40 | NA | NA | 43.00 |
| 5 | 36.00 | 39.40 | 31.40 | 40.10 | 35.80 | 35.00 | 35.80 | 35.10 |
| 6 | 8.44 | 7.85 | 5.78 | 7.61 | 6.29 | 6.60 | 6.74 | 6.77 |
| 7 | 6.15 | 5.84 | 4.38 | 4.01 | 4.95 | NA | 3.73 | 2.88 |
| 8 | 3.27 | 3.06 | 1.33 | 5.01 | 1.58 | 1.74 | 2.25 | 3.34 |
| 9 | 211.70 | 307.10 | 133.10 | 308.10 | 157.50 | 155.00 | 192.00 | 273.50 |
| 10 | 1.64 | 1.32 | 1.58 | 1.56 | 1.53 | 1.52 | 1.63 | 1.58 |
| 11 | 13.30 | 11.60 | 11.10 | 13.10 | 12.00 | 12.30 | 12.60 | 12.00 |
| 12 | 4.73 | 6.07 | 4.73 | 6.17 | 5.00 | 5.42 | 5.87 | 6.13 |
| 13 | 8.16 | 8.83 | 7.03 | 8.42 | 7.85 | 8.13 | 7.78 | 7.61 |
| 14 | 226.30 | 222.30 | 213.00 | 207.30 | 257.80 | 238.20 | 248.20 | 237.70 |
| 15 | 5.79 | 5.84 | 5.39 | 5.83 | 4.91 | 6.00 | 5.29 | 5.54 |
| 16 | 16.20 | 18.70 | 19.30 | 27.80 | 14.40 | 18.00 | 15.60 | 31.00 |
| 17 | 7.33 | 8.28 | 6.37 | 11.85 | 5.42 | 7.40 | 8.02 | 9.34 |
| 18 | 0.30 | 0.33 | 0.24 | 0.44 | 0.21 | 0.35 | 0.24 | 0.38 |
| 19 | 7.93 | 6.20 | 7.93 | 7.00 | 9.67 | 7.53 | 9.20 | 8.87 |
| 20 | 4.90 | 4.90 | 5.80 | 6.60 | 5.10 | 5.70 | 5.50 | 6.00 |
| 21 | 16.30 | 13.50 | 18.80 | 12.60 | 17.00 | 10.00 | 12.30 | 13.70 |
| 22 | 91.60 | 65.60 | 61.80 | 71.10 | 77.50 | 56.80 | 47.70 | 70.80 |
| 23 | 0.97 | 0.85 | 0.91 | 0.85 | 0.72 | 1.06 | 0.81 | 1.07 |
| 24 | 36.80 | 34.80 | 31.50 | 37.70 | 28.90 | 39.80 | 30.40 | 41.30 |
| 25 | 4.39 | 4.80 | 3.67 | 5.75 | 3.92 | 4.50 | 4.67 | 6.16 |
| 26 | 11.40 | 11.20 | 7.60 | 16.60 | 8.40 | 9.70 | 11.20 | 15.30 |
| 27 | 0.44 | 0.46 | 0.35 | 1.18 | 0.38 | 0.39 | 0.45 | 0.58 |
| 28 | 0.92 | 2.03 | 1.67 | 0.84 | 1.35 | NA | 1.52 | 1.39 |
| 29 | 6.53 | 4.29 | 3.69 | 8.04 | 5.73 | 5.70 | 4.15 | 6.87 |
| 30 | 0.71 | 0.59 | 0.48 | 0.83 | 0.62 | 0.68 | 0.47 | 0.70 |
| 31 | 11.00 | 7.70 | 8.30 | 11.30 | 11.00 | 9.10 | 9.10 | 11.40 |
| 32 | 11.70 | 15.20 | 16.00 | 23.10 | 17.10 | 15.10 | 19.50 | 18.90 |
| 33 | 0.62 | 2.06 | 1.15 | 0.60 | 0.80 | 1.27 | 0.00 | 0.73 |
| 34 | 0.50 | 6.00 | 9.50 | 1.50 | 1.00 | 5.00 | 8.75 | 0.50 |
| 35 | 24.20 | 35.20 | 65.00 | 26.50 | 38.80 | 35.50 | 49.80 | 22.20 |
| 36 | NA | 67.40 | 38.20 | 76.40 | 49.40 | 43.70 | NA | 49.90 |
| 37 | 12.80 | 20.70 | 13.90 | 30.40 | 15.30 | 10.80 | 21.90 | 23.50 |
| 38 | 33.00 | 105.00 | 61.10 | 33.10 | 41.20 | 81.80 | 3.00 | 43.00 |
| 39 | 27.10 | 24.70 | 46.10 | 38.30 | 38.30 | 18.90 | 44.10 | 33.90 |
| 40 | 33.10 | 33.90 | 31.60 | 20.90 | 46.00 | 24.30 | 30.30 | 27.30 |
| 41 | 94.40 | 117.60 | 69.60 | 123.70 | 66.30 | 93.70 | 72.80 | 107.40 |
| 42 | 342.40 | 457.20 | 196.70 | 430.60 | 198.10 | 371.10 | 431.50 | 533.60 |
| 43 | 6.31 | 8.29 | 4.53 | 9.20 | 4.02 | 6.55 | 7.92 | 9.62 |
| 44 | NA | 3.45 | 0.50 | 0.17 | 2.88 | 0.39 | NA | 2.30 |
| 45 | 3635.2 | 3879.6 | 2875.2 | 3485.8 | 3012.2 | 3953.8 | 5946.6 | 4920.2 |
| 46 | 3.32 | 4.68 | 2.81 | 3.93 | 3.09 | 3.77 | 3.87 | 3.78 |
| 47 | 2.64 | 2.35 | 1.02 | 0.63 | 1.61 | 0.81 | 1.58 | 3.15 |
| 48 | 90.50 | 111.30 | 128.60 | 151.80 | 138.20 | 70.50 | 168.40 | 128.80 |
| 49 | 87.60 | 79.00 | 29.40 | 9.20 | 77.90 | 20.00 | 50.10 | 84.60 |

Table 149. Provided are the values of each of the parameters (as described above) measured in Bean accessions (Line). Growth conditions are specified in the experimental procedure section.

TABLE 150

Measured parameters in bean varieties ("fine" and "extra fine") (lines 9-16)

| Line/Corr. ID | Line-23 | Line-27 | Line-28 | Line-31 | Line-32 | Line-33 | Line-36 | Line-38 |
|---|---|---|---|---|---|---|---|---|
| 1 | 84.40 | NA | 83.90 | NA | 83.40 | NA | 79.60 | 75.10 |
| 2 | 83.10 | 86.60 | 82.50 | 83.40 | 84.20 | 73.10 | 71.40 | 68.10 |
| 3 | 64.10 | 90.00 | 62.30 | 63.40 | 61.30 | 38.20 | 40.30 | 26.20 |
| 4 | 42.30 | NA | 34.00 | NA | 37.80 | NA | 31.10 | 34.70 |
| 5 | 34.20 | 34.50 | 30.80 | 38.40 | 37.00 | 34.20 | 26.10 | 29.30 |
| 6 | 7.02 | 7.40 | 6.21 | 6.42 | 8.40 | 5.11 | 4.66 | 4.56 |
| 7 | 5.16 | NA | 4.78 | NA | 4.67 | NA | 4.20 | 4.00 |
| 8 | 3.63 | 6.30 | 3.50 | 3.07 | 2.66 | 1.14 | 1.28 | 0.76 |
| 9 | 180.70 | 324.10 | 175.80 | 242.20 | 200.60 | 174.00 | 146.90 | 61.70 |
| 10 | 1.70 | 1.58 | 1.67 | 1.59 | 1.59 | 1.66 | 1.59 | 1.48 |
| 11 | 12.80 | 12.20 | 10.40 | 11.20 | 13.10 | 11.80 | 11.60 | 12.90 |
| 12 | 4.13 | 7.17 | 7.00 | 6.19 | 5.13 | 4.53 | 5.11 | 3.64 |
| 13 | 7.52 | 7.73 | 6.26 | 7.05 | 8.23 | 7.10 | 7.33 | 8.68 |
| 14 | 220.60 | 250.40 | 236.90 | 203.50 | 211.40 | 255.60 | 228.00 | 251.60 |

TABLE 150-continued

Measured parameters in bean varieties ("fine" and "extra fine") (lines 9-16)

| Line/Corr. ID | Line-23 | Line-27 | Line-28 | Line-31 | Line-32 | Line-33 | Line-36 | Line-38 |
|---|---|---|---|---|---|---|---|---|
| 15 | 5.54 | 6.05 | 5.09 | 5.65 | 6.28 | 5.55 | 5.64 | 4.63 |
| 16 | 18.70 | 21.90 | 21.80 | 17.00 | 18.80 | 14.80 | 18.50 | 15.10 |
| 17 | 6.97 | 11.21 | 6.31 | 11.99 | 10.57 | 7.35 | 7.44 | 5.21 |
| 18 | 0.36 | 0.54 | 0.21 | 0.48 | 0.36 | 0.20 | 0.30 | 0.21 |
| 19 | 9.00 | 6.94 | 8.27 | 6.53 | 8.20 | 6.93 | 8.67 | 10.67 |
| 20 | 6.00 | 6.92 | 7.60 | 6.40 | 8.40 | 6.20 | 6.00 | 4.60 |
| 21 | NA | 8.80 | 11.70 | 12.90 | 18.50 | 10.80 | 17.40 | 14.30 |
| 22 | 70.90 | 66.80 | 61.80 | 69.10 | 86.80 | 52.80 | 116.90 | 71.50 |
| 23 | 1.18 | 1.30 | 0.94 | 0.98 | 0.88 | 0.79 | 0.96 | 0.71 |
| 24 | 44.60 | 53.20 | 34.70 | 37.50 | 35.70 | 29.50 | 34.90 | 26.20 |
| 25 | 5.54 | 6.16 | 4.33 | 6.53 | 4.61 | 3.46 | 4.98 | 3.50 |
| 26 | 11.70 | 23.20 | 7.80 | 19.10 | 10.50 | 8.70 | 8.70 | 5.90 |
| 27 | 0.35 | 0.69 | 0.39 | 0.64 | 0.54 | 0.42 | 0.36 | 0.25 |
| 28 | 0.84 | 1.65 | 0.93 | NA | 0.37 | 1.39 | 1.43 | 1.34 |
| 29 | 7.37 | 7.53 | 5.68 | 7.89 | 6.26 | 4.30 | 8.22 | 5.23 |
| 30 | 0.72 | 0.74 | 0.66 | 0.73 | 0.69 | 0.50 | 0.81 | 0.59 |
| 31 | 11.40 | 11.70 | 8.80 | 12.20 | 10.50 | 8.70 | 11.70 | 10.50 |
| 32 | 15.90 | 17.90 | 11.80 | 17.00 | 11.20 | 12.80 | 20.20 | 19.50 |
| 33 | 1.23 | 1.47 | 1.40 | 0.91 | 0.61 | 0.00 | 1.67 | 1.03 |
| 34 | 1.75 | 2.00 | 6.25 | 2.25 | 0.83 | 9.50 | 0.00 | 3.25 |
| 35 | 23.20 | 28.20 | 32.00 | 32.80 | 34.20 | 46.50 | 23.50 | 68.80 |
| 36 | 49.10 | 76.20 | NA | NA | 61.70 | 23.70 | 89.20 | NA |
| 37 | 18.90 | 13.00 | 18.20 | 18.90 | 9.80 | 23.50 | 24.60 | 28.10 |
| 38 | 82.60 | 91.00 | 85.30 | 62.20 | 36.40 | 1.80 | 52.40 | 40.40 |
| 39 | 30.00 | 22.10 | 25.20 | 24.10 | 23.50 | 63.60 | 24.50 | 43.90 |
| 40 | 22.20 | 23.20 | 25.30 | 24.90 | 32.40 | 26.90 | 22.30 | 43.40 |
| 41 | 121.30 | 120.70 | 96.80 | 116.10 | 94.60 | 82.90 | 111.80 | 70.70 |
| 42 | 482.20 | 290.80 | 426.60 | 501.10 | 102.60 | 170.90 | 334.60 | 330.60 |
| 43 | 9.05 | 5.42 | 7.37 | 8.24 | 1.94 | 3.70 | 9.76 | 10.16 |
| 44 | 1.53 | 1.01 | NA | NA | 3.74 | 0.30 | 1.54 | NA |
| 45 | 3978.6 | 2416.5 | 4403 | 4356.2 | 1164.4 | 2036.8 | 2987.2 | 4661.8 |
| 46 | 3.66 | 3.08 | 4.79 | 4.27 | 3.02 | 1.82 | 5.30 | 5.12 |
| 47 | 2.52 | 0.35 | 3.65 | 4.93 | 2.48 | 1.12 | 1.83 | 1.42 |
| 48 | 98.50 | 65.10 | 118.10 | 103.20 | 70.30 | 111.90 | 126.70 | 224.00 |
| 49 | 58.50 | 12.50 | 91.10 | 97.10 | 81.40 | 31.70 | 45.40 | 62.30 |

Table 150. Provided are the values of each of the parameters (as described above) measured in Bean accessions (Line). Growth conditions are specified in the experimental procedure section.

TABLE 151

Correlation between the expression level of selected genes of some embodiments of the invention in various tissues and the phenotypic performance under normal conditions across 40 bean varieties

| Gene Name | R | P value | Exp. set | Corr. ID | Gene Name | R | P value | Exp. set | Corr. ID |
|---|---|---|---|---|---|---|---|---|---|
| LBY264 | 0.77 | 8.02E−05 | 4 | 40 | LGD28 | 0.82 | 3.98E−03 | 2 | 4 |
| LBY412 | 0.71 | 5.09E−04 | 4 | 40 | LBY412 | 0.75 | 5.29E−04 | 2 | 27 |
| LYD956 | 0.75 | 1.59E−04 | 9 | 19 | LYD956 | 0.76 | 1.06E−04 | 9 | 48 |
| LYD957 | 0.78 | 5.95E−05 | 9 | 35 | LYD956 | 0.71 | 9.52E−05 | 5 | 39 |
| LYD958 | 0.72 | 1.26E−02 | 3 | 44 | | | | | |

Table 151. Provided are the correlations (R) between the genes expression levels in various tissues [Expression (Exp) sets, Table 142] and the phenotypic performance [yield, biomass, and plant architecture (as described in Table 144-148 using the (Correlation vectors (Corr.) described in Table 143] under normal conditions across bean varieties. P = p value.

TABLE 152

Correlation between the expression level of selected genes of some embodiments of the invention in various tissues and the phenotypic performance under normal conditions across 16 bean varieties ("fine" and "extra fine")

| Gene Name | R | P value | Exp. set | Corr. ID | Gene Name | R | P value | Exp. set | Corr. ID |
|---|---|---|---|---|---|---|---|---|---|
| LBY264 | 0.72 | 1.28E−02 | 5 | 8 | LBY264 | 0.78 | 4.30E−03 | 5 | 24 |
| LBY264 | 0.81 | 2.64E−03 | 5 | 26 | LBY264 | 0.76 | 6.82E−03 | 5 | 18 |
| LBY264 | 0.81 | 4.27E−03 | 7 | 35 | LBY264 | 0.80 | 5.79E−03 | 7 | 40 |
| LBY264 | 0.84 | 5.71E−04 | 4 | 40 | LBY264 | 0.81 | 2.32E−03 | 2 | 40 |

TABLE 152-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. ID | Gene Name | R | P value | Exp. set | Corr. ID |
|---|---|---|---|---|---|---|---|---|---|
| LBY264 | 0.75 | 7.75E−03 | 3 | 49 | LBY264 | 0.86 | 2.71E−02 | 6 | 4 |
| LBY264 | 0.71 | 9.03E−03 | 9 | 49 | LBY264 | 0.78 | 4.22E−03 | 9 | 44 |
| LBY410 | 0.74 | 8.77E−03 | 2 | 3 | LBY410 | 0.72 | 1.28E−02 | 2 | 17 |
| LBY410 | 0.83 | 3.00E−03 | 7 | 19 | LBY410 | 0.90 | 1.95E−04 | 3 | 27 |
| LBY410 | 0.75 | 8.29E−03 | 2 | 25 | LBY410 | 0.73 | 1.06E−02 | 2 | 9 |
| LBY410 | 0.73 | 1.13E−02 | 2 | 27 | LBY410 | 0.73 | 1.08E−02 | 2 | 8 |
| LBY410 | 0.70 | 1.12E−02 | 6 | 37 | LBY412 | 0.77 | 3.55E−03 | 4 | 40 |
| LBY412 | 0.74 | 9.91E−03 | 2 | 2 | LBY412 | 0.75 | 7.66E−03 | 2 | 26 |
| LBY412 | 0.78 | 4.89E−03 | 2 | 3 | LBY412 | 0.71 | 1.51E−02 | 2 | 17 |
| LBY412 | 0.73 | 1.01E−02 | 2 | 27 | LBY412 | 0.73 | 1.03E−02 | 2 | 12 |
| LBY412 | 0.73 | 1.09E−02 | 8 | 36 | LBY412 | 0.70 | 2.31E−02 | 7 | 15 |
| LBY412 | 0.76 | 7.05E−03 | 3 | 39 | LGD28 | 0.73 | 1.05E−02 | 2 | 5 |
| LGD28 | 0.77 | 5.10E−03 | 2 | 3 | LGD28 | 0.71 | 1.04E−02 | 9 | 23 |
| LGD28 | 0.96 | 6.56E−04 | 7 | 4 | LGD28 | 0.74 | 1.50E−02 | 7 | 16 |
| LGD28 | 0.83 | 1.62E−03 | 2 | 8 | LGD28 | 0.75 | 1.99E−02 | 2 | 1 |
| LGD28 | 0.73 | 7.50E−03 | 9 | 24 | LGD28 | 0.71 | 2.07E−02 | 7 | 18 |
| LGD28 | 0.75 | 1.24E−02 | 7 | 24 | LGD28 | 0.85 | 9.76E−04 | 3 | 27 |
| LGD28 | 0.73 | 1.08E−02 | 2 | 26 | LGD28 | 0.83 | 2.11E−02 | 2 | 4 |
| LGD28 | 0.78 | 2.87E−03 | 6 | 32 | LYD956 | 0.74 | 5.68E−03 | 4 | 27 |
| LYD956 | 0.92 | 1.04E−02 | 5 | 4 | LYD956 | 0.74 | 8.58E−03 | 5 | 39 |
| LYD956 | 0.85 | 1.97E−03 | 7 | 10 | LYD956 | 0.72 | 4.34E−02 | 3 | 44 |
| LYD956 | 0.81 | 1.57E−03 | 9 | 19 | LYD956 | 0.75 | 5.18E−03 | 9 | 48 |
| LYD956 | 0.72 | 8.05E−03 | 6 | 32 | LYD956 | 0.74 | 6.35E−03 | 6 | 37 |
| LYD956 | 0.78 | 4.34E−03 | 2 | 40 | LYD956 | 0.74 | 9.20E−03 | 2 | 39 |
| LYD957 | 0.87 | 5.13E−04 | 2 | 8 | LYD957 | 0.89 | 2.10E−04 | 2 | 3 |
| LYD957 | 0.75 | 8.41E−03 | 2 | 9 | LYD957 | 0.87 | 4.92E−04 | 2 | 27 |
| LYD957 | 0.92 | 5.48E−05 | 2 | 17 | LYD957 | 0.78 | 2.56E−03 | 9 | 35 |
| LYD957 | 0.82 | 3.75E−03 | 7 | 19 | LYD957 | 0.80 | 3.23E−03 | 3 | 27 |
| LYD957 | 0.84 | 1.26E−03 | 2 | 26 | LYD957 | 0.80 | 2.98E−03 | 2 | 18 |
| LYD957 | 0.84 | 6.85E−04 | 9 | 34 | LYD957 | 0.81 | 4.92E−03 | 8 | 4 |
| LYD957 | 0.81 | 2.89E−02 | 6 | 44 | LYD958 | 0.71 | 3.06E−02 | 7 | 1 |
| LYD958 | 0.71 | 9.31E−03 | 6 | 23 | LYD958 | 0.75 | 3.37E−02 | 3 | 44 |
| LYD958 | 0.73 | 1.09E−02 | 3 | 49 | MGP63 | 0.74 | 9.40E−03 | 3 | 10 |
| MGP63 | 0.79 | 3.68E−03 | 2 | 29 | MGP63 | 0.74 | 9.43E−03 | 2 | 20 |
| MGP63 | 0.72 | 1.31E−02 | 2 | 31 | MGP63 | 0.72 | 1.33E−02 | 2 | 27 |
| MGP63 | 0.77 | 5.64E−03 | 2 | 30 | MGP63 | 0.78 | 8.30E−03 | 2 | 36 |

Table 152. Provided are the correlations (R) between the genes expression levels in various tissues [Expression (Exp) sets, Table 142] and the phenotypic performance [yield, biomass, and plant architecture (as described in Tables 149-150 using the (Correlation vectors (Corr.) described in Table 143 under normal conditions across bean varieties. P = p value.

Example 14

Production of B. juncea Transcriptome and High Throughput Correlation Analysis with Yield Parameters Using 60K B. juncea Oligonucleotide Micro-Arrays In order to produce a high throughput correlation analysis, the present inventors utilized a B. juncea oligonucleotide micro-array, produced by Agilent Technologies [chem. (dot) agilent (dot) com/Scripts/PDS (dot) asp?lPage=50879]. The array oligonucleotide represents about 60,000 B. juncea genes and transcripts. In order to define correlations between the levels of RNA expression with yield components or vigor related parameters, various plant characteristics of 11 different B. juncea varieties were analyzed and used for RNA expression analysis. The correlation between the RNA levels and the characterized parameters was analyzed using Pearson correlation test.

Correlation of B. juncea Genes' Expression Levels with Phenotypic Characteristics Across Ecotype

Experimental Procedures

11 B. juncea varieties were grown in three repetitive plots, in field. Briefly, the growing protocol was as follows: B. juncea seeds were sown in soil and grown under normal condition till harvest [field experiment, normal growth conditions which included irrigation 2-3 times a week with 861 m$^3$ water per dunam (1000 square meters) per entire growth period, and fertilization of 12 units of nitrogen given in the first month of the growth period]. In order to define correlations between the levels of RNA expression with yield components or vigor related parameters, the 11 different B. juncea varieties were analyzed and used for gene expression analyses.

TABLE 153

Tissues used for B. juncea transcriptome expression sets

| Description | Expression Set |
|---|---|
| Pod (R4-R5) under normal growth conditions | 1 |
| Meristem at vegetative stage under normal growth conditions | 2 |
| Leaf at vegetative stage under normal growth conditions | 3 |

Table 153: Provided are the identification (ID) digits of each of the B. juncea expression sets.

RNA extraction—All 11 selected B. juncea varieties were sample per each treatment. Plant tissues [leaf, pod and lateral meristem] growing under normal conditions were sampled and RNA was extracted as described above.

The collected data parameters were as follows:

Fresh weight (plot-harvest) [gr./plant]—total fresh weight per plot at harvest time normalized to the number of plants per plot.

Seed Weight [milligrams/plant]—total seeds from each plot was extracted, weighted and normalized for plant number in each plot.

Harvest index—The harvest index was calculated: seed weight/fresh weight.

Days till bolting/flowering—number of days till 50% bolting/flowering for each plot.

SPAD—Chlorophyll content was determined using a Minolta SPAD 502 chlorophyll meter and measurement was performed at time of flowering. SPAD meter readings were done on young fully developed leaf. Three measurements per leaf were taken for each plot.

Main branch—average node length—total length/total number of nods on main branch.

Lateral branch—average node length—total length/total number of nods on lateral branch.

Main branch—20th length—the length of the pod on the $20^{th}$ node from the apex of main branch.

Lateral branch—20th length—the length of the pod on the $20^{th}$ node from the apex of lateral branch.

Main branch—20th seed No.—number of seeds in the pod on the $20^{th}$ node from the apex of main branch.

Lateral branch—20th seed number—number of seeds in the pod on the $20^{th}$ node from the apex of lateral branch.

Number of lateral branches—total number of lateral branches, average of three plants per plot.

Main branch height [cm]—total length of main branch.

Min-lateral branch position—lowest node on the main branch that has developed lateral branch.

Max-lateral branch position [number of node of main branch]—highest node on the main branch that has developed lateral branch.

Max-number of nodes in lateral branch—the highest number of node that a lateral branch had per plant.

Max length of lateral branch [cm]—the highest length of lateral branch per plant.

Max diameter of lateral branch [mm]—the highest base diameter that a lateral branch had per plant.

Oil Content—Indirect oil content analysis was carried out using Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)];

Fresh weight (single plant) (gr./plant)—average fresh weight of three plants per plot taken at the middle of the season.

Main branch base diameter [mm]—the based diameter of main branch, average of three plants per plot.

1000 Seeds [gr.]—weight of 1000 seeds per plot.

Experimental Results

Eleven different B. juncea varieties were grown and characterized for 23 parameters as specified above and summarized in Table 154. The average for each of the measured parameters was calculated using the JMP software and values are summarized in Tables 155-156 below. Subsequent correlation analysis between the various transcriptome expression sets and the average parameters was conducted. Results were then integrated to the database (Table 157).

TABLE 154

Measured parameters in B. juncea accessions

| Correlated parameter with | Correlation ID |
|---|---|
| Days till bolting (days) | 1 |
| Fresh weight (plot-harvest) [gr./plant] | 2 |
| Seed weight per plant (gr.) | 3 |
| Harvest index (ratio) | 4 |
| Days till flowering (days) | 5 |
| SPAD | 6 |
| Main branch - average node length (cm) | 7 |
| Lateral branch - average node length (cm) | 8 |
| Main branch - 20th length (cm) | 9 |
| Lateral branch - 20th length (cm) | 10 |
| Main branch - 20th seed number (number) | 11 |
| Lateral branch - 20th seed number (number) | 12 |
| Number of lateral branches (number) | 13 |
| Main branch height [cm] | 14 |
| Min-Lateral branch position (#node of main branch) | 15 |
| Max-Lateral branch position [# node of main branch] | 16 |
| Max-Number of nodes in lateral branch (number) | 17 |
| Max-Length of lateral branch [cm] | 18 |
| Max-Diameter of lateral branch [mm] | 19 |
| Oil content (mg) | 20 |
| Fresh weight (single plant) [gr./plant] | 21 |
| Main branch base diameter [mm] | 22 |
| 1000 Seeds [gr.] | 23 |

Table 154. Provided are the B, juncea correlated parameters, "gr." = grams; mm = millimeters; "cm" = centimeters; "mg" = milligrams; "SPAD" = chlorophyll levels; "#" = number.

TABLE 155

Measured parameters in B. juncea accessions (lines 1-6)

| Line/Corr. ID | Line-1 | Line-2 | Line-3 | Line-4 | Line-5 | Line-6 |
|---|---|---|---|---|---|---|
| 1 | 57.30 | 60.30 | 59.70 | 56.30 | 55.00 | 46.70 |
| 2 | 69.20 | 45.20 | 39.30 | 49.10 | 44.00 | 46.40 |
| 3 | 0.0044 | 0.0057 | 0.0055 | 0.0069 | 0.0058 | 0.0063 |
| 4 | 0.0001 | 0.0001 | 0.0001 | 0.0001 | 0.0001 | 0.0001 |
| 5 | 66.00 | 69.70 | 69.30 | 66.00 | 61.30 | 53.00 |
| 6 | 33.00 | 30.00 | 32.80 | 37.50 | 41.40 | 35.40 |
| 7 | 0.48 | 0.41 | 0.63 | 0.43 | 0.38 | 0.68 |
| 8 | 0.65 | 0.43 | 0.74 | 0.57 | 0.56 | 0.79 |
| 9 | 4.28 | 3.72 | 3.62 | 3.50 | 2.74 | 5.20 |
| 10 | 4.32 | 3.69 | 4.14 | 3.37 | 3.06 | 3.96 |
| 11 | 13.20 | 13.70 | 10.40 | 14.10 | 9.80 | 15.20 |
| 12 | 13.00 | 14.00 | 13.20 | 13.40 | 11.00 | 13.10 |
| 13 | 15.20 | 14.90 | 13.60 | 14.90 | 14.00 | 9.80 |
| 14 | 140.70 | 125.20 | 112.40 | 133.40 | 142.00 | 101.50 |

TABLE 155-continued

Measured parameters in *B. juncea* accessions (lines 1-6)

| Line/Corr. ID | Line-1 | Line-2 | Line-3 | Line-4 | Line-5 | Line-6 |
|---|---|---|---|---|---|---|
| 15 | 6.78 | 6.33 | 5.56 | 3.67 | 3.00 | 3.11 |
| 16 | 15.20 | 14.90 | 13.60 | 14.90 | 14.00 | 10.90 |
| 17 | 5.22 | 7.00 | 5.22 | 7.00 | 6.56 | 9.44 |
| 18 | 40.40 | 47.20 | 41.60 | 60.50 | 59.80 | 59.40 |
| 19 | 4.20 | 4.85 | 4.34 | 5.74 | 5.87 | 5.68 |
| 20 | 40.20 | 40.70 | 40.90 | 38.60 | 40.10 | 42.60 |
| 21 | 197.80 | 142.20 | 147.20 | 243.30 | 192.30 | 163.80 |
| 22 | 14.50 | 12.00 | 19.90 | 14.30 | 12.60 | 12.30 |
| 23 | 3.76 | 2.21 | 3.26 | 2.36 | 2.00 | 3.12 |

Table 155. Provided are the values of each of the parameters (as described above) measured in *B. juncea* accessions (line number) under normal conditions.

TABLE 156

Measured parameters in *B. juncea* accessions (lines 7-11)

| Line/Corr. ID | Line-7 | Line-8 | Line-9 | Line-10 | Line-11 |
|---|---|---|---|---|---|
| 1 | 59.00 | 54.30 | 59.70 | 57.30 | 53.00 |
| 2 | 36.10 | 32.60 | 33.20 | 63.20 | 60.90 |
| 3 | 0.0046 | 0.0044 | 0.0045 | 0.0057 | 0.0071 |
| 4 | 0.0001 | 0.0001 | 0.0001 | 0.0001 | 0.0001 |
| 5 | 69.70 | 63.70 | 69.70 | 71.00 | 58.30 |
| 6 | 33.20 | 32.90 | 34.80 | 31.80 | 41.50 |
| 7 | 0.40 | 0.63 | 0.57 | 0.59 | 1.55 |
| 8 | 0.57 | 0.76 | 0.96 | 0.78 | 0.91 |
| 9 | 3.91 | 3.98 | 3.46 | 3.73 | 4.04 |
| 10 | 4.33 | 4.21 | 4.14 | 4.04 | 3.88 |
| 11 | 12.00 | 12.70 | 9.90 | 11.60 | 15.60 |
| 12 | 11.90 | 13.40 | 11.20 | 13.20 | 14.00 |
| 13 | 16.40 | 14.30 | 14.60 | 14.10 | 16.80 |
| 14 | 145.40 | 131.60 | 129.90 | 131.60 | 116.40 |
| 15 | 7.78 | 6.22 | 5.56 | 4.89 | 5.33 |
| 16 | 16.40 | 14.30 | 14.60 | 14.10 | 16.80 |
| 17 | 6.11 | 5.22 | 5.67 | 6.56 | 6.00 |
| 18 | 47.30 | 47.30 | 44.70 | 58.70 | 47.20 |
| 19 | 4.52 | 4.89 | 4.68 | 5.56 | 5.49 |
| 20 | 41.30 | 40.80 | 40.80 | 38.10 | 37.20 |
| 21 | 164.40 | 181.10 | 176.20 | 217.90 | 261.10 |
| 22 | 12.60 | 12.90 | 12.60 | 13.80 | 13.60 |
| 23 | 3.34 | 3.09 | 3.39 | 3.40 | 2.39 |

Table 156. Provided are the values of each of the parameters (as described above) measured in *B. juncea* accessions (line number) under normal conditions.

TABLE 157

Correlation between the expression level of selected genes of some embodiments of the invention in various tissues and the phenotypic performance under normal growth conditions across *B. Juncea* accessions

| Gene Name | R | P value | Exp. set | Corr. ID | Gene Name | R | P value | Exp. set | Corr. ID |
|---|---|---|---|---|---|---|---|---|---|
| LGD27 | 0.76 | 1.82E−02 | 2 | 19 | LGD27 | 0.72 | 2.76E−02 | 2 | 18 |
| LGD27 | 0.76 | 1.83E−02 | 2 | 17 | | | | | |

Table 157. Provided are the correlations (R) between the expression levels of the genes of some embodiments of the invention, and their homologues in tissues [Leaves, meristem and pods; Expression sets (Exp) according to Table 153] and the phenotypic performance in various yield, biomass, growth rate and/or vigor components (measured parameters shown in Tables 155 and 156) according to the Correlation (corr.) vectors shown in Table 154 under normal growth conditions across *B, juncea* accessions.
P = p value.

Example 15

Production of Sorghum Transcriptome and High Throughput Correlation Analysis with Yield, Drought and Low Nitrogen Related Parameters Measured in Fields Using 65K Sorghum Oligonucleotide Micro-Arrays In order to produce a high throughput correlation analysis between plant phenotype and gene expression level, the present inventors utilized a sorghum oligonucleotide microarray, produced by Agilent Technologies [World Wide Web (dot) chem. (dot) agilent (dot) com/Scripts/PDS (dot) asp?l-Page=50879]. The array oligonucleotide represents about 65,000 sorghum genes and transcripts. In order to define correlations between the levels of RNA expression with ABST, drought tolerance, low N tolerance and yield components or vigor related parameters, various plant characteristics of 36 different sorghum inbreds and hybrids were analyzed under normal (regular) conditions, 35 sorghum lines were analyzed under drought conditions and 34 sorghum lines were analyzed under low N (nitrogen) conditions. All the lines were sent for RNA expression analysis. The correlation between the RNA levels and the characterized parameters was analyzed using Pearson correlation test [World Wide Web (dot) davidmlane (dot) com/hyperstat/A34739 (dot) html].

Experimental Procedures

36 Sorghum varieties were grown in 5 repetitive plots, in field. Briefly, the growing protocol was as follows:

1. Regular (normal) growth conditions: sorghum plants were grown in the field using commercial fertilization and irrigation protocols, which include 549 m³ water per dunam (1000 square meters) per entire growth period and fertilization of 16 units of URAN® 21% (Nitrogen Fertilizer Solution; PCS Sales, Northbrook, Ill., USA) (normal growth conditions).

2. Drought conditions: sorghum seeds were sown in soil and grown under normal condition until vegetative stage (49 days from sowing), drought treatment was imposed by irrigating plants with approximately 60% of the water applied for the normal treatment [315 m$^3$ water per dunam (1000 square meters) per entire growth period].

3. Low Nitrogen fertilization conditions: sorghum plants were sown in soil and irrigated with as the normal conditions (549 m$^3$ water per dunam (1000 square meters) per entire growth period). No fertilization of nitrogen was applied, whereas other elements were fertilized as in the normal conditions (Magnesium—405 gr. per dunam for three weeks).

Analyzed Sorghum tissues—All 36 Sorghum inbreds and hybrids were sample per each of the treatments. Tissues [Flag leaf, root and peduncle] representing different plant characteristics, were sampled and RNA was extracted as described above. Each micro-array expression information tissue type has received a Set ID as summarized in Table 158 below.

TABLE 158

Sorghum transcriptome expression sets in field experiment

| Expression Set | Set ID |
| --- | --- |
| Flag leaf at grain filling stage under normal conditions | 1 |
| Peduncle at flowering stage under normal conditions | 2 |
| Root at seedling stage under normal conditions | 3 |
| Flag leaf at grain filling stage under drought conditions | 4 |
| Flag leaf at grain filling stage under low nitrogen conditions | 5 |

Table 158: Provided are the *sorghum* transcriptome expression sets.
Flag leaf = the leaf below the flower.

Sorghum yield components and vigor related parameters assessment—Plants were phenotyped as shown in Tables 159-161 below. Some of the following parameters were collected using digital imaging system:

Grains yield per dunam (kg)—At the end of the growing period all heads were collected (harvest). Heads were separately threshed and grains were weighted (grain yield). Grains yield per dunam was calculated by multiplying grain yield per m$^2$ by 1000 (dunam is 1000 m$^2$).

Grains yield per plant (plot) (gr.)—At the end of the growing period all heads were collected (harvest). Heads were separately threshed and grains were weighted (grain yield). The average grain weight per plant was calculated by dividing the grain yield by the number of plants per plot.

Grains yield per head (gr.)—At the end of the growing period all heads were collected (harvest). Heads were separately threshed and grains were weighted (grain yield). Grains yield per head was calculated by dividing the grain yield by the number of heads.

Main head grains yield per plant (gr.)—At the end of the growing period all plants were collected (harvest). Main heads were threshed and grains were weighted. Main head grains yield per plant was calculated by dividing the grain yield of the main heads by the number of plants.

Secondary heads grains yield per plant (gr.)—At the end of the growing period all plants were collected (harvest). Secondary heads were threshed and grains were weighted. Secondary heads grain yield per plant was calculated by dividing the grain yield of the secondary heads by the number of plants.

Heads dry weight per dunam (kg)—At the end of the growing period heads of all plants were collected (harvest). Heads were weighted after oven dry (dry weight). Heads dry weight per dunam was calculated by multiplying grain yield per m$^2$ by 1000 (dunam is 1000 m$^2$).

Average heads weight per plant at flowering (gr.)—At flowering stage heads of 4 plants per plot were collected. Heads were weighted after oven dry (dry weight), and divided by the number of plants.

Leaf carbon isotope discrimination at harvest (%)—isotopic ratio of $^{13}$C to $^{12}$C in plant tissue was compared to the isotopic ratio of $^{13}$C to $^{12}$C in the atmosphere Yield per dunam/water until maturity (kg/lit)—was calculated according to Formula 42 (above).

Vegetative dry weight per plant/water until maturity (gr./lit)—was calculated according to Formula 42 above.

Total dry matter per plant at harvest/water until maturity (gr./lit)—was calculated according to Formula 44 above.

Yield/SPAD at grain filling (kg/SPAD units) was calculated according to Formula 47 above.

Grains number per dunam (num)—Grains yield per dunam divided by the average 1000 grain weight.

Grains per plant (num)—Grains yield per plant divided by the average 1000 grain weight.

Main head grains num per plant (num)—main head grain yield divided by the number of plants.

Heads weight per plant (gr.)—At the end of the growing period heads of selected plants were collected (harvest stage) from the rest of the plants in the plot. Heads were weighted after oven dry (dry weight), and average head weight per plant was calculated.

1000 grain weight (gr.)—was calculated according to Formula 14 above.

1000 grain weight filling rate (gr./day)—was calculated based on Formula 36 above.

Grain area (cm$^2$)—At the end of the growing period the grains were separated from the head (harvest). A sample of ~200 grains were weighted, photographed and images were processed using the below described image processing system. The grain area was measured from those images and was divided by the number of grains.

Grain Length and Grain width [cm]—A sample of ~200 grains was weighted, photographed and images were processed using the below described image processing system. The sum of grain lengths and width (longest axis) was measured from those images and was divided by the number of grains.

Grain Perimeter [cm]—A sample of ~200 grains were weighted, photographed and images were processed using the below described image processing system. The sum of grain perimeter was measured from those images and was divided by the number of grains.

Grain fill duration (num)—Duration of grain filling period was calculated by subtracting the number of days to flowering from the number of days to maturity.

Grain fill duration (GDD)—Duration of grain filling period according to the growing degree units (GDD) method. The accumulated GDD during the grain filling period was calculated by subtracting the Num days to Anthesis (GDD) from Num days to Maturity (GDD).

Yield per dunam filling rate (kg/day)—was calculated according to Formula 39 (using grain yield per dunam).

Yield per plant filling rate (gr./day)—was calculated according to Formula 39 (using grain yield per plant).

Head area (cm$^2$)—At the end of the growing period (harvest) 6 plants main heads were photographed and images were processed using the below described image processing system. The head area was measured from those images and was divided by the number of plants.

Head length (cm)—At the end of the growing period (harvest) 6 plants main heads were photographed and images were processed using the below described image processing system. The head length (longest axis) was measured from those images and was divided by the number of plants.

Head width (cm)—At the end of the growing period (harvest) 6 plants main heads were photographed and images were processed using the below described image processing system. The head width (longest axis) was measured from those images and was divided by the number of plants.

Number days to flag leaf senescence (num)—the number of days from sowing till 50% of the plot arrives to Flag leaf senescence (above half of the leaves are yellow).

Number days to flag leaf senescence (GDD)—Number days to flag leaf senescence according to the growing degree units method. The accumulated GDD from sowing until flag leaf senescence.

% yellow leaves number at flowering (percentage)—At flowering stage, leaves of 4 plants per plot were collected. Yellow and green leaves were separately counted. Percent of yellow leaves at flowering was calculated for each plant by dividing yellow leaves number per plant by the overall number of leaves per plant and multiplying by 100.

% yellow leaves number at harvest (percentage)—At the end of the growing period (harvest) yellow and green leaves from 6 plants per plot were separately counted. Percent of the yellow leaves was calculated per each plant by dividing yellow leaves number per plant by the overall number of leaves per plant and multiplying by 100.

Leaf temperature at flowering (° celsius)—Leaf temperature was measured at flowering stage using Fluke IR thermometer 568 device. Measurements were done on 4 plants per plot on an open flag leaf.

Specific leaf area at flowering ($cm^2$/gr)—was calculated according to Formula 37 above.

Flag leaf thickness at flowering (mm)—At the flowering stage, flag leaf thickness was measured for 4 plants per plot. Micrometer was used to measure the thickness of a flag leaf at an intermediate position between the border and the midrib.

Relative water content at flowering (percentage)—was calculated based on Formula 1 above.

Leaf water content at flowering (percentage)—was calculated based on Formula 49 above.

Stem water content at flowering (percentage)—was calculated based on Formula 48 above.

Total heads per dunam at harvest (number)—At the end of the growing period the total number of heads per plot was counted (harvest). Total heads per dunam was calculated by multiplying heads number per $m^2$ by 1000 (dunam is 1000 $m^2$).

Heads per plant (num)—At the end of the growing period total number of heads were counted and divided by the total number plants.

Tillering per plant (num)—Tillers of 6 plants per plot were counted at harvest stage and divided by the number of plants.

Harvest index (plot) (ratio)—The harvest index was calculated using Formula 58 above.

Heads index (ratio)—Heads index was calculated using Formula 46 above.

Total dry matter per plant at flowering (gr.)—Total dry matter per plant was calculated at flowering. The vegetative portion above ground and all the heads dry weight of 4 plants per plot were summed and divided by the number of plants.

Total dry matter per plant (kg)—Total dry matter per plant at harvest was calculated by summing the average head dry weight and the average vegetative dry weight of 6 plants per plot.

Vegetative dry weight per plant at flowering (gr.)—At the flowering stage, vegetative material (excluding roots) of 4 plants per plot were collected and weighted after (dry weight) oven dry. The biomass per plant was calculated by dividing total biomass by the number of plants.

Vegetative dry weight per plant (kg)—At the harvest stage, all vegetative material (excluding roots) were collected and weighted after (dry weight) oven dry. Vegetative dry weight per plant was calculated by dividing the total biomass by the number of plants.

Plant height—Plants were characterized for height at harvest. In each measure, plants were measured for their height using a measuring tape. Height was measured from ground level to top of the longest leaf.

Plant height growth (cm/day)—The relative growth rate (RGR) of plant height was calculated based on Formula 3 above.

% Canopy coverage at flowering (percentage)—The % Canopy coverage at flowering was calculated based on Formula 32 above.

PAR_LAI (Photosynthetic active radiance—Leaf area index)—Leaf area index values were determined using an AccuPAR Ceptometer Model LP-80 and measurements were performed at flowering stage with three measurements per plot.

Leaves area at flowering ($cm^2$)—Green leaves area of 4 plants per plot was measured at flowering stage. Measurement was performed using a Leaf area-meter.

SPAD at vegetative stage (SPAD unit)—Chlorophyll content was determined using a Minolta SPAD 502 chlorophyll meter and measurement was performed at vegetative stage. SPAD meter readings were done on fully developed leaves of 4 plants per plot by performing three measurements per leaf per plant.

SPAD at flowering (SPAD unit)—Chlorophyll content was determined using a Minolta SPAD 502 chlorophyll meter and measurement was performed at flowering stage. SPAD meter readings were done on fully developed leaves of 4 plants per plot by performing three measurements per leaf per plant.

SPAD at grain filling (SPAD unit)—Chlorophyll content was determined using a Minolta SPAD 502 chlorophyll meter and measurement was performed at grain filling stage. SPAD meter readings were done on fully developed leaves of 4 plants per plot by performing three measurements per leaf per plant.

RUE (Radiation use efficiency) (gr./% canopy coverage)—Total dry matter produced per intercepted PAR at flowering stage was calculated by dividing the average total dry matter per plant at flowering by the percent of canopy coverage.

Lower stem width at flowering (mm)—Lower stem width was measured at the flowering stage. Lower internodes from 4 plants per plot were separated from the plant and their diameter was measured using a caliber.

Upper stem width at flowering (mm)—Upper stem width was measured at flowering stage.

Upper internodes from 4 plants per plot were separated from the plant and their diameter was measured using a caliber.

All stem volume at flowering (cm$^3$)—was calculated based on Formula 50 above.

Number days to heading (num)—Number of days to heading was calculated as the number of days from sowing till 50% of the plot arrive heading.

Number days to heading (GDD)—Number days to heading according to the growing degree units method. The accumulated GDD from sowing until heading stage.

Number days to anthesis (num)—Number of days to flowering was calculated as the number of days from sowing till 50% of the plot arrive anthesis.

Number days to anthesis (GDD)—Number days to anthesis according to the growing degree units method. The accumulated GDD from sowing until anthesis stage.

Number days to maturity (GDD)—Number days to maturity according to the growing degree units method. The accumulated GDD from sowing until maturity stage.

N (Nitrogen) use efficiency (kg/kg)—was calculated based on Formula 51 above.

Total NUtE—was calculated based on Formula 53 above.

Grain NUtE—was calculated based on Formula 55 above.

NUpE (kg/kg)—was calculated based on Formula 52 above.

N (Nitrogen) harvest index (Ratio)—was calculated based on Formula 56 above.

% N (Nitrogen) in shoot at flowering—% N content of dry matter in the shoot at flowering.

% N (Nitrogen) in head at flowering—% N content of dry matter in the head at flowering.

% N in (Nitrogen) shoot at harvest—% N content of dry matter in the shoot at harvest.

% N (Nitrogen) in grain at harvest—% N content of dry matter in the grain at harvest.

% N (Nitrogen) in leaf at grain filling—% N content of dry matter in the shoot at grain filling.

% C (Carbon) in leaf at flowering—% C content of dry matter in the leaf at flowering.

% C (Carbon) in leaf at grain filling—% C content of dry matter in the leaf at grain filling.

Data parameters collected are summarized in Tables 159-161 herein below.

TABLE 159

*Sorghum* correlated parameters under normal conditions (vectors)

| Correlated parameter with | Correlation ID |
|---|---|
| Grains yield per dunam [kg] | 1 |
| Grains yield per plant (plot) [gr.] | 2 |
| Grains yield per head (RP) [gr.] | 3 |
| Grains number per dunam [num] | 4 |
| Grains per plant (plot) [num] | 5 |
| Main head grains yield per plant [gr.] | 6 |
| Main Heads DW (SP) [gr.] | 7 |
| Main head grains num per plant [num] | 8 |
| Secondary heads grains yield per plant [gr.] | 9 |
| Yield/SPAD (GF) [ratio] | 10 |
| Yield per dunam/water until maturity [kg/ml] | 11 |
| TDM (F)/water until flowering [gr./lit] | 12 |
| TDM (SP)/water until maturity [kg/lit] | 13 |
| VDW (F)/water until flowering [gr./lit] | 14 |
| VDW (SP)/water until maturity [gr./lit] | 15 |
| Head Area [cm$^2$] | 16 |
| Head length [cm] | 17 |
| Head Width [cm] | 18 |
| Heads dry weight per dunam [kg] | 19 |
| Grain area [cm$^2$] | 20 |
| Grain length [cm] | 21 |
| Grain Perimeter [cm] | 22 |
| Grain width [cm] | 23 |
| 1000 grain weight [gr.] | 24 |
| 1000 grain weight filling rate [gr./day] | 25 |
| Yield per dunam filling rate [kg/day] | 26 |

TABLE 159-continued

*Sorghum* correlated parameters under normal conditions (vectors)

| Correlated parameter with | Correlation ID |
|---|---|
| Yield per plant filling rate [gr./day] | 27 |
| Grain fill duration [num] | 28 |
| Grain fill duration (GDD) | 29 |
| Number days to Anthesis [num] | 30 |
| Number days to Anthesis (GDD) | 31 |
| Number days to Flag leaf senescence [num] | 32 |
| Number days to Flag leaf senescence (GDD) | 33 |
| Number days to Heading | 34 |
| Number days to Heading (GDD) | 35 |
| Num days to Maturity (GDD) | 36 |
| % yellow leaves number (F) [%] | 37 |
| % yellow leaves number (H) [%] | 38 |
| Harvest index (plot) [ratio] | 39 |
| Heads index (SP) [Ratio] | 40 |
| Heads per plant (RP) [num] | 41 |
| Average heads weight per plant (F) [gr.] | 42 |
| Total Heads per dunam (H) [number] | 43 |
| Tillering per plant (SP) [number] | 44 |
| Total dry matter per plant (F) [gr.] | 45 |
| Total dry matter per plant (SP) [kg] | 46 |
| Vegetative DW per plant (F) [gr.] | 47 |
| Vegetative DW per plant (RP) [kg] | 48 |
| % Canopy coverage (F) [%] | 49 |
| Flag Leaf thickness (F) [mm] | 50 |
| Leaf carbon isotope discrimination (H) (%) | 51 |
| Leaf temperature (F) [° C.] | 52 |
| Leaf water content (F) [%] | 53 |
| RWC (F) [%] | 54 |
| Leaves area (F) [cm$^2$] | 55 |
| Specific leaf area (F) [cm$^2$/gr] | 56 |
| SPAD (F) [SPAD unit] | 57 |
| SPAD (GF) [SPAD unit] | 58 |
| PAR_LAI (F) [µmol m$^{-2}$ S$^{-1}$] | 59 |
| RUE [gr./% canopy coverage] | 60 |
| Plant height (H) [cm] | 61 |
| Plant height growth [cm/day] | 62 |
| Lower Stem width (F) [mm] | 63 |
| Upper Stem width (F) [mm] | 64 |
| Stem water content (F) [%] | 65 |
| All stem volume (F) [cm$^3$] | 66 |
| % C in leaf (F) [%] | 67 |
| % C in leaf (GF) [%] | 68 |
| % N in grain (H) [%] | 69 |
| % N in head (F) [%] | 70 |
| % N in leaf (GF) [%] | 71 |
| % N in shoot (F) [%] | 72 |
| % N in shoot (H) [%] | 73 |
| Grain N utilization efficiency [ratio] | 74 |
| Total N utilization efficiency (H) [ratio] | 75 |
| N harvest index [ratio] | 76 |
| N use efficiency [ratio] | 77 |
| NupE (H) [ratio] | 78 |

Table 159. Provided are the *Sorghum* correlated parameters (vectors).
"kg" = kilograms;
"gr." = grams;
"RP" = Rest of plot;
"SP" = Selected plants;
"lit" = liter;
"ml"—milliliter;
"cm" = centimeter;
"num" = number;
"GDD"—Growing degree day;
"SPAD" = chlorophyll levels;
"FW" = Plant Fresh weight;
"DW" = Plant Dry weight;
"GF" = grain filling growth stage;
"F" = flowering stage;
"H" = harvest stage;
"N"—Nitrogen;
"NupE"—Nitrogen uptake efficiency;
"VDW" = vegetative dry weight;
"TDM" = Total dry matter.
"RUE" = radiation use efficiency;
"RWC" relative water content;
"veg" = vegetative stage.

TABLE 160

Sorghum correlated parameters under low N conditions (vectors)

| Correlated parameter with | Correlation ID |
|---|---|
| Grains yield per dunam [kg] | 1 |
| Grains yield per plant (plot) [gr.] | 2 |
| Grains yield per head (RP) [gr.] | 3 |
| Main head grains yield per plant [gr.] | 4 |
| Secondary heads grains yield per plant [gr.] | 5 |
| Heads dry weight per dunam [kg] | 6 |
| Average heads weight per plant (F) [gr.] | 7 |
| Leaf carbon isotope discrimination (H) (%) | 8 |
| Yield per dunam/water until maturity [kg/ml] | 9 |
| VDW (SP)/water until maturity [gr./lit] | 10 |
| TDM (SP)/water until maturity [kg/lit] | 11 |
| TDM (F)/water until flowering [gr./lit] | 12 |
| VDW (F)/water until flowering [gr./lit] | 13 |
| Yield/SPAD (GF) [ratio] | 14 |
| Grains number per dunam [num] | 15 |
| Grains per plant (plot) [num] | 16 |
| Main head grains num per plant [num] | 17 |
| 1000 grain weight [gr.] | 18 |
| Grain area [$cm^2$] | 19 |
| Grain fill duration [num] | 20 |
| Grain fill duration (GDD) | 21 |
| Yield per dunam filling rate [kg/day] | 22 |
| Yield per plant filling rate [gr./day] | 23 |
| Head Area [$cm^2$] | 24 |
| Number days to Flag leaf senescence [num] | 25 |
| Number days to Flag leaf senescence (GDD) | 26 |
| % yellow leaves number (F) [%] | 27 |
| % yellow leaves number (H) [%] | 28 |
| Leaf temperature (F) [° C.] | 29 |
| Specific leaf area (F) [$cm^2$/gr.] | 30 |
| Flag Leaf thickness (F) [mm] | 31 |
| RWC (F) [%] | 32 |
| Leaf water content (F) [%] | 33 |
| Stem water content (F) [%] | 34 |
| Total Heads per dunam (H) [number] | 35 |
| Heads per plant (RP) [num] | 36 |
| Tillering per plant (SP) [number] | 37 |
| Harvest index (plot) [ratio] | 38 |
| Heads index (SP) [Ratio] | 39 |
| Total dry matter per plant (F) [gr.] | 40 |
| Total dry matter per plant (SP) [kg] | 41 |
| Vegetative DW per plant (F) [gr.] | 42 |
| Vegetative DW per plant (RP) [kg] | 43 |
| Plant height growth [cm/day] | 44 |
| % Canopy coverage (F) [%] | 45 |
| PAR_LAI (F) [µmol $m^{-2}$ $S^{-1}$] | 46 |
| Leaves area (F) [$cm^2$] | 47 |
| SPAD_(veg) [SPAD unit] | 48 |
| SPAD (F) [SPAD unit] | 49 |
| SPAD (GF) [SPAD unit] | 50 |
| RUE [gr./% canopy coverage] | 51 |
| Lower Stem width (F) [mm] | 52 |
| Upper Stem width (F) [mm] | 53 |
| All stem volume (F) [$cm^3$] | 54 |
| Number days to Heading (GDD) | 55 |
| Number days to Anthesis [num] | 56 |
| Number days to Anthesis (GDD) | 57 |
| Number days to Maturity (GDD) | 58 |
| N use efficiency [ratio] | 59 |
| Total N utilization efficiency (H) [ratio] | 60 |
| Grain N utilization efficiency [ratio] | 61 |
| NupE (H) [ratio] | 62 |
| N harvest index [ratio] | 63 |
| % N in shoot (F) [%] | 64 |
| % N in head (F) [%] | 65 |
| % N in shoot (H) [%] | 66 |
| % N in grain (H) [%] | 67 |

Table 160. Provided are the *Sorghum* correlated parameters (vectors).

"kg" = kilograms;

"gr." = grams;

"RP" = Rest of plot;

"SP" = Selected plants;

"lit" = liter;

"ml"—milliliter;

"cm" = centimeter;

"num" = number;

"GDD"—Growing degree day;

"SPAD" = chlorophyll levels;

"FW" = Plant Fresh weight;

"DW" = Plant Dry weight;

"GF" = grain filling growth stage;

"F" = flowering stage;

"H" = harvest stage;

"N"—Nitrogen;

"NupE"—Nitrogen uptake efficiency;

"VDW" = vegetative dry weight;

"TDM" = Total dry matter.

"RUE" = radiation use efficiency;

"RWC" relative water content;

"veg" = vegetative stage.

TABLE 161

Sorghum correlated parameters under drought conditions (vectors)

| Correlated parameter with | Correlation ID |
|---|---|
| Grains yield per dunam [kg] | 1 |
| Grains yield per plant (plot) [gr.] | 2 |
| Grains yield per head (RP) [gr.] | 3 |
| Main head grains yield per plant [gr.] | 4 |
| Secondary heads grains yield per plant [gr.] | 5 |
| Heads dry weight per dunam [kg] | 6 |
| Average heads weight per plant (F) [gr.] | 7 |
| Leaf carbon isotope discrimination (H) (%) | 8 |
| Yield per dunam/water until maturity [kg/ml] | 9 |
| VDW (SP)/water until maturity [gr./lit] | 10 |
| TDM (SP)/water until maturity [kg/lit] | 11 |
| TDM (F)/water until flowering [gr./lit] | 12 |
| VDW (F)/water until flowering [gr./lit] | 13 |
| Yield/SPAD (GF) [ratio] | 14 |
| Grains number per dunam [num] | 15 |
| Grains per plant (plot) [num] | 16 |
| Main head grains num per plant [num] | 17 |
| 1000 grain weight [gr.] | 18 |
| Grain area [$cm^2$] | 19 |
| Grain fill duration [num] | 20 |
| Grain fill duration (GDD) | 21 |
| Yield per dunam filling rate [kg/day] | 22 |
| Yield per plant filling rate [gr./day] | 23 |
| Head Area [$cm^2$] | 24 |
| Number days to Flag leaf senescence [num] | 25 |
| Number days to Flag leaf senescence (GDD) | 26 |
| % yellow leaves number (F) [%] | 27 |
| % yellow leaves number (H) [%] | 28 |

TABLE 161-continued

Sorghum correlated parameters under drought conditions (vectors)

| Correlated parameter with | Correlation ID |
|---|---|
| Leaf temperature (F) [° C.] | 29 |
| Specific leaf area (F) [cm$^2$/gr.] | 30 |
| Flag Leaf thickness (F) [mm] | 31 |
| RWC (F) [%] | 32 |
| Leaf water content (F) [%] | 33 |
| Stem water content (F) [%] | 34 |
| Total Heads per dunam (H) [number] | 35 |
| Heads per plant (RP) [num] | 36 |
| Tillering per plant (SP) [number] | 37 |
| Harvest index (plot) [ratio] | 38 |
| Heads index (SP) [Ratio] | 39 |
| Total dry matter per plant (F) [gr.] | 40 |
| Total dry matter per plant (SP) [kg] | 41 |
| Vegetative DW per plant (F) [gr.] | 42 |
| Vegetative DW per plant (RP) [kg] | 43 |
| Plant height growth [cm/day] | 44 |
| % Canopy coverage (F) [%] | 45 |
| PAR_LAI (F) [μmol m$^{-2}$ S$^{-1}$] | 46 |
| Leaves area (F) [cm$^2$] | 47 |
| SPAD_(veg) [SPAD unit] | 48 |
| SPAD (F) [SPAD unit] | 49 |
| SPAD (GF) [SPAD unit] | 50 |
| RUE [gr./% canopy coverage] | 51 |
| Lower Stem width (F) [mm] | 52 |
| Upper Stem width (F) [mm] | 53 |
| All stem volume (F) [cm$^3$] | 54 |
| Number days to Heading (GDD) | 55 |
| Number days to Anthesis [num] | 56 |
| Number days to Anthesis (GDD) | 57 |
| Number days to Maturity (GDD) | 58 |

Table 161. Provided are the Sorghum correlated parameters (vectors).
"kg" = kilograms;
"gr." = grams;
"RP" = Rest of plot;
"SP" = Selected plants;
"lit" = liter;
"ml"—milliliter;
"cm" = centimeter;
"num" = number;
"GDD"—Growing degree day;
"SPAD" = chlorophyll levels;
"FW" = Plant Fresh weight;
"DW" = Plant Dry weight;
"GF" = grain filling growth stage;
"F" = flowering stage;
"H" = harvest stage;
"N"—Nitrogen;
"NupE" = Nitrogen uptake efficiency;
"VDW" = vegetative dry weight;
"TDM" = Total dry matter.
"RUE" = radiation use efficiency;
"RWC" relative water content;
"veg" = vegetative stage.

Experimental Results

Thirty-six different sorghum inbreds and hybrids lines were grown and characterized for different parameters (Tables 159-161). The average for each of the measured parameters was calculated using the JMP software (Tables 162-176) and a subsequent correlation analysis was performed (Tables 177-179). Results were then integrated to the database.

TABLE 162

Measured parameters in Sorghum accessions under normal conditions

| L/Corr. ID | L-1 | L-2 | L-3 | L-4 | L-5 | L-6 | L-7 |
|---|---|---|---|---|---|---|---|
| 1 | 818.90 | 893.20 | 861.80 | 912.80 | 661.80 | 612.20 | 421.0 |
| 2 | 42.40 | 48.60 | 48.50 | 56.20 | 48.10 | 39.50 | 23.50 |
| 3 | 30.30 | 32.80 | 25.40 | 21.40 | 37.30 | 33.20 | 17.00 |
| 4 | 27117640 | 27702000 | 25021020 | 29202780 | 21264980 | 25132460 | 20308520 |
| 5 | 1383.1 | 1685.2 | 1581.1 | 2265.6 | 1732.2 | 1513.9 | 1133.7 |
| 6 | 38.20 | 53.80 | 55.60 | 51.00 | 53.40 | 36.00 | 19.80 |
| 7 | 391.30 | 440.00 | 428.50 | 412.20 | 456.60 | 445.30 | 317.0 |
| 8 | 7933.6 | 10019.6 | 9690.6 | 9745.6 | 10705.8 | 11739.6 | 6052.2 |
| 9 | 2.45 | 7.00 | 2.20 | 30.99 | 5.72 | 2.84 | 2.33 |
| 10 | 24.00 | 33.70 | 34.00 | 48.10 | 38.00 | 28.40 | 23.70 |
| 11 | 1.62 | 1.92 | 1.85 | 1.85 | 1.42 | 1.26 | 0.90 |
| 12 | 0.67 | 0.46 | 0.28 | 0.28 | 0.54 | 0.28 | 0.45 |
| 13 | 0.38 | 0.47 | 0.43 | 0.48 | 0.47 | 0.30 | 0.37 |
| 14 | 0.62 | 0.39 | 0.24 | 0.25 | 0.41 | 0.24 | 0.42 |
| 15 | 0.03 | 0.03 | 0.03 | 0.03 | 0.03 | 0.01 | 0.02 |
| 16 | 134.40 | 96.70 | 112.80 | 101.70 | 106.10 | 84.10 | 105.6 |
| 17 | 29.80 | 19.10 | 23.10 | 19.60 | 18.20 | 23.80 | 19.60 |
| 18 | 5.62 | 6.40 | 6.14 | 6.43 | 7.42 | 4.43 | 6.74 |
| 19 | 1.05 | 1.06 | 0.96 | 1.01 | 0.80 | 0.77 | 0.75 |
| 20 | 0.12 | 0.13 | 0.13 | 0.14 | 0.13 | 0.11 | 0.09 |
| 21 | 0.44 | 0.49 | 0.46 | 0.51 | 0.45 | 0.41 | 0.48 |
| 22 | 1.31 | 1.40 | 1.36 | 1.42 | 1.36 | 1.22 | 1.31 |
| 23 | 0.37 | 0.38 | 0.38 | 0.38 | 0.39 | 0.35 | 0.29 |
| 24 | 29.80 | 32.00 | 33.80 | 31.30 | 30.00 | 24.10 | 18.40 |
| 25 | 0.79 | 0.90 | 1.02 | 0.89 | 1.03 | 0.76 | 0.81 |
| 26 | 23.40 | 27.60 | 27.80 | 28.20 | 23.90 | 20.00 | 17.90 |
| 27 | 1.11 | 1.88 | 1.86 | 2.54 | 2.10 | 1.13 | 0.93 |
| 28 | 35.00 | 32.40 | 31.00 | 32.40 | 27.60 | 32.80 | 23.40 |
| 29 | 459.60 | 407.90 | 396.80 | 423.60 | 358.80 | 414.60 | 305.60 |

TABLE 162-continued

Measured parameters in Sorghum accessions under normal conditions

| L/ Corr. ID | L-1 | L-2 | L-3 | L-4 | L-5 | L-6 | L-7 |
|---|---|---|---|---|---|---|---|
| 30 | 89.2 | 83.0 | 85.8 | 88.4 | 88.8 | 84.2 | 93.40 |
| 31 | 777.5 | 709.7 | 740.6 | 768.4 | 773.0 | 725.7 | 831.9 |
| 32 | 141.00 | 119.00 | 125.50 | 139.00 | 117.20 | NA | 126.80 |
| 33 | 1469.5 | 1165.8 | 1254.9 | 1441.2 | 1142.7 | NA | 1272.0 |
| 34 | 85.60 | 75.60 | 83.00 | 84.00 | 88.00 | 76.00 | 88.50 |
| 35 | 739.40 | 625.30 | 709.00 | 721.10 | 763.80 | 629.60 | 769.50 |
| 36 | 1237.2 | 1117.6 | 1137.4 | 1191.9 | 1131.7 | 1137.4 | 1137.4 |
| 37 | 0.14 | 0.24 | 0.08 | 0.13 | 0.27 | 0.13 | 0.10 |
| 38 | 0.27 | 0.16 | 0.32 | 0.39 | 0.32 | 0.10 | 0.14 |
| 39 | 0.23 | 0.27 | 0.28 | 0.34 | 0.27 | 0.31 | 0.13 |
| 40 | 0.35 | 0.40 | 0.39 | 0.45 | 0.38 | 0.54 | 0.34 |
| 41 | 1.12 | 1.31 | 1.71 | 2.28 | 1.14 | 1.15 | 1.29 |
| 42 | 66.00 | 86.50 | 77.20 | 105.90 | 83.00 | 55.80 | 59.90 |
| 43 | 25950.0 | 25250.0 | 31350.0 | 37950.0 | 15917.6 | 16250.0 | 23200.0 |
| 44 | 1.23 | 3.28 | 4.13 | 3.17 | 1.10 | 2.33 | 3.07 |
| 45 | 198.50 | 120.90 | 77.80 | 83.10 | 159.60 | 70.70 | 143.30 |
| 46 | 0.19 | 0.22 | 0.20 | 0.24 | 0.22 | 0.14 | 0.17 |
| 47 | 181.50 | 103.20 | 68.00 | 73.00 | 121.90 | 59.50 | 132.00 |
| 48 | 0.10 | 0.10 | 0.11 | 0.09 | 0.10 | 0.08 | 0.13 |
| 49 | 87.30 | 90.10 | 75.70 | 75.60 | 76.10 | 69.90 | 84.40 |
| 50 | 0.18 | 0.14 | 0.14 | 0.16 | 0.13 | 0.19 | 0.14 |
| 51 | −12.86 | −13.20 | −13.12 | −12.83 | −13.16 | −13.05 | −13.16 |
| 52 | 31.70 | 29.20 | 30.40 | 29.60 | 30.40 | 30.00 | 29.80 |
| 53 | 66.00 | NA | 74.10 | 71.80 | 63.30 | 77.50 | 70.00 |
| 54 | 90.80 | 91.70 | 91.20 | 88.70 | 88.30 | 84.50 | 87.20 |
| 55 | 16514.4 | 12058.4 | 12787.0 | 9932.2 | 11459.3 | 9116.4 | 9023.2 |
| 56 | 137.5 | 148.3 | 164.8 | 175.8 | 162.4 | 150.5 | 110.2 |
| 57 | 56.90 | 52.50 | 49.20 | 55.10 | 48.20 | 53.30 | 48.90 |
| 58 | 56.30 | 56.30 | 53.30 | 59.10 | 52.00 | 54.20 | 47.00 |
| 59 | 5.34 | 5.58 | 4.42 | 3.76 | 3.62 | 4.01 | 4.92 |
| 60 | 2.27 | 1.34 | 1.03 | 1.11 | 2.10 | 1.07 | 1.96 |
| 61 | 119.0 | 158.2 | 149.5 | 185.9 | 296.2 | 107.9 | 285.8 |
| 62 | 1.24 | 2.55 | 2.04 | 2.01 | 2.76 | 1.12 | 2.18 |
| 63 | 20.00 | 15.50 | 14.20 | 18.40 | 16.00 | 16.40 | 15.40 |
| 64 | 11.28 | 9.93 | 8.12 | 10.66 | 9.86 | 9.02 | 8.27 |
| 65 | 53.80 | 77.80 | 79.80 | 78.50 | 67.20 | 78.00 | 71.90 |
| 66 | 23261.2 | 19941.6 | 14878.4 | 31092.4 | 39294.6 | 13029.4 | 33015.4 |
| 67 | NA | NA | NA | NA | NA | NA | 53.00 |
| 68 | NA | NA | NA | NA | NA | NA | 0.35 |
| 69 | 1.91 | NA | 1.62 | 2.09 | NA | 1.59 | NA |
| 70 | 2.32 | NA | 2.72 | 1.84 | NA | 1.97 | NA |
| 71 | NA | NA | NA | NA | NA | NA | 0.35 |
| 72 | 1.73 | NA | 1.41 | 1.30 | NA | 1.60 | NA |
| 73 | 1.08 | NA | 0.56 | 0.72 | NA | 1.11 | NA |
| 74 | 18.51 | NA | 35.87 | 31.06 | NA | 30.94 | NA |
| 75 | 91.30 | NA | 123.20 | 89.00 | NA | 93.70 | NA |
| 76 | 0.35 | NA | 0.58 | 0.65 | NA | 0.49 | NA |
| 77 | 45.50 | 49.60 | 47.90 | 50.70 | 36.80 | 34.00 | 23.40 |
| 78 | 1.91 | NA | 1.33 | 1.56 | NA | 1.10 | NA |

Table 162: Provided are the values of each of the parameters (as described above) measured in Sorghum accessions ("L" = Line) under normal conditions. Growth conditions are specified in the experimental procedure section.

Table 163

Measured parameters in additional Sorghum accessions under normal conditions

| L/ Corr. ID | L-8 | L-9 | L-10 | L-11 | L-12 | L-13 | L-14 |
|---|---|---|---|---|---|---|---|
| 1 | 154.3 | 663.3 | 457.0 | 473.8 | 257.0 | 664.8 | 297.9 |
| 2 | 9.60 | 43.50 | 31.40 | 44.40 | 14.50 | 39.60 | 25.50 |
| 3 | 8.60 | 27.90 | 30.80 | 39.50 | 9.20 | 29.00 | 15.10 |
| 4 | 6938386 | 26620980 | 23566280 | 16059440 | 10047874 | 24969700 | 15586667 |
| 5 | 442.0 | 1935.1 | 1613.3 | 1605.0 | 783.9 | 1522.3 | 1725.9 |
| 6 | 10.00 | 46.60 | 28.50 | 46.90 | 22.20 | 31.10 | 43.40 |
| 7 | 145.4 | 442.6 | 308.4 | 440.0 | 339.7 | 273.5 | 466.2 |
| 8 | 2700.8 | 11875.0 | 9496.2 | 10407.6 | 5596.8 | 8174.8 | 14343.0 |
| 9 | 0.11 | 4.37 | 0.21 | NA | 2.75 | 1.47 | 0.70 |
| 10 | 7.50 | 36.00 | 33.00 | 29.80 | 20.20 | 26.20 | 42.10 |
| 11 | 0.32 | 1.31 | 0.81 | 0.84 | 0.51 | 1.39 | 0.53 |

Table 163-continued

Measured parameters in additional *Sorghum* accessions under normal conditions

| L/Corr. ID | L-8 | L-9 | L-10 | L-11 | L-12 | L-13 | L-14 |
|---|---|---|---|---|---|---|---|
| 12 | 0.12 | 0.35 | 0.62 | 0.58 | 0.26 | 0.27 | 0.51 |
| 13 | 0.14 | 0.33 | 0.74 | 0.44 | 0.28 | 0.22 | 0.45 |
| 14 | 0.09 | 0.32 | 0.59 | 0.49 | 0.23 | 0.22 | 0.46 |
| 15 | 0.01 | 0.02 | 0.06 | 0.03 | 0.02 | 0.01 | 0.03 |
| 16 | 226.2 | 156.4 | 120.4 | 210.5 | 121.3 | 74.8 | 244.5 |
| 17 | 25.90 | 28.90 | 25.30 | 35.10 | 25.20 | 17.80 | 30.80 |
| 18 | 11.04 | 6.77 | 6.05 | 7.53 | 5.95 | 5.27 | 9.99 |
| 19 | 0.24 | 0.85 | 0.59 | 0.61 | 0.50 | 0.85 | 0.34 |
| 20 | 0.12 | 0.10 | 0.09 | 0.12 | 0.11 | 0.10 | 0.08 |
| 21 | 0.58 | 0.40 | 0.43 | 0.45 | 0.42 | 0.40 | 0.38 |
| 22 | 1.51 | 1.19 | 1.16 | 1.30 | 1.22 | 1.21 | 1.09 |
| 23 | 0.33 | 0.34 | 0.28 | 0.36 | 0.33 | 0.34 | 0.30 |
| 24 | 22.60 | 23.20 | 17.30 | 27.00 | 24.70 | 22.60 | 16.80 |
| 25 | 0.54 | 0.70 | 0.85 | 0.79 | 0.62 | 0.62 | 0.63 |
| 26 | 4.00 | 20.50 | 21.90 | 13.20 | 6.90 | 19.80 | 10.80 |
| 27 | 0.28 | 1.58 | 1.39 | 1.36 | 0.67 | 0.86 | 1.51 |
| 28 | 37.00 | 32.40 | 20.80 | 35.20 | 37.40 | 41.00 | 29.30 |
| 29 | 433.90 | 425.10 | 285.10 | 479.20 | 478.10 | 528.20 | 401.20 |
| 30 | 77.80 | 90.20 | 119.00 | 107.00 | 83.80 | 84.00 | 113.30 |
| 31 | 650.1 | 790.9 | 1167.9 | 1008.4 | 719.0 | 721.1 | 1091.8 |
| 32 | 112.60 | 148.80 | 149.20 | 152.20 | 148.70 | 121.30 | 152.00 |
| 33 | 1078.8 | 1581.4 | 1588.7 | 1630.5 | 1580.2 | 1198.4 | 1628.1 |
| 34 | 76.00 | 87.20 | NA | 102.00 | 75.20 | 79.00 | 102.00 |
| 35 | 630.50 | 756.10 | NA | 945.20 | 621.20 | 663.50 | 945.20 |
| 36 | 1084.0 | 1216.0 | 1453.0 | 1487.5 | 1197.2 | 1122.6 | 1493.0 |
| 37 | 0.00 | 0.06 | 0.15 | 0.13 | 0.18 | 0.10 | 0.12 |
| 38 | 0.17 | 0.58 | 0.55 | 0.32 | 0.23 | 0.04 | 0.13 |
| 39 | 0.17 | 0.30 | 0.06 | 0.18 | 0.17 | 0.29 | 0.15 |
| 40 | 0.41 | 0.49 | 0.13 | 0.31 | 0.48 | 0.44 | 0.32 |
| 41 | 1.04 | 1.40 | 0.95 | 1.00 | 1.32 | 1.26 | 1.43 |
| 42 | 24.70 | 80.70 | 52.20 | 75.00 | 62.50 | 46.60 | 79.50 |
| 43 | 17500.0 | 22300.0 | 14750.0 | 11450.0 | 24700.0 | 21250.0 | 18694.4 |
| 44 | 1.43 | 2.93 | 1.70 | 2.23 | 3.27 | 2.13 | 1.94 |
| 45 | 26.00 | 108.50 | 292.90 | 232.70 | 72.50 | 68.40 | 233.20 |
| 46 | 0.06 | 0.17 | 0.42 | 0.25 | 0.13 | 0.11 | 0.25 |
| 47 | 19.20 | 96.50 | 278.50 | 197.10 | 63.70 | 58.10 | 209.20 |
| 48 | 0.03 | 0.07 | 0.47 | 0.18 | 0.06 | 0.08 | 0.13 |
| 49 | NA | 89.50 | 95.10 | 92.80 | 67.30 | 80.40 | 72.20 |
| 50 | NA | 0.18 | 0.15 | 0.21 | 0.18 | 0.20 | 0.17 |
| 51 | −13.47 | −12.83 | −12.99 | −13.38 | −12.59 | −13.14 | NA |
| 52 | NA | 29.50 | 31.40 | 28.70 | 29.80 | 29.70 | 29.50 |
| 53 | 70.20 | 73.20 | 71.10 | 69.70 | 80.10 | 75.60 | 70.60 |
| 54 | 91.50 | 84.00 | 85.90 | 89.00 | 85.50 | 88.00 | 89.70 |
| 55 | 3520.4 | 12434.2 | 18050.2 | 16771.2 | 7915.8 | 8866.2 | 18167.7 |
| 56 | 191.1 | 123.3 | 143.9 | 118.6 | 171.9 | 154.9 | 121.1 |
| 57 | NA | 57.60 | 53.60 | 59.80 | 50.90 | 54.50 | 58.90 |
| 58 | 60.10 | 59.90 | 50.50 | 58.60 | 51.90 | 52.70 | 57.10 |
| 59 | NA | 6.04 | 7.09 | 3.90 | 2.94 | 4.60 | 2.36 |
| 60 | NA | 1.21 | 3.13 | 2.50 | 1.09 | 0.85 | 3.22 |
| 61 | 165.5 | 117.5 | 359.6 | 179.8 | 100.9 | 94.4 | 91.9 |
| 62 | 2.84 | 0.82 | 1.49 | 1.20 | 1.11 | 1.20 | 0.62 |
| 63 | 9.30 | 20.50 | 21.90 | 22.60 | 17.90 | 13.70 | 24.70 |
| 64 | 7.78 | 9.95 | 7.34 | 11.88 | 9.94 | 9.19 | 9.46 |
| 65 | 83.40 | 72.30 | 74.50 | 63.20 | 76.20 | 75.90 | 56.00 |
| 66 | 9480.2 | 21372.2 | 57928.1 | 42021.2 | 15340.9 | 10035.2 | 20685.1 |
| 67 | NA | NA | NA | 55.00 | 54.00 | NA | NA |
| 68 | NA | NA | NA | 0.46 | 0.58 | NA | NA |
| 69 | NA | 1.80 | NA | NA | NA | NA | NA |
| 70 | NA | 1.37 | NA | NA | NA | NA | NA |
| 71 | NA | NA | NA | 0.46 | 0.58 | NA | NA |
| 72 | NA | 1.80 | NA | NA | NA | NA | NA |
| 73 | NA | 1.15 | NA | NA | NA | NA | NA |
| 74 | NA | 26.69 | NA | NA | NA | NA | NA |
| 75 | NA | 88.50 | NA | NA | NA | NA | NA |
| 76 | NA | 0.48 | NA | NA | NA | NA | NA |
| 77 | 8.60 | 36.90 | 25.40 | 26.30 | 14.30 | 36.90 | 16.60 |
| 78 | NA | 1.53 | NA | NA | NA | NA | NA |

Table 163: Provided are the values of each of the parameters (as described above) measured in *Sorghum* accessions ("L" = Line) under normal conditions. Growth conditions are specified in the experimental procedure section.

TABLE 164

Measured parameters in additional *Sorghum* accessions under normal conditions

| L/Corr. ID | L-15 | L-16 | L-17 | L-18 | L-19 | L-20 | L-21 |
|---|---|---|---|---|---|---|---|
| 1 | 731.80 | 609.80 | 378.10 | 470.80 | 291.50 | 496.60 | 611.00 |
| 2 | 48.60 | 33.60 | 20.60 | 37.80 | 20.40 | 38.10 | 37.60 |
| 3 | 33.00 | 29.50 | 14.90 | 22.20 | 8.10 | 29.60 | 30.10 |
| 4 | 23737260 | 25534520 | 19319316 | 12802788 | 14629600 | 16643442 | 31788060 |
| 5 | 1593.50 | 1652.40 | 1092.10 | 1093.50 | 975.90 | 1365.50 | 1909.30 |
| 6 | 43.20 | 43.20 | 18.00 | 31.80 | 13.00 | 37.80 | 32.50 |
| 7 | 365.0 | 389.7 | 195.3 | 321.2 | 175.8 | 366.9 | 267.5 |
| 8 | 9325.6 | 11705.4 | 5959.4 | 5093.2 | 4119.5 | 7974.0 | 10851.6 |
| 9 | 0.95 | 0.25 | 5.63 | 10.96 | 5.36 | 5.89 | 1.70 |
| 10 | 28.80 | 39.40 | 20.50 | 19.30 | 18.40 | 27.80 | 36.20 |
| 11 | 1.57 | 1.20 | 0.81 | 0.94 | 0.53 | 1.07 | 1.31 |
| 12 | 0.26 | 0.45 | 0.27 | 0.79 | 0.41 | 0.26 | 0.56 |
| 13 | 0.28 | 0.25 | 0.27 | 0.45 | 0.28 | 0.28 | 0.28 |
| 14 | 0.23 | 0.40 | 0.24 | 0.72 | 0.34 | 0.21 | 0.51 |
| 15 | 0.01 | 0.01 | 0.02 | 0.03 | 0.02 | 0.01 | 0.02 |
| 16 | 82.00 | 106.10 | 129.30 | 86.30 | 83.30 | 114.00 | 90.00 |
| 17 | 17.10 | 21.40 | 28.70 | 21.30 | 17.50 | 23.90 | 26.00 |
| 18 | 6.07 | 6.26 | 5.58 | 4.88 | 5.87 | 5.95 | 4.27 |
| 19 | 0.86 | 0.76 | 0.65 | 0.60 | 0.62 | 0.52 | 0.72 |
| 20 | 0.12 | 0.12 | 0.08 | 0.15 | 0.09 | 0.12 | 0.09 |
| 21 | 0.43 | 0.44 | 0.39 | 0.51 | 0.44 | 0.43 | 0.39 |
| 22 | 1.31 | 1.29 | 1.11 | 1.46 | 1.20 | 1.31 | 1.13 |
| 23 | 0.38 | 0.36 | 0.30 | 0.39 | 0.30 | 0.37 | 0.31 |
| 24 | 28.20 | 21.80 | 16.90 | 37.00 | 18.20 | 28.80 | 17.40 |
| 25 | 0.96 | 0.87 | 0.69 | 1.13 | 0.64 | 0.92 | 0.78 |
| 26 | 25.20 | 24.20 | 14.90 | 15.90 | 10.40 | 16.40 | 27.20 |
| 27 | 1.50 | 1.72 | 0.81 | 1.45 | 0.63 | 1.52 | 1.50 |
| 28 | 29.00 | 25.20 | 26.20 | 29.80 | 29.80 | 29.80 | 23.20 |
| 29 | 364.00 | 331.60 | 341.90 | 390.90 | 395.40 | 385.10 | 303.80 |
| 30 | 84.60 | 98.00 | 90.60 | 94.20 | 101.80 | 88.20 | 94.40 |
| 31 | 728.40 | 892.50 | 795.50 | 843.10 | 940.90 | 769.50 | 845.00 |
| 32 | 124.60 | NA | NA | 152.00 | 146.50 | NA | 137.00 |
| 33 | 1242.8 | NA | NA | 1628.1 | 1548.8 | NA | 1412.0 |
| 34 | 82.00 | 95.00 | 84.60 | 87.20 | 98.00 | 78.20 | 88.00 |
| 35 | 697.4 | 853.2 | 728.4 | 755.8 | 892.4 | 655.2 | 763.8 |
| 36 | 1092.4 | 1224.0 | 1137.4 | 1234.0 | 1336.3 | 1154.5 | 1148.8 |
| 37 | 0.19 | 0.23 | 0.25 | 0.04 | 0.17 | 0.02 | 0.15 |
| 38 | 0.14 | 0.21 | 0.27 | 0.24 | 0.30 | 0.14 | 0.04 |
| 39 | 0.32 | 0.32 | 0.19 | 0.18 | 0.11 | 0.35 | 0.26 |
| 40 | 0.47 | 0.52 | 0.30 | 0.33 | 0.28 | 0.51 | 0.35 |
| 41 | 1.09 | 1.00 | 1.24 | 1.53 | 2.06 | 1.03 | 1.12 |
| 42 | 61.10 | 65.20 | 36.50 | 73.30 | 43.40 | 69.60 | 45.40 |
| 43 | 19607.1 | 18300.0 | 23150.0 | 22687.5 | 43348.2 | 14873.5 | 18625.7 |
| 44 | 1.80 | 1.37 | 1.89 | 4.50 | 5.12 | 2.70 | 1.10 |
| 45 | 74.40 | 153.10 | 81.30 | 258.10 | 151.90 | 76.80 | 187.00 |
| 46 | 0.13 | 0.13 | 0.13 | 0.23 | 0.16 | 0.13 | 0.13 |
| 47 | 64.80 | 139.00 | 73.60 | 233.40 | 127.80 | 63.30 | 170.40 |
| 48 | 0.08 | 0.06 | 0.05 | 0.14 | 0.13 | 0.06 | 0.08 |
| 49 | 72.70 | 66.30 | 90.90 | 68.50 | 93.00 | 62.20 | 85.50 |
| 50 | 0.17 | 0.20 | 0.14 | 0.21 | 0.16 | 0.20 | 0.19 |
| 51 | −12.99 | −12.73 | −13.15 | −13.29 | −13.00 | −13.19 | −12.82 |
| 52 | 31.30 | 31.20 | 30.20 | 30.90 | 28.90 | 30.70 | 30.50 |
| 53 | 75.30 | 63.10 | 71.90 | 76.10 | 66.50 | 78.50 | 76.40 |
| 54 | 91.90 | 91.40 | 83.60 | 90.90 | 87.90 | 90.20 | 89.50 |
| 55 | 16019.6 | 20833.0 | 13190.4 | 16299.5 | 12096.8 | 11573.2 | 11655.8 |
| 56 | 179.10 | 183.00 | 159.20 | 157.50 | 111.30 | 163.50 | 142.60 |
| 57 | 52.60 | 49.10 | 53.90 | 61.50 | 51.40 | 51.60 | 47.90 |
| 58 | 54.30 | 49.80 | 54.80 | 61.80 | 54.20 | 55.60 | 51.60 |
| 59 | 3.76 | 3.53 | 6.38 | 3.87 | 3.98 | 3.05 | 4.78 |
| 60 | 1.06 | 2.42 | 0.89 | 3.96 | 1.63 | 1.32 | 2.27 |
| 61 | 110.30 | 74.70 | 122.00 | 113.20 | 166.90 | 74.60 | 86.70 |
| 62 | 1.41 | 0.86 | 0.90 | 1.22 | 1.52 | 0.73 | 0.67 |
| 63 | 16.10 | 20.90 | 16.90 | 22.30 | 16.30 | 19.20 | 19.10 |
| 64 | 8.00 | 11.43 | 7.69 | 12.31 | 6.85 | 10.76 | 7.71 |
| 65 | 82.20 | 54.70 | 76.70 | 48.30 | 62.80 | 81.00 | 29.10 |
| 66 | 12649.4 | 15432.6 | 14500.7 | 26609.8 | 17621.5 | 13556.3 | 12018.1 |
| 67 | 54.00 | NA | NA | NA | NA | 52.00 | 53.00 |
| 68 | 0.49 | NA | NA | NA | NA | 0.81 | 1.10 |
| 69 | NA | NA | NA | NA | NA | NA | NA |
| 70 | NA | NA | NA | NA | NA | NA | NA |
| 71 | 0.49 | NA | NA | NA | NA | 0.81 | 1.10 |
| 72 | NA | NA | NA | NA | NA | NA | NA |
| 73 | NA | NA | NA | NA | NA | NA | NA |
| 74 | NA | NA | NA | NA | NA | NA | NA |

TABLE 164-continued

Measured parameters in additional *Sorghum* accessions under normal conditions

| L/Corr. ID | L-15 | L-16 | L-17 | L-18 | L-19 | L-20 | L-21 |
|---|---|---|---|---|---|---|---|
| 75 | NA | NA | NA | NA | NA | NA | NA |
| 76 | NA | NA | NA | NA | NA | NA | NA |
| 77 | 40.70 | 33.90 | 21.00 | 26.20 | 16.20 | 27.60 | 33.90 |
| 78 | NA | NA | NA | NA | NA | NA | NA |

Table 164: Provided are the values of each of the parameters (as described above) measured in *Sorghum* accessions ("L" = Line) under normal conditions. Growth conditions are specified in the experimental procedure section.

TABLE 165

Measured parameters in additional *Sorghum* accessions under normal conditions

| L/Corr. ID | L-22 | L-23 | L-24 | L-25 | L-26 | L-27 | L-28 |
|---|---|---|---|---|---|---|---|
| 1 | 307.60 | 221.00 | 685.90 | 792.00 | 449.80 | 626.10 | 497.10 |
| 2 | 25.30 | 15.70 | 45.70 | 72.50 | 29.00 | 49.50 | 38.60 |
| 3 | 13.30 | 8.40 | 37.60 | 48.30 | 25.10 | 31.60 | 30.90 |
| 4 | 13130962 | 6653443 | 23933120 | 24881460 | 19456260 | 19639820 | 21045320 |
| 5 | 1029.3 | 672.3 | 1909.6 | 2673.4 | 1325.1 | 1602.3 | 1551.0 |
| 6 | 16.80 | 17.50 | 62.20 | 89.30 | 30.00 | 46.80 | 33.50 |
| 7 | 141.20 | 216.40 | 606.60 | 840.50 | 314.90 | 366.90 | 432.60 |
| 8 | 4537.2 | 3438.6 | 13794.6 | 18913.2 | 8352.6 | 9475.8 | 8627.8 |
| 9 | 4.10 | 1.83 | NA | 5.05 | 1.25 | NA | NA |
| 10 | 20.60 | 11.50 | 44.00 | 53.30 | 25.10 | 31.30 | 26.60 |
| 11 | 0.66 | 0.39 | 1.22 | 1.62 | 0.96 | 1.25 | 1.07 |
| 12 | 0.24 | 0.72 | 0.63 | 0.46 | 0.25 | NA | 0.28 |
| 13 | 0.15 | 0.44 | 0.53 | 0.49 | 0.25 | 0.35 | 0.27 |
| 14 | 0.20 | 0.65 | 0.59 | 0.41 | 0.20 | NA | 0.21 |
| 15 | 0.01 | 0.04 | 0.04 | 0.02 | 0.01 | 0.02 | 0.01 |
| 16 | 55.00 | 200.50 | 136.50 | 192.10 | 85.90 | 119.30 | 151.30 |
| 17 | 19.50 | 25.70 | 25.30 | 23.70 | 20.50 | 24.80 | 27.10 |
| 18 | 3.47 | 9.32 | 6.83 | 10.25 | 5.17 | 6.12 | 7.02 |
| 19 | 0.36 | 0.42 | 0.98 | 0.90 | 0.64 | 0.75 | 0.83 |
| 20 | 0.10 | 0.13 | 0.12 | 0.13 | 0.10 | 0.13 | 0.11 |
| 21 | 0.43 | 0.48 | 0.46 | 0.47 | 0.41 | 0.44 | 0.44 |
| 22 | 1.23 | 1.40 | 1.31 | 1.37 | 1.22 | 1.34 | 1.27 |
| 23 | 0.33 | 0.38 | 0.34 | 0.38 | 0.34 | 0.38 | 0.35 |
| 24 | 21.40 | 28.00 | 27.00 | 29.00 | 20.90 | 29.40 | 22.50 |
| 25 | 0.53 | 0.84 | 1.05 | 0.94 | 0.64 | 1.42 | 0.75 |
| 26 | 7.60 | 6.50 | 27.80 | 25.60 | 14.00 | 30.60 | 17.40 |
| 27 | 0.51 | 0.58 | 2.50 | 2.90 | 0.92 | 2.42 | 1.17 |
| 28 | 40.60 | 35.20 | 25.00 | 31.60 | 33.00 | 20.40 | 28.60 |
| 29 | 500.30 | 476.60 | 343.10 | 415.10 | 423.70 | 268.10 | 363.80 |
| 30 | 74.40 | 106.00 | 115.20 | 89.60 | 85.40 | 102.00 | 86.20 |
| 31 | 611.90 | 996.10 | 1115.40 | 782.10 | 736.10 | 945.20 | 745.50 |
| 32 | NA | 148.60 | 143.00 | 132.00 | NA | 150.80 | 113.00 |
| 33 | NA | 1579.1 | 1498.6 | 1343.5 | NA | 1610.7 | 1084.0 |
| 34 | 67.80 | 102.00 | 102.00 | 85.80 | 81.60 | 97.00 | 83.00 |
| 35 | 530.20 | 945.20 | 945.20 | 740.60 | 693.30 | 879.20 | 709.00 |
| 36 | 1112.2 | 1472.8 | 1458.5 | 1197.2 | 1159.8 | 1213.4 | 1109.2 |
| 37 | 0.04 | 0.13 | 0.25 | 0.13 | 0.11 | 0.33 | 0.08 |
| 38 | 0.06 | 0.41 | 0.79 | 0.19 | 0.15 | 0.64 | 0.14 |
| 39 | 0.27 | 0.08 | 0.17 | 0.37 | 0.25 | 0.24 | 0.25 |
| 40 | 0.42 | 0.20 | 0.34 | 0.59 | 0.45 | 0.36 | 0.59 |
| 41 | 1.82 | 2.18 | 1.06 | 1.29 | 1.02 | 1.44 | 1.14 |
| 42 | 28.40 | 47.40 | 101.10 | 142.90 | 53.40 | 63.50 | 72.10 |
| 43 | 22218.2 | 27333.3 | 15850.0 | 13892.9 | 16300.0 | 17150.0 | 14650.0 |
| 44 | 3.50 | 4.83 | 1.00 | 1.20 | 2.07 | 1.20 | 1.00 |
| 45 | 49.90 | 292.60 | 293.90 | 134.60 | 70.70 | NA | 81.50 |
| 46 | 0.07 | 0.25 | 0.30 | 0.24 | 0.12 | 0.18 | 0.12 |
| 47 | 41.30 | 265.00 | 276.40 | 119.10 | 55.60 | NA | 61.20 |
| 48 | 0.06 | 0.23 | 0.22 | 0.09 | 0.06 | 0.15 | 0.09 |
| 49 | 76.00 | 92.10 | 88.40 | 62.20 | 54.70 | 94.40 | 57.50 |
| 50 | NA | 0.16 | 0.18 | 0.15 | 0.15 | 0.17 | 0.18 |
| 51 | −12.72 | −13.08 | −12.41 | −13.14 | −12.83 | −12.68 | −13.00 |
| 52 | 28.60 | 29.20 | 28.60 | 30.00 | 31.50 | 31.70 | 31.50 |
| 53 | NA | 67.30 | 70.00 | 68.20 | 72.90 | 67.30 | 76.10 |
| 54 | 94.60 | 88.70 | 89.20 | 89.30 | 90.50 | 91.90 | 91.30 |
| 55 | 6785.6 | 14171.8 | 21989.2 | 13038.2 | 10639.6 | NA | 14682.2 |
| 56 | 166.90 | 108.40 | 139.90 | 164.90 | 164.40 | NA | 156.70 |

TABLE 165-continued

Measured parameters in additional *Sorghum* accessions under normal conditions

| L/Corr. ID | L-22 | L-23 | L-24 | L-25 | L-26 | L-27 | L-28 |
|---|---|---|---|---|---|---|---|
| 57 | 52.70 | 54.70 | 52.50 | 57.70 | 53.50 | 50.20 | 54.90 |
| 58 | 47.20 | 56.00 | 52.40 | 57.60 | 56.60 | 52.30 | 54.40 |
| 59 | 3.56 | 4.34 | 3.26 | 2.88 | 2.37 | 7.28 | 2.81 |
| 60 | 0.66 | 3.19 | 3.36 | 2.57 | 1.45 | NA | 1.45 |
| 61 | 79.20 | 187.20 | 241.50 | 134.70 | 54.80 | 135.40 | 85.30 |
| 62 | 0.97 | 1.15 | 1.12 | 1.60 | 0.78 | 0.97 | 0.87 |
| 63 | 15.00 | 20.30 | 21.90 | 18.90 | 18.90 | 23.20 | 22.00 |
| 64 | 8.24 | 8.41 | 11.43 | 10.41 | 9.62 | 11.29 | 11.57 |
| 65 | NA | 57.30 | 68.50 | 53.50 | 79.60 | NA | 84.60 |
| 66 | 8397.1 | 28819.2 | 52862.1 | 23299.4 | 8716.9 | NA | 18934.9 |
| 67 | NA | 52.00 | NA | NA | NA | NA | 52.00 |
| 68 | NA | 1.08 | NA | NA | NA | NA | 0.56 |
| 69 | NA | NA | 1.54 | 1.60 | NA | NA | NA |
| 70 | NA | NA | 1.86 | 1.65 | NA | NA | NA |
| 71 | NA | 1.08 | NA | NA | NA | NA | 0.56 |
| 72 | NA | NA | 0.80 | 1.29 | NA | NA | NA |
| 73 | NA | NA | 0.41 | 0.83 | NA | NA | NA |
| 74 | NA | NA | 35.13 | 39.99 | NA | NA | NA |
| 75 | NA | NA | 169.70 | 105.90 | NA | NA | NA |
| 76 | NA | NA | 0.54 | 0.64 | NA | NA | NA |
| 77 | 17.10 | 12.30 | 38.10 | 44.00 | 25.00 | 34.80 | 27.60 |
| 78 | NA | NA | 1.21 | 1.09 | NA | NA | NA |

Table 165: Provided are the values of each of the parameters (as described above) measured in *Sorghum* accessions ("L" = Line) under normal conditions. Growth conditions are specified in the experimental procedure section.

TABLE 166

Measured parameters in additional *Sorghum* accessions under normal conditions

| Line/Corr. ID | Line-29 | Line-30 | Line-31 | Line-32 | Line-33 | Line-34 | Line-35 | Line-36 |
|---|---|---|---|---|---|---|---|---|
| 1 | 693.90 | 663.00 | 668.80 | 861.90 | 904.60 | 757.30 | 874.20 | 653.20 |
| 2 | 45.90 | 43.30 | 39.80 | 69.80 | 64.30 | 56.90 | 56.40 | 45.00 |
| 3 | 35.50 | 35.60 | 30.00 | 56.00 | 52.70 | 46.20 | 48.70 | 27.20 |
| 4 | 25439325 | 22595225 | 23516220 | 35903040 | 35910300 | 30637940 | 37887500 | 22720400 |
| 5 | 1803.8 | 1356.6 | 1506.4 | 2934.8 | 2997.3 | 2366.6 | 2463.5 | 1855.1 |
| 6 | 50.80 | 34.00 | 40.90 | 65.70 | 79.80 | 57.30 | 62.70 | 56.60 |
| 7 | 439.60 | 323.70 | 352.50 | 607.50 | 735.20 | 525.20 | 556.20 | 485.10 |
| 8 | 11785.0 | 7149.5 | 9080.2 | 17551.0 | 15911.0 | 14725.2 | 13484.6 | 12126.6 |
| 9 | 0.55 | 0.41 | 6.98 | 3.44 | 6.65 | 1.21 | NA | 7.50 |
| 10 | 38.00 | 22.00 | 32.70 | 54.30 | 58.90 | 46.10 | 50.50 | 39.90 |
| 11 | 1.49 | 1.42 | 1.44 | 1.74 | 1.81 | 1.52 | 1.77 | 1.29 |
| 12 | 0.33 | 0.27 | 0.29 | 1.23 | 1.10 | 0.81 | 0.48 | 0.75 |
| 13 | 0.30 | 0.24 | 0.27 | 0.51 | 0.46 | 0.40 | 0.40 | 0.79 |
| 14 | 0.26 | 0.21 | 0.24 | 1.14 | 0.97 | 0.76 | 0.41 | 0.67 |
| 15 | 0.01 | 0.01 | 0.01 | 0.03 | 0.02 | 0.02 | 0.02 | 0.06 |
| 16 | 115.10 | 141.70 | 99.00 | 174.10 | 245.30 | 195.00 | 180.40 | 136.00 |
| 17 | 24.10 | 29.90 | 22.90 | 32.20 | 37.50 | 33.00 | 34.30 | 25.10 |
| 18 | 5.96 | 5.97 | 5.43 | 6.68 | 8.27 | 7.74 | 6.56 | 6.78 |
| 19 | 0.82 | 0.81 | 0.85 | 1.03 | 1.01 | 0.97 | 1.14 | 0.79 |
| 20 | 0.11 | 0.12 | 0.11 | 0.10 | 0.11 | 0.11 | 0.10 | 0.12 |
| 21 | 0.42 | 0.45 | 0.43 | 0.41 | 0.43 | 0.42 | 0.41 | 0.45 |
| 22 | 1.25 | 1.32 | 1.26 | 1.21 | 1.27 | 1.25 | 1.22 | 1.30 |
| 23 | 0.35 | 0.36 | 0.35 | 0.34 | 0.36 | 0.36 | 0.34 | 0.35 |
| 24 | 25.90 | 28.40 | 26.80 | 21.80 | 25.40 | 23.50 | 22.60 | 28.30 |
| 25 | 0.59 | 0.63 | 0.63 | 0.82 | 0.70 | 0.75 | 0.71 | 0.79 |
| 26 | 16.30 | 15.60 | 16.50 | 32.20 | 27.40 | 25.10 | 27.80 | 20.00 |
| 27 | 1.20 | 0.80 | 1.12 | 2.50 | 2.40 | 1.92 | 2.01 | 1.84 |
| 28 | 42.50 | 42.50 | 40.20 | 26.80 | 32.50 | 30.00 | 31.40 | 33.40 |
| 29 | 525.90 | 525.90 | 493.60 | 351.90 | 425.10 | 394.90 | 413.20 | 438.20 |
| 30 | 74.0 | 74.0 | 74.0 | 94.0 | 88.5 | 93.0 | 90.0 | 92.0 |
| 31 | 607.2 | 607.2 | 607.2 | 840.0 | 769.5 | 826.6 | 786.8 | 814.0 |
| 32 | NA | NA | NA | 146.20 | NA | NA | NA | 141.30 |
| 33 | NA | NA | NA | 1544.8 | NA | NA | NA | 1473.8 |
| 34 | 69.70 | 68.50 | 70.50 | 88.50 | 83.50 | 87.20 | 87.20 | 88.40 |
| 35 | 563.90 | 537.20 | 591.00 | 769.50 | 715.10 | 756.10 | 756.10 | 768.40 |
| 36 | 1133.1 | 1133.1 | 1100.8 | 1191.9 | 1194.6 | 1221.5 | 1200.0 | 1252.2 |
| 37 | 0.09 | 0.13 | 0.30 | 0.17 | 0.03 | 0.09 | 0.24 | 0.13 |
| 38 | 0.00 | 0.02 | 0.17 | 0.26 | 0.12 | 0.15 | 0.23 | 0.26 |

TABLE 166-continued

Measured parameters in additional *Sorghum* accessions under normal conditions

| Line/Corr. ID | Line-29 | Line-30 | Line-31 | Line-32 | Line-33 | Line-34 | Line-35 | Line-36 |
|---|---|---|---|---|---|---|---|---|
| 39 | 0.36 | 0.35 | 0.32 | 0.28 | 0.31 | 0.31 | 0.31 | 0.14 |
| 40 | 0.55 | 0.58 | 0.55 | 0.47 | 0.56 | 0.46 | 0.47 | 0.22 |
| 41 | 1.15 | 1.12 | 1.22 | 1.06 | 1.14 | 1.10 | 1.00 | 1.46 |
| 42 | 77.50 | 56.50 | 69.50 | 105.00 | 154.70 | 87.90 | 92.70 | 88.90 |
| 43 | 19875.0 | 17979.2 | 21600.0 | 14064.3 | 16583.3 | 15400.0 | 16500.0 | 21250.0 |
| 44 | 3.58 | 3.54 | 2.89 | 2.17 | 1.00 | 1.07 | 1.13 | 2.73 |
| 45 | 68.20 | 56.00 | 59.00 | 403.10 | 323.40 | 264.50 | 140.90 | 231.10 |
| 46 | 0.14 | 0.11 | 0.13 | 0.25 | 0.23 | 0.20 | 0.20 | 0.40 |
| 47 | 53.30 | 43.80 | 49.10 | 373.50 | 285.50 | 247.50 | 121.90 | 206.50 |
| 48 | 0.06 | 0.06 | 0.07 | 0.13 | 0.07 | 0.08 | 0.08 | 0.28 |
| 49 | 85.80 | 88.80 | 92.60 | 87.30 | 81.60 | 90.10 | 66.20 | 82.30 |
| 50 | NA | NA | NA | 0.21 | 0.19 | 0.17 | 0.17 | 0.16 |
| 51 | −13.36 | −13.00 | −13.07 | −12.85 | NA | −12.56 | −12.79 | −13.14 |
| 52 | 28.60 | 29.00 | 28.00 | 30.10 | 30.50 | 30.10 | 30.00 | 30.00 |
| 53 | NA | NA | NA | 52.60 | 44.30 | 35.40 | 75.10 | 66.00 |
| 54 | 92.40 | 91.80 | 91.40 | 87.20 | 87.90 | 85.70 | 90.90 | 92.50 |
| 55 | 10885.2 | 9702.0 | 12009.2 | 20599.4 | 16039.2 | 17728.8 | 17360.8 | 15975.6 |
| 56 | 173.3 | 151.9 | 167.2 | 104.0 | 82.3 | 66.9 | 172.6 | 131.3 |
| 57 | 53.90 | 60.10 | 51.10 | 49.70 | 57.00 | 55.10 | 53.90 | 53.90 |
| 58 | 51.50 | 54.70 | 50.50 | 54.40 | 55.80 | 53.60 | 52.80 | 55.70 |
| 59 | 4.77 | 4.96 | 5.75 | 6.06 | 5.25 | 6.68 | 3.39 | 4.76 |
| 60 | 0.81 | 0.64 | 0.63 | 4.94 | 4.05 | 3.01 | 2.10 | 2.89 |
| 61 | 97.7 | 91.5 | 114.6 | 139.0 | 90.8 | 108.8 | 120.7 | 244.8 |
| 62 | 1.02 | 0.96 | 0.98 | 0.84 | 1.12 | 0.88 | 0.94 | 1.78 |
| 63 | 17.40 | 16.60 | 15.10 | 21.60 | 20.60 | 19.40 | 15.70 | 20.90 |
| 64 | 10.10 | 8.91 | 8.77 | 10.07 | 11.50 | 8.81 | 8.56 | 10.10 |
| 65 | NA | NA | NA | 20.60 | 38.00 | 37.40 | 70.10 | 66.70 |
| 66 | 14471.9 | 11682.4 | 12897.2 | 27195.9 | 18515.8 | 16533.5 | 14367.4 | 45771.7 |
| 67 | NA | NA | NA | NA | NA | NA | NA | NA |
| 68 | NA | NA | NA | NA | NA | NA | NA | NA |
| 69 | NA | NA | 1.84 | NA | NA | 1.56 | NA | 1.84 |
| 70 | NA | NA | 1.93 | NA | NA | 1.70 | NA | 2.05 |
| 71 | NA | NA | NA | NA | NA | NA | NA | NA |
| 72 | NA | NA | 1.32 | NA | NA | 1.24 | NA | 1.34 |
| 73 | NA | NA | 0.97 | NA | NA | 1.23 | NA | 0.63 |
| 74 | NA | NA | 32.59 | NA | NA | 26.71 | NA | 19.84 |
| 75 | NA | NA | 91.40 | NA | NA | 88.60 | NA | 129.50 |
| 76 | NA | NA | 0.60 | NA | NA | 0.42 | NA | 0.37 |
| 77 | 38.60 | 36.80 | 37.20 | 47.90 | 50.30 | 42.10 | 48.60 | 36.30 |
| 78 | NA | NA | 1.26 | NA | NA | 1.48 | NA | 1.75 |

Table 166: Provided are the values of each of the parameters (as described above) measured in *Sorghum* accessions ("L" = Line) under normal conditions. Growth conditions are specified in the experimental procedure section.

TABLE 167

Measured parameters in *Sorghum* accessions under drought conditions

| Line/Corr. ID | Line-1 | Line-2 | Line-3 | Line-4 | Line-5 | Line-6 | Line-7 |
|---|---|---|---|---|---|---|---|
| 1 | 539.6 | 494.0 | 653.6 | 568.3 | 358.4 | 474.7 | 364.6 |
| 2 | 59.20 | 62.70 | 77.50 | 82.60 | 53.30 | 67.10 | 37.90 |
| 3 | 29.00 | 17.00 | 17.30 | 22.30 | 22.50 | 35.40 | 15.80 |
| 4 | 30.40 | 29.00 | 37.90 | 32.90 | 28.80 | 32.30 | 19.80 |
| 5 | 0.04 | 4.85 | 4.64 | 14.19 | 3.06 | 1.15 | 3.18 |
| 6 | 0.71 | 0.62 | 0.72 | 0.63 | 0.49 | 0.55 | 0.57 |
| 7 | 18.00 | 13.80 | 9.50 | 12.50 | 25.50 | 9.70 | 9.90 |
| 8 | −13.41 | −13.02 | −13.38 | −13.46 | −13.87 | −13.37 | −13.37 |
| 9 | 1.94 | 1.92 | 2.48 | 2.11 | 1.39 | 1.85 | 1.37 |
| 10 | 0.04 | 0.04 | 0.04 | 0.03 | 0.03 | 0.02 | 0.04 |
| 11 | 0.06 | 0.06 | 0.06 | 0.05 | 0.05 | 0.04 | 0.06 |
| 12 | 0.94 | 0.63 | 0.53 | 0.50 | 0.85 | 0.37 | 0.58 |
| 13 | 0.83 | 0.54 | 0.47 | 0.42 | 0.70 | 0.31 | 0.53 |
| 14 | 20.60 | 25.60 | 29.80 | 32.10 | 27.30 | 28.40 | 26.70 |
| 15 | 19183840 | 17265920 | 20151620 | 18904060 | 12652968 | 19240800 | 18560870 |
| 16 | 2226.7 | 2367.6 | 2602.6 | 3022.6 | 2051.1 | 2957.7 | 2089.8 |
| 17 | 1096.0 | 998.7 | 1092.3 | 1171.0 | 1082.7 | 1401.9 | 1074.0 |
| 18 | 27.40 | 28.70 | 34.50 | 28.10 | 25.80 | 22.90 | 17.50 |
| 19 | 0.12 | 0.13 | 0.14 | 0.13 | 0.12 | 0.10 | 0.09 |
| 20 | 31.80 | 32.20 | 32.00 | 31.60 | 25.40 | 32.60 | 23.40 |
| 21 | 415.20 | 404.40 | 403.30 | 409.90 | 330.40 | 408.90 | 306.60 |

TABLE 167-continued

Measured parameters in *Sorghum* accessions under drought conditions

| Line/Corr. ID | Line-1 | Line-2 | Line-3 | Line-4 | Line-5 | Line-6 | Line-7 |
|---|---|---|---|---|---|---|---|
| 22 | 17.10 | 15.40 | 20.60 | 17.90 | 14.00 | 14.60 | 15.40 |
| 23 | 0.98 | 1.05 | 1.35 | 1.39 | 1.16 | 1.01 | 0.95 |
| 24 | 102.60 | 79.90 | 82.50 | 78.50 | 72.30 | 72.40 | 81.30 |
| 25 | 130.50 | 114.20 | 114.00 | 122.40 | 114.20 | 126.70 | 121.40 |
| 26 | 1325.2 | 1100.8 | 1098.1 | 1213.0 | 1100.8 | 1274.7 | 1199.2 |
| 27 | 0.27 | 0.40 | 0.25 | 0.23 | 0.57 | 0.12 | 0.26 |
| 28 | 0.48 | 0.69 | 0.63 | 0.65 | 0.65 | 0.50 | 0.41 |
| 29 | 31.20 | 32.40 | 33.10 | 31.80 | 30.90 | 30.90 | 30.60 |
| 30 | 126.90 | 146.60 | 158.10 | 160.70 | 116.80 | 135.80 | 83.80 |
| 31 | 0.15 | 0.13 | 0.14 | 0.13 | 0.13 | 0.19 | 0.11 |
| 32 | 83.20 | 84.30 | 86.90 | 81.70 | 82.80 | 89.50 | 77.50 |
| 33 | 62.90 | NA | 70.90 | 69.20 | 52.30 | 76.80 | 60.80 |
| 34 | 42.90 | 75.70 | 75.80 | 77.10 | 66.00 | 75.80 | 71.40 |
| 35 | 17250.0 | 29257.1 | 36000.0 | 23966.7 | 15250.0 | 12687.5 | 21430.0 |
| 36 | 0.99 | 1.90 | 2.07 | 1.70 | 1.08 | 1.01 | 0.98 |
| 37 | 1.11 | 3.20 | 3.43 | 3.30 | 1.00 | 1.10 | 4.38 |
| 38 | 0.21 | 0.22 | 0.27 | 0.31 | 0.19 | 0.36 | 0.13 |
| 39 | 0.34 | 0.34 | 0.38 | 0.45 | 0.33 | 0.56 | 0.32 |
| 40 | 161.60 | 96.10 | 82.70 | 84.20 | 145.30 | 56.00 | 109.10 |
| 41 | 0.16 | 0.16 | 0.15 | 0.15 | 0.13 | 0.09 | 0.16 |
| 42 | 143.60 | 82.30 | 73.30 | 71.70 | 119.80 | 46.30 | 99.20 |
| 43 | 0.08 | 0.09 | 0.08 | 0.08 | 0.09 | 0.05 | 0.10 |
| 44 | 0.88 | 2.07 | 1.57 | 1.33 | 1.87 | 1.13 | 2.07 |
| 45 | 78.40 | 78.00 | 71.00 | 63.40 | 69.90 | 73.10 | 77.70 |
| 46 | 4.03 | 3.97 | 3.79 | 3.05 | 3.04 | 3.92 | 3.84 |
| 47 | 13806.8 | 10419.0 | 10992.0 | 10397.8 | 10516.7 | 6092.0 | 6199.8 |
| 48 | 48.90 | 43.20 | 42.80 | 42.10 | 35.50 | 47.50 | 35.10 |
| 49 | 52.40 | 49.90 | 45.30 | 50.40 | 43.10 | 51.80 | 45.10 |
| 50 | 53.60 | 49.30 | 47.70 | 51.10 | 42.60 | 54.90 | 45.20 |
| 51 | 2.16 | 1.29 | 1.27 | 1.38 | 2.13 | 0.78 | 1.40 |
| 52 | 18.30 | 14.40 | 14.40 | 19.10 | 16.90 | 14.90 | 14.10 |
| 53 | 9.33 | 9.11 | 7.80 | 10.15 | 9.82 | 8.72 | 7.80 |
| 54 | 13008.3 | 13795.3 | 11883.2 | 22788.4 | 31653.3 | 9740.6 | 19460.1 |
| 55 | 748.20 | 634.90 | 654.40 | 723.50 | 754.20 | 624.80 | 779.10 |
| 56 | 89.60 | 82.60 | 83.40 | 87.40 | 90.60 | 82.20 | 95.00 |
| 57 | 784.80 | 704.90 | 714.20 | 757.60 | 795.50 | 700.40 | 853.20 |
| 58 | 1200.0 | 1109.2 | 1117.5 | 1167.5 | 1125.9 | 1109.2 | 1159.8 |

Table 167: Provided are the values of each of the parameters (as described above) measured in *Sorghum* accessions ("L" = Line) under drought conditions. Growth conditions are specified in the experimental procedure section.

TABLE 168

Measured parameters in additional *Sorghum* accessions under drought conditions

| Line/Corr. ID | Line-8 | Line-9 | Line-10 | Line-11 | Line-12 | Line-13 | Line-14 |
|---|---|---|---|---|---|---|---|
| 1 | 176.2 | 586.8 | 95.0 | 321.5 | 275.9 | 459.7 | 426.1 |
| 2 | 18.80 | 68.60 | 17.50 | 66.30 | 29.80 | 53.90 | 46.40 |
| 3 | 10.80 | 23.20 | 6.60 | 16.70 | 9.50 | 25.80 | 22.20 |
| 4 | 7.80 | 35.20 | 11.30 | 45.20 | 15.00 | 21.30 | 24.20 |
| 5 | 0.49 | 6.89 | NA | 0.84 | 1.12 | 0.37 | 2.20 |
| 6 | 0.27 | 0.71 | 0.23 | 0.35 | 0.44 | 0.57 | 0.59 |
| 7 | 5.90 | 11.10 | 8.50 | 15.90 | 7.90 | 9.90 | 8.60 |
| 8 | −14.20 | −13.15 | −13.42 | −13.62 | −12.78 | −13.56 | −13.12 |
| 9 | 0.64 | 2.23 | 0.29 | 0.95 | 1.07 | 1.79 | 1.66 |
| 10 | 0.01 | 0.03 | 0.10 | 0.04 | 0.02 | 0.02 | 0.02 |
| 11 | 0.01 | 0.05 | 0.11 | 0.06 | 0.03 | 0.04 | 0.03 |
| 12 | 0.18 | 0.56 | 1.18 | 0.87 | 0.43 | 0.41 | 0.38 |
| 13 | 0.13 | 0.50 | 1.15 | 0.81 | 0.37 | 0.35 | 0.33 |
| 14 | 7.70 | 33.20 | NA | 29.50 | 13.30 | 17.00 | 18.50 |
| 15 | 8106154 | 25074700 | 6470276 | 10728240 | 11082880 | 17810750 | 14047538 |
| 16 | 922.6 | 3192.6 | 1275.3 | 2368.5 | 1297.7 | 2280.5 | 1687.8 |
| 17 | 363.4 | 1590.2 | 817.4 | 1579.0 | 630.3 | 898.3 | 875.4 |
| 18 | 21.70 | 21.80 | 12.30 | 28.30 | 23.80 | 23.50 | 27.70 |
| 19 | 0.11 | 0.10 | 0.07 | 0.12 | 0.11 | 0.11 | 0.12 |
| 20 | 37.00 | 28.20 | 18.20 | 28.80 | 37.20 | 30.60 | 29.80 |
| 21 | 453.50 | 369.20 | 193.90 | 391.70 | 469.10 | 384.20 | 374.60 |
| 22 | 4.40 | 20.90 | 4.70 | 10.40 | 7.40 | 14.80 | 14.60 |
| 23 | 0.16 | 1.32 | 0.53 | 1.56 | 0.41 | 0.69 | 0.84 |
| 24 | 188.40 | 128.80 | 80.80 | 114.90 | 78.80 | 70.50 | 54.30 |

TABLE 168-continued

Measured parameters in additional Sorghum accessions under drought conditions

| Line/Corr. ID | Line-8 | Line-9 | Line-10 | Line-11 | Line-12 | Line-13 | Line-14 |
|---|---|---|---|---|---|---|---|
| 25 | 111.80 | 143.20 | 150.00 | 150.60 | 147.20 | 113.00 | 114.00 |
| 26 | 1068.2 | 1501.6 | 1599.4 | 1607.3 | 1558.9 | 1084.0 | 1098.2 |
| 27 | 0.00 | 0.32 | 0.28 | 0.31 | 0.23 | 0.12 | 0.30 |
| 28 | 0.21 | 0.63 | 0.76 | 0.68 | 0.57 | 0.36 | 0.43 |
| 29 | NA | 31.70 | NA | 30.60 | 30.10 | 31.10 | 32.80 |
| 30 | 188.70 | 106.50 | 96.90 | 104.50 | 161.10 | 116.70 | 152.40 |
| 31 | NA | 0.17 | 0.15 | 0.17 | 0.15 | 0.16 | 0.16 |
| 32 | 89.70 | 79.60 | NA | 85.40 | 86.90 | 84.50 | 84.30 |
| 33 | 71.10 | 68.40 | 65.30 | 63.30 | 79.00 | 75.80 | 71.80 |
| 34 | 83.20 | 68.20 | 53.80 | 56.70 | 78.40 | 74.80 | 77.70 |
| 35 | 16700.0 | 23062.5 | 12450.0 | 13300.0 | 29500.0 | 17842.9 | 18812.5 |
| 36 | 1.05 | 1.36 | 0.95 | 1.12 | 1.46 | 1.19 | 1.05 |
| 37 | 1.20 | 2.83 | 1.07 | 1.67 | 3.27 | 2.83 | 2.76 |
| 38 | 0.19 | 0.30 | 0.03 | 0.17 | 0.18 | 0.25 | 0.35 |
| 39 | 0.46 | 0.47 | 0.08 | 0.29 | 0.42 | 0.43 | 0.50 |
| 40 | 22.40 | 96.90 | 398.90 | 209.70 | 61.00 | 63.00 | 61.60 |
| 41 | 0.04 | 0.12 | 0.36 | 0.20 | 0.09 | 0.11 | 0.08 |
| 42 | 16.50 | 85.90 | 390.30 | 193.80 | 53.10 | 53.20 | 53.00 |
| 43 | 0.04 | 0.07 | 0.28 | 0.12 | 0.04 | 0.06 | 0.04 |
| 44 | 2.47 | 0.70 | 1.10 | 1.00 | 0.79 | 1.04 | 0.98 |
| 45 | NA | 91.00 | NA | 81.00 | 70.50 | 79.80 | 75.80 |
| 46 | NA | 6.24 | NA | 3.23 | 3.17 | 4.80 | 3.80 |
| 47 | 2894.0 | 9764.5 | 13474.8 | 14964.6 | 9651.0 | 6615.4 | 10532.6 |
| 48 | 47.10 | 44.60 | 39.30 | 44.20 | 42.00 | 44.40 | 46.40 |
| 49 | NA | 48.80 | NA | 50.90 | 50.80 | 52.00 | 50.60 |
| 50 | 55.50 | 50.80 | NA | 52.80 | 51.50 | 52.90 | 48.40 |
| 51 | NA | 1.06 | NA | 2.55 | 0.93 | 0.80 | 0.82 |
| 52 | 9.00 | 19.90 | 23.10 | 21.70 | 17.50 | 13.40 | 17.20 |
| 53 | 7.24 | 9.32 | 7.96 | 11.01 | 8.58 | 8.32 | 8.27 |
| 54 | 7925.4 | 15390.8 | 46856.1 | 26599.5 | 13234.7 | 8101.3 | 9566.4 |
| 55 | 630.50 | 736.40 | NA | 945.20 | 625.30 | 607.20 | 709.00 |
| 56 | 76.00 | 90.20 | 132.00 | 112.40 | 80.40 | 83.40 | 84.20 |
| 57 | 630.50 | 791.90 | 1343.20 | 1080.70 | 679.60 | 713.90 | 723.50 |
| 58 | 1092.4 | 1161.1 | 1602.8 | 1472.4 | 1148.8 | 1098.1 | 1098.1 |

Table 168: Provided are the values of each of the parameters (as described above) measured in Sorghum accessions ("L" = Line) under drought conditions. Growth conditions are specified in the experimental procedure section.

TABLE 169

Measured parameters in additional Sorghum accessions under drought conditions

| Line/Corr. ID | Line-15 | Line-16 | Line-17 | Line-18 | Line-19 | Line-20 | Line-21 |
|---|---|---|---|---|---|---|---|
| 1 | 267.3 | 312.0 | 289.8 | 124.8 | 507.4 | 430.3 | 254.4 |
| 2 | 39.70 | 34.50 | 56.90 | 15.10 | 73.50 | 52.50 | 48.80 |
| 3 | 18.80 | 14.80 | 12.60 | 4.00 | 34.10 | 23.40 | 13.40 |
| 4 | 23.70 | 16.90 | 31.90 | 7.20 | 36.20 | 27.20 | 19.80 |
| 5 | 2.03 | 2.36 | 2.63 | 1.46 | 4.93 | 0.10 | 1.40 |
| 6 | 0.32 | 0.44 | 0.37 | 0.28 | 0.56 | 0.48 | 0.30 |
| 7 | 12.30 | 9.50 | 37.00 | 10.60 | 12.80 | 20.50 | 7.30 |
| 8 | −13.37 | −13.30 | −13.46 | −13.00 | −13.20 | −13.15 | −13.53 |
| 9 | 0.97 | 1.21 | 1.00 | 0.40 | 1.97 | 1.67 | 0.99 |
| 10 | 0.02 | 0.02 | 0.05 | 0.03 | 0.02 | 0.04 | 0.02 |
| 11 | 0.04 | 0.05 | 0.06 | 0.04 | 0.04 | 0.05 | 0.03 |
| 12 | 0.91 | 0.49 | 1.30 | 0.72 | 0.53 | 1.21 | 0.38 |
| 13 | 0.85 | 0.43 | 1.10 | 0.65 | 0.45 | 1.10 | 0.32 |
| 14 | 21.50 | 18.20 | 16.10 | NA | 27.60 | 30.40 | 18.90 |
| 15 | 10846278 | 15582420 | 8247885 | 6942220 | 18592480 | 21713380 | 10884158 |
| 16 | 1724.4 | 1891.7 | 1683.0 | 927.2 | 2955.1 | 2902.0 | 2221.1 |
| 17 | 1008.7 | 932.2 | 871.4 | 440.9 | 1460.1 | 1489.0 | 836.5 |
| 18 | 23.40 | 17.20 | 36.50 | 15.80 | 24.60 | 17.80 | 21.80 |
| 19 | 0.12 | 0.08 | 0.15 | 0.09 | 0.11 | 0.09 | 0.11 |
| 20 | 23.60 | 28.00 | 30.20 | 23.00 | 32.60 | 22.40 | 40.20 |
| 21 | 309.60 | 365.60 | 397.90 | 311.80 | 413.60 | 291.80 | 493.60 |
| 22 | 11.20 | 11.20 | 9.80 | 6.20 | 15.80 | 19.30 | 6.40 |
| 23 | 1.04 | 0.64 | 1.14 | 0.38 | 1.19 | 1.23 | 0.53 |
| 24 | 65.80 | 120.50 | 84.30 | 59.90 | 117.00 | 73.90 | 60.20 |
| 25 | NA | NA | 143.80 | 148.00 | 131.00 | 114.50 | 116.00 |
| 26 | NA | NA | 1508.4 | 1570.0 | 1332.1 | 1105.0 | 1126.0 |
| 27 | 0.33 | 0.44 | 0.11 | 0.30 | 0.07 | 0.29 | 0.13 |
| 28 | 0.36 | 0.59 | 0.63 | 0.31 | 0.40 | 0.36 | 0.15 |

TABLE 169-continued

Measured parameters in additional *Sorghum* accessions under drought conditions

| Line/Corr. ID | Line-15 | Line-16 | Line-17 | Line-18 | Line-19 | Line-20 | Line-21 |
|---|---|---|---|---|---|---|---|
| 29 | 32.40 | 32.10 | 31.10 | 29.90 | 30.20 | 31.50 | 29.40 |
| 30 | 153.20 | 128.40 | 145.80 | 87.70 | 183.00 | 81.30 | 115.30 |
| 31 | 0.20 | 0.13 | 0.21 | 0.17 | 0.16 | 0.17 | NA |
| 32 | 86.60 | 78.50 | 85.80 | 86.60 | 89.60 | 82.90 | 90.30 |
| 33 | 68.10 | 63.30 | 72.50 | 61.30 | 75.20 | 49.70 | NA |
| 34 | 49.00 | 74.30 | 52.30 | 58.00 | 74.10 | 33.40 | NA |
| 35 | 12750.0 | 19492.9 | 20833.3 | 28978.6 | 14650.0 | 16950.0 | 18229.2 |
| 36 | 0.73 | 1.16 | 1.86 | 1.59 | 1.04 | 1.09 | 1.86 |
| 37 | 2.70 | 1.32 | 4.00 | 3.77 | 2.37 | 1.68 | 4.90 |
| 38 | 0.20 | 0.18 | 0.16 | 0.06 | 0.36 | 0.22 | 0.27 |
| 39 | 0.37 | 0.34 | 0.30 | 0.19 | 0.53 | 0.31 | 0.41 |
| 40 | 179.30 | 82.60 | 240.60 | 171.00 | 81.50 | 219.40 | 47.10 |
| 41 | 0.11 | 0.12 | 0.19 | 0.12 | 0.10 | 0.13 | 0.07 |
| 42 | 167.00 | 73.20 | 203.60 | 152.50 | 68.60 | 198.90 | 39.80 |
| 43 | 0.07 | 0.06 | 0.12 | 0.10 | 0.05 | 0.08 | 0.12 |
| 44 | 0.67 | 0.89 | 0.96 | 1.27 | 0.83 | 0.68 | 0.81 |
| 45 | 63.10 | 82.80 | 61.80 | 91.40 | 69.40 | 78.00 | 73.00 |
| 46 | 2.46 | 4.88 | 2.62 | 3.60 | 3.54 | 4.22 | 3.21 |
| 47 | 15978.1 | 11762.4 | 17356.5 | 13226.2 | 12471.0 | 14010.0 | 4967.2 |
| 48 | 43.80 | 40.10 | 46.70 | 38.40 | 46.00 | 40.70 | 43.00 |
| 49 | 50.10 | 51.10 | 57.50 | 48.80 | 53.70 | 46.70 | 50.20 |
| 50 | 49.10 | 53.90 | 58.40 | NA | 55.60 | 48.50 | 47.70 |
| 51 | 2.78 | 1.01 | 4.23 | 1.88 | 1.18 | 2.79 | 0.64 |
| 52 | 21.80 | 17.40 | 21.60 | 17.50 | 19.10 | 18.90 | 14.30 |
| 53 | 9.99 | 7.64 | 11.80 | 6.58 | 9.75 | 7.26 | 7.54 |
| 54 | 12813.5 | 12286.3 | 19751.0 | 12768.1 | 11089.9 | 9923.7 | 6584.9 |
| 55 | 859.80 | 733.20 | 775.20 | 945.20 | 655.50 | 757.60 | 526.20 |
| 56 | 98.60 | 89.20 | 94.20 | 109.00 | 83.60 | 94.00 | 74.00 |
| 57 | 900.50 | 777.50 | 843.10 | 1032.80 | 715.50 | 840.00 | 607.20 |
| 58 | 1210.0 | 1143.1 | 1241.1 | 1344.5 | 1129.0 | 1131.7 | 1100.8 |

Table 169: Provided are the values of each of the parameters (as described above) measured in *Sorghum* accessions ("L" =Line) under drought conditions. Growth conditions are specified in the experimental procedure section.

TABLE 170

Measured parameters in additional *Sorghum* accessions under drought conditions

| Line/Corr. ID | Line-22 | Line-23 | Line-24 | Line-25 | Line-26 | Line-27 | Line-28 |
|---|---|---|---|---|---|---|---|
| 1 | 73.6 | 443.7 | 475.3 | 346.3 | 243.6 | 317.1 | 537.3 |
| 2 | 7.60 | 66.80 | 86.30 | 54.80 | 38.80 | 53.80 | 97.10 |
| 3 | 6.20 | 28.20 | 33.80 | 21.90 | 11.80 | 21.90 | 32.90 |
| 4 | 3.50 | 40.50 | 45.40 | 29.80 | 16.10 | 28.50 | 41.80 |
| 5 | 0.54 | NA | 0.43 | 1.44 | 9.14 | NA | 3.37 |
| 6 | 0.16 | 0.65 | 0.55 | 0.46 | 0.27 | 0.65 | 0.60 |
| 7 | 17.60 | 14.90 | 32.60 | 10.60 | 17.70 | 20.40 | 18.60 |
| 8 | −13.46 | −13.53 | −13.86 | −13.32 | −13.28 | −12.89 | −13.20 |
| 9 | 0.22 | 1.31 | 1.81 | 1.35 | 0.79 | 1.23 | 2.09 |
| 10 | 0.04 | 0.04 | 0.03 | 0.02 | 0.04 | 0.02 | 0.02 |
| 11 | 0.05 | 0.06 | 0.06 | 0.05 | 0.04 | 0.04 | 0.04 |
| 12 | 0.89 | 0.78 | 0.75 | 0.39 | 0.59 | 0.49 | 0.66 |
| 13 | 0.82 | 0.72 | 0.56 | 0.33 | 0.51 | 0.36 | 0.51 |
| 14 | 4.40 | 32.10 | 35.90 | 26.70 | 18.70 | 26.90 | 35.30 |
| 15 | 2607623 | 15608820 | 16427920 | 14660064 | 8494728 | 15105380 | 19961625 |
| 16 | 344.2 | 2572.2 | 3186.7 | 2510.2 | 1468.4 | 2754.9 | 3990.9 |
| 17 | 130.2 | 1545.9 | 1637.5 | 1351.2 | 533.7 | 1425.0 | 1736.1 |
| 18 | 26.50 | 25.80 | 27.60 | 21.80 | 26.80 | 18.40 | 24.20 |
| 19 | 0.12 | 0.11 | 0.13 | 0.11 | 0.12 | 0.10 | 0.11 |
| 20 | 32.40 | 25.40 | 29.20 | 32.80 | 25.00 | 26.60 | 40.20 |
| 21 | 445.70 | 349.80 | 381.10 | 418.80 | 338.10 | 337.30 | 494.40 |
| 22 | 2.50 | 17.90 | 16.30 | 10.80 | 10.60 | 12.10 | 13.20 |
| 23 | 0.13 | 1.63 | 1.55 | 0.94 | 1.02 | 1.08 | 1.05 |
| 24 | 86.00 | 101.80 | 116.90 | 76.00 | 47.60 | 129.10 | 105.90 |
| 25 | 148.00 | 144.80 | 114.00 | 118.00 | 144.00 | 113.00 | 116.00 |
| 26 | 1570.2 | 1524.0 | 1098.2 | 1154.5 | 1512.2 | 1084.0 | 1126.0 |
| 27 | 0.27 | 0.44 | 0.34 | 0.22 | 0.41 | 0.24 | 0.23 |
| 28 | 0.73 | 0.84 | 0.63 | 0.40 | 0.71 | 0.52 | 0.28 |
| 29 | 31.20 | 29.90 | 31.00 | 31.70 | 31.70 | 31.00 | 28.50 |
| 30 | 96.20 | 113.50 | 107.60 | 144.50 | 93.70 | 143.40 | 122.90 |
| 31 | 0.16 | 0.15 | 0.15 | 0.14 | 0.18 | 0.16 | NA |
| 32 | 87.90 | 87.20 | 75.50 | 85.00 | 89.20 | 86.00 | 90.00 |

TABLE 170-continued

Measured parameters in additional *Sorghum* accessions under drought conditions

| Line/Corr. ID | Line-22 | Line-23 | Line-24 | Line-25 | Line-26 | Line-27 | Line-28 |
|---|---|---|---|---|---|---|---|
| 33 | 61.60 | 68.30 | 52.70 | 73.40 | 58.10 | 72.00 | NA |
| 34 | 55.50 | 58.50 | 61.60 | 74.20 | 63.80 | 80.50 | NA |
| 35 | 20283.3 | 13450.0 | 12802.4 | 14000.0 | 18716.7 | 12750.0 | 16564.1 |
| 36 | 1.49 | 0.92 | 1.17 | 1.05 | 1.15 | 1.01 | 1.79 |
| 37 | 3.80 | 1.03 | 1.14 | 2.17 | 2.07 | 1.00 | 2.83 |
| 38 | 0.03 | 0.18 | 0.31 | 0.30 | 0.14 | 0.21 | 0.38 |
| 39 | 0.11 | 0.35 | 0.54 | 0.49 | 0.21 | 0.60 | 0.58 |
| 40 | 222.30 | 203.20 | 126.70 | 64.40 | 137.20 | 80.30 | 82.20 |
| 41 | 0.15 | 0.21 | 0.15 | 0.13 | 0.14 | 0.11 | 0.12 |
| 42 | 204.70 | 188.30 | 94.10 | 53.80 | 119.50 | 59.90 | 63.60 |
| 43 | 0.18 | 0.12 | 0.06 | 0.05 | 0.11 | 0.09 | 0.06 |
| 44 | 0.88 | 0.70 | 1.42 | 0.74 | 0.80 | 0.82 | 1.13 |
| 45 | 90.70 | 89.30 | 63.40 | 58.70 | 90.30 | 69.30 | 78.50 |
| 46 | 3.53 | 3.44 | 2.71 | 2.40 | 4.57 | 3.54 | 4.24 |
| 47 | 14354.0 | 14782.2 | 9583.3 | 9224.8 | 12185.8 | 11844.8 | 10118.5 |
| 48 | 39.20 | 38.30 | 42.20 | 45.30 | 39.60 | 42.40 | 45.90 |
| 49 | 44.00 | 48.60 | 47.40 | 52.50 | 47.10 | 53.80 | 52.00 |
| 50 | 41.90 | 48.00 | 45.90 | 51.20 | 45.90 | 53.50 | 50.00 |
| 51 | 2.44 | 2.29 | 2.05 | 1.12 | 1.53 | 1.20 | 1.04 |
| 52 | 21.30 | 21.50 | 17.60 | 18.70 | 19.60 | 20.50 | 14.40 |
| 53 | 8.07 | 11.18 | 11.87 | 8.76 | 9.33 | 10.74 | 8.70 |
| 54 | 19859.5 | 29904.1 | 18695.2 | 7513.3 | 15652.7 | 14605.7 | 8278.9 |
| 55 | 854.50 | 945.20 | 734.50 | 688.60 | 801.90 | 709.00 | 607.80 |
| 56 | 113.00 | 116.20 | 88.80 | 84.80 | 107.20 | 86.40 | 74.00 |
| 57 | 1086.50 | 1128.60 | 773.00 | 730.00 | 1010.60 | 746.70 | 607.20 |
| 58 | 1532.2 | 1478.4 | 1154.1 | 1148.8 | 1348.8 | 1084.0 | 1101.6 |

Table 170: Provided are the values of each of the parameters (as described above) measured in *Sorghum* accessions ("L" = Line) under drought conditions. Growth conditions are specified in the experimental procedure section.

TABLE 171

Measured parameters in additional *Sorghum* accessions under drought conditions

| Line/Corr. ID | Line-29 | Line-30 | Line-31 | Line-32 | Line-33 | Line-34 | Line-35 |
|---|---|---|---|---|---|---|---|
| 1 | 542.9 | 561.3 | 582.8 | 506.8 | 712.9 | 625.0 | 397.3 |
| 2 | 107.40 | 67.20 | 101.60 | 98.30 | 110.30 | 99.80 | 54.30 |
| 3 | 32.20 | 32.30 | 39.80 | 41.70 | 45.30 | 43.90 | 17.40 |
| 4 | 42.40 | 36.10 | 56.00 | 54.90 | 48.30 | 39.80 | 26.80 |
| 5 | 13.56 | 16.26 | 4.59 | 4.24 | 2.97 | 3.42 | 2.67 |
| 6 | 0.65 | 0.69 | 0.69 | 0.65 | 0.80 | 0.75 | 0.46 |
| 7 | 11.00 | 11.50 | 22.20 | 49.00 | 13.30 | 32.10 | 12.30 |
| 8 | −13.11 | −13.30 | −13.17 | NA | −12.93 | −12.77 | −13.64 |
| 9 | 2.11 | 2.18 | 2.27 | 1.84 | 2.50 | 2.35 | 1.29 |
| 10 | 0.02 | 0.02 | 0.04 | 0.03 | 0.03 | 0.03 | 0.07 |
| 11 | 0.05 | 0.05 | 0.08 | 0.06 | 0.05 | 0.06 | 0.09 |
| 12 | 0.47 | 0.48 | 1.29 | 1.82 | 1.75 | 1.03 | 1.11 |
| 13 | 0.39 | 0.39 | 1.16 | 1.53 | 1.68 | 0.84 | 1.05 |
| 14 | 37.70 | 25.90 | 52.10 | 46.00 | 41.30 | 35.70 | 24.20 |
| 15 | 18615532 | 21411860 | 25679300 | 23005825 | 29206300 | 27920025 | 15769504 |
| 16 | 4001.9 | 2671.3 | 4808.2 | 4663.8 | 4845.4 | 4510.1 | 2317.9 |
| 17 | 1588.5 | 1445.4 | 2590.2 | 2483.5 | 2041.6 | 1695.7 | 1071.9 |
| 18 | 25.90 | 24.80 | 21.30 | 21.60 | 23.50 | 24.00 | 25.40 |
| 19 | 0.11 | 0.11 | 0.10 | 0.10 | 0.11 | 0.11 | 0.11 |
| 20 | 39.00 | 39.00 | 23.80 | 30.80 | 26.00 | 29.20 | 35.60 |
| 21 | 476.80 | 476.80 | 311.20 | 403.50 | 341.20 | 383.10 | 470.60 |
| 22 | 13.90 | 14.40 | 24.80 | 16.50 | 27.70 | 21.40 | 11.40 |
| 23 | 1.37 | 0.86 | 2.45 | 1.91 | 1.89 | 1.43 | 0.83 |
| 24 | 147.10 | 102.10 | 142.70 | 141.30 | 157.40 | 113.90 | 80.50 |
| 25 | 115.30 | 113.00 | 136.60 | 134.00 | 136.50 | 139.00 | 143.20 |
| 26 | 1116.3 | 1084.0 | 1406.8 | 1369.0 | 1405.5 | 1442.0 | 1501.9 |
| 27 | 0.16 | 0.45 | 0.35 | 0.22 | 0.23 | 0.41 | 0.42 |
| 28 | 0.36 | 0.60 | 0.63 | 0.36 | 0.37 | 0.56 | 0.59 |
| 29 | 29.00 | 29.20 | 32.10 | 31.50 | 30.40 | 34.50 | 31.70 |
| 30 | 90.90 | 109.20 | 130.90 | 121.20 | 100.90 | 133.70 | 113.60 |
| 31 | NA | NA | 0.17 | 0.18 | 0.18 | 0.16 | 0.15 |
| 32 | 91.80 | 90.90 | 76.20 | 80.90 | NA | 81.20 | 81.20 |
| 33 | NA | NA | 69.90 | 66.00 | 52.70 | 69.00 | 63.00 |
| 34 | NA | NA | 31.20 | 25.10 | 33.70 | 63.20 | 61.90 |
| 35 | 15183.3 | 18905.9 | 13300.0 | 10875.0 | 14777.8 | 14000.0 | 23500.0 |

TABLE 171-continued

Measured parameters in additional *Sorghum* accessions under drought conditions

| Line/Corr. ID | Line-29 | Line-30 | Line-31 | Line-32 | Line-33 | Line-34 | Line-35 |
|---|---|---|---|---|---|---|---|
| 36 | 1.70 | 1.09 | 1.13 | 0.96 | 1.32 | 1.04 | 1.58 |
| 37 | 2.17 | 3.11 | 1.50 | 1.62 | 1.11 | 1.71 | 2.90 |
| 38 | 0.35 | 0.32 | 0.27 | 0.33 | 0.32 | 0.29 | 0.12 |
| 39 | 0.61 | 0.56 | 0.45 | 0.54 | 0.47 | 0.44 | 0.20 |
| 40 | 59.10 | 60.00 | 233.70 | 307.30 | 331.20 | 173.50 | 205.70 |
| 41 | 0.14 | 0.12 | 0.19 | 0.18 | 0.16 | 0.16 | 0.28 |
| 42 | 48.10 | 48.40 | 211.60 | 258.30 | 317.90 | 141.40 | 193.40 |
| 43 | 0.07 | 0.06 | 0.11 | 0.06 | 0.10 | 0.09 | 0.15 |
| 44 | 0.96 | 1.05 | 0.89 | 0.86 | 0.82 | 1.04 | 1.57 |
| 45 | 81.10 | 91.20 | 91.30 | 75.60 | 84.80 | 64.80 | 81.80 |
| 46 | 4.09 | 5.58 | 6.10 | 3.94 | 4.91 | 3.23 | 4.00 |
| 47 | 3717.8 | 7510.6 | 15198.4 | 15660.2 | 26643.7 | 16453.5 | 16261.8 |
| 48 | 52.60 | 44.70 | 43.10 | 46.90 | 47.90 | 44.10 | 43.40 |
| 49 | 58.10 | 50.60 | 48.30 | 55.20 | 52.60 | 52.30 | 51.30 |
| 50 | 51.90 | 50.60 | 50.60 | 56.90 | 51.10 | 50.30 | 50.40 |
| 51 | 0.73 | 0.66 | 2.56 | 4.15 | 3.91 | 2.74 | 2.50 |
| 52 | 15.70 | 15.00 | 21.30 | 18.00 | 21.40 | 18.70 | 18.10 |
| 53 | 8.57 | 8.98 | 8.58 | 9.92 | 8.55 | 9.36 | 9.00 |
| 54 | 8487.4 | 10490.7 | 18823.5 | 11730.4 | 13868.6 | 16143.5 | 25029.7 |
| 55 | 534.20 | 563.90 | 775.30 | 727.20 | 779.10 | 753.60 | 761.20 |
| 56 | 74.00 | 74.00 | 93.40 | 89.50 | 95.00 | 89.50 | 93.40 |
| 57 | 607.20 | 607.20 | 831.90 | 781.00 | 853.20 | 781.00 | 831.80 |
| 58 | 1084.0 | 1084.0 | 1143.1 | 1184.5 | 1194.5 | 1164.1 | 1260.6 |

Table 171: Provided are the values of each of the parameters (as described above) measured in *Sorghum* accessions ("L" = Line) under drought conditions. Growth conditions are specified in the experimental procedure section.

TABLE 172

Measured parameters in *Sorghum* accessions under low N conditions

| Line/Corr. ID | Line-1 | Line-2 | Line-3 | Line-4 | Line-5 | Line-6 | Line-7 |
|---|---|---|---|---|---|---|---|
| 1 | 661.80 | 769.50 | 745.20 | 653.30 | 610.10 | 581.20 | 324.50 |
| 2 | 88.10 | 116.00 | 87.40 | 113.00 | 115.00 | 79.50 | 42.20 |
| 3 | 34.20 | 35.10 | 23.10 | 18.80 | 42.80 | 38.90 | 15.00 |
| 4 | 49.90 | 68.30 | 45.80 | 53.90 | 67.00 | 37.50 | 23.10 |
| 5 | 6.43 | 0.79 | 3.96 | 18.90 | 5.83 | 0.14 | 2.18 |
| 6 | 0.87 | 0.88 | 0.82 | 0.74 | 0.69 | 0.67 | 0.51 |
| 7 | 19.60 | 17.30 | 10.00 | 11.70 | 38.70 | 12.40 | 13.70 |
| 8 | −12.78 | −13.11 | −12.99 | −12.83 | −13.05 | −13.44 | −12.96 |
| 9 | 1.28 | 1.65 | 1.60 | 1.33 | 1.31 | 1.25 | 0.70 |
| 10 | 0.02 | 0.03 | 0.03 | 0.03 | 0.03 | 0.02 | 0.03 |
| 11 | 0.04 | 0.05 | 0.05 | 0.05 | 0.06 | 0.03 | 0.04 |
| 12 | 0.55 | 0.36 | 0.33 | 0.31 | 0.64 | 0.24 | 0.41 |
| 13 | 0.48 | 0.30 | 0.29 | 0.27 | 0.52 | 0.20 | 0.37 |
| 14 | 32.70 | 43.50 | 30.90 | 52.10 | 57.20 | 29.50 | 25.50 |
| 15 | 22070840 | 24438020 | 21504340 | 21499680 | 20685020 | 21825800 | 16454200 |
| 16 | 3110.70 | 3929.40 | 2654.60 | 3987.60 | 4127.20 | 3314.90 | 2216.50 |
| 17 | 1700.30 | 2239.10 | 1281.70 | 1754.20 | 2275.70 | 1569.70 | 1123.20 |
| 18 | 29.80 | 30.60 | 35.40 | 30.70 | 29.20 | 23.40 | 20.10 |
| 19 | 0.12 | 0.13 | 0.13 | 0.13 | 0.13 | 0.10 | 0.09 |
| 20 | 33.80 | 29.60 | 35.00 | 28.50 | 26.20 | 33.60 | 21.80 |
| 21 | 444.50 | 380.40 | 439.60 | 373.50 | 273.30 | 428.10 | 285.10 |
| 22 | 20.00 | 26.20 | 21.50 | 21.70 | 22.00 | 16.90 | 14.80 |
| 23 | 1.57 | 2.35 | 1.43 | 2.43 | 2.86 | 1.14 | 1.15 |
| 24 | 135.40 | 108.30 | 102.80 | 108.10 | 134.00 | 94.10 | 97.70 |
| 25 | 139.00 | 117.00 | 122.60 | 133.00 | 115.20 | NA | 126.40 |
| 26 | 1442.00 | 1139.80 | 1215.20 | 1357.90 | 1115.50 | NA | 1266.70 |
| 27 | 0.15 | 0.20 | 0.12 | 0.14 | 0.29 | 0.06 | 0.10 |
| 28 | 0.30 | 0.18 | 0.09 | 0.30 | 0.32 | 0.05 | 0.28 |
| 29 | 30.80 | 29.20 | 30.90 | 30.30 | 29.00 | 30.30 | 29.40 |
| 30 | 155.10 | 162.50 | 161.90 | 181.40 | 148.30 | 144.10 | 100.30 |
| 31 | 0.18 | 0.15 | 0.15 | 0.13 | 0.14 | 0.20 | 0.15 |
| 32 | 91.30 | 90.90 | 91.30 | 87.30 | 89.60 | 87.10 | 84.60 |
| 33 | 70.50 | NA | 71.90 | 71.80 | 61.30 | 76.60 | 65.10 |
| 34 | 49.70 | 81.60 | 76.10 | 78.00 | 60.20 | 79.40 | 72.60 |
| 35 | 19050.00 | 19500.00 | 30600.00 | 29007.10 | 13250.00 | 14125.00 | 19550.00 |
| 36 | 1.15 | 1.35 | 1.64 | 2.16 | 0.99 | 1.13 | 1.15 |
| 37 | 1.14 | 2.23 | 5.03 | 2.20 | 1.10 | 2.79 | 3.00 |
| 38 | 0.24 | 0.28 | 0.25 | 0.29 | 0.27 | 0.30 | 0.13 |

TABLE 172-continued

Measured parameters in Sorghum accessions under low N conditions

| Line/Corr. ID | Line-1 | Line-2 | Line-3 | Line-4 | Line-5 | Line-6 | Line-7 |
|---|---|---|---|---|---|---|---|
| 39 | 0.42 | 0.41 | 0.36 | 0.41 | 0.39 | 0.45 | 0.31 |
| 40 | 166.00 | 103.70 | 85.70 | 90.80 | 205.70 | 66.70 | 138.30 |
| 41 | 0.20 | 0.23 | 0.21 | 0.24 | 0.26 | 0.13 | 0.18 |
| 42 | 146.50 | 86.40 | 75.70 | 79.10 | 167.00 | 54.20 | 124.60 |
| 43 | 0.11 | 0.11 | 0.10 | 0.08 | 0.10 | 0.09 | 0.13 |
| 44 | 0.90 | 2.18 | 1.92 | 1.48 | 2.09 | 1.37 | 2.05 |
| 45 | 71.00 | 80.80 | 71.10 | 62.90 | 65.10 | 74.30 | 83.10 |
| 46 | 3.95 | 4.10 | 3.36 | 3.02 | 2.14 | 3.82 | 4.35 |
| 47 | 16770.40 | 10615.2 | 9361.4 | 12263.6 | 12503.9 | 7283.2 | 7295.8 |
| 48 | 50.20 | 39.10 | 42.40 | 38.90 | 36.20 | 41.50 | 37.00 |
| 49 | 56.30 | 49.70 | 47.00 | 48.60 | 42.80 | 54.80 | 43.70 |
| 50 | 54.50 | 51.70 | 47.50 | 48.70 | 44.60 | 52.80 | 47.80 |
| 51 | 2.75 | 1.27 | 1.29 | 1.56 | 3.22 | 0.90 | 1.67 |
| 52 | 19.70 | 14.30 | 14.10 | 17.10 | 17.30 | 15.10 | 16.10 |
| 53 | 10.72 | 9.68 | 7.88 | 9.47 | 10.83 | 9.78 | 8.96 |
| 54 | 21835.90 | 19319.40 | 15290.90 | 24497.00 | 44648.60 | 13714.80 | 30943.70 |
| 55 | 762.20 | 669.10 | 675.10 | 757.60 | 757.60 | 649.40 | 823.40 |
| 56 | 92.00 | 86.80 | 81.20 | 89.60 | 89.50 | 84.00 | 95.80 |
| 57 | 814.00 | 751.30 | 689.40 | 782.10 | 781.00 | 720.60 | 863.60 |
| 58 | 1258.50 | 1131.70 | 1129.00 | 1154.50 | 1123.30 | 1148.80 | 1148.80 |
| 59 | 330.90 | 384.80 | 372.60 | 326.60 | 305.10 | 290.60 | 162.20 |
| 60 | 93.30 | NA | 120.50 | 126.60 | NA | 99.80 | NA |
| 61 | 24.77 | NA | 29.66 | 37.89 | NA | 28.94 | NA |
| 62 | 14.71 | NA | 12.00 | 8.51 | NA | 9.04 | NA |
| 63 | 0.50 | NA | 0.49 | 0.57 | NA | 0.45 | NA |
| 64 | 1.22 | NA | 1.01 | 1.42 | NA | 1.67 | NA |
| 65 | 1.62 | NA | 2.31 | 1.38 | NA | 2.06 | NA |
| 66 | 0.93 | NA | 0.67 | 0.58 | NA | 0.99 | NA |
| 67 | 2.01 | NA | 1.64 | 1.49 | NA | 1.57 | NA |

Table 172: Provided are the values of each of the parameters (as described above) measured in Sorghum accessions (Line) under low N conditions. Growth conditions are specified in the experimental procedure section.

TABLE 173

Measured parameters in additional Sorghum accessions under low N conditions

| Line/Corr. ID | Line-8 | Line-9 | Line-10 | Line-11 | Line-12 | Line-13 | Line-14 |
|---|---|---|---|---|---|---|---|
| 1 | 152.00 | 633.40 | 389.10 | 306.50 | 283.00 | 558.30 | 690.40 |
| 2 | 31.10 | 90.20 | 58.70 | 44.10 | 35.70 | 74.70 | 84.10 |
| 3 | 12.90 | 28.00 | 27.70 | 20.90 | 10.00 | 27.60 | 34.10 |
| 4 | 12.30 | 43.70 | 33.00 | 19.10 | 19.80 | 40.80 | 46.40 |
| 5 | 5.20 | 10.09 | NA | 5.25 | 1.45 | 9.66 | NA |
| 6 | 0.20 | 0.76 | 0.51 | 0.47 | 0.50 | 0.63 | 0.78 |
| 7 | 6.70 | 11.00 | 10.20 | 31.70 | 7.70 | 10.10 | 9.50 |
| 8 | −13.62 | −12.69 | −13.11 | −13.17 | −12.59 | −13.13 | −13.00 |
| 9 | 0.32 | 1.25 | 0.69 | 0.54 | 0.57 | 1.20 | 1.48 |
| 10 | 0.01 | 0.03 | 0.06 | 0.04 | 0.01 | 0.01 | 0.02 |
| 11 | 0.02 | 0.04 | 0.07 | 0.05 | 0.03 | 0.03 | 0.04 |
| 12 | 0.12 | 0.38 | 0.48 | 0.44 | 0.20 | 0.23 | 0.23 |
| 13 | 0.09 | 0.35 | 0.46 | 0.37 | 0.17 | 0.20 | 0.20 |
| 14 | 12.00 | 40.60 | 40.90 | 13.30 | 17.50 | 34.90 | 31.90 |
| 15 | 6420783 | 26192733 | 21156820 | 10734122 | 10820540 | 21581650 | 22437200 |
| 16 | 1326.90 | 4021.60 | 3454.50 | 1697.20 | 1472.70 | 3041.20 | 2942.70 |
| 17 | 520.90 | 1874.60 | 1912.80 | 732.20 | 810.60 | 1593.30 | 1572.20 |
| 18 | 23.70 | 22.80 | 16.50 | 24.80 | 25.60 | 25.20 | 29.50 |
| 19 | 0.12 | 0.10 | 0.08 | 0.11 | 0.11 | 0.11 | 0.12 |
| 20 | 37.00 | 33.30 | 22.00 | 27.80 | 34.80 | 31.60 | 28.60 |
| 21 | 453.50 | 437.00 | 303.10 | 381.10 | 448.50 | 400.90 | 366.10 |
| 22 | 4.00 | 18.90 | 18.00 | 11.90 | 8.20 | 17.20 | 24.30 |
| 23 | 0.49 | 1.51 | 1.52 | 0.75 | 0.61 | 1.42 | 1.63 |
| 24 | 235.30 | 156.90 | 136.70 | 190.30 | 117.00 | 75.90 | 79.00 |
| 25 | 112.00 | 147.00 | 145.50 | 154.20 | 148.00 | 137.00 | 119.00 |
| 26 | 1070.90 | 1554.50 | 1534.20 | 1659.70 | 1570.20 | 1412.00 | 1165.80 |
| 27 | 0.00 | 0.11 | 0.20 | 0.04 | 0.24 | 0.17 | 0.24 |
| 28 | 0.20 | 0.42 | 0.59 | 0.34 | 0.19 | 0.03 | 0.21 |
| 29 | NA | 30.00 | 32.50 | 32.50 | 29.50 | 29.30 | 30.90 |
| 30 | 189.50 | 125.50 | 140.60 | 160.00 | 159.60 | 178.50 | 157.80 |
| 31 | NA | 0.17 | 0.13 | 0.18 | 0.17 | 0.19 | 0.18 |
| 32 | 92.30 | 87.20 | 86.70 | 88.10 | 86.90 | 85.90 | 91.50 |
| 33 | 71.90 | 69.20 | 68.60 | 69.30 | 79.70 | 76.70 | 73.60 |
| 34 | 84.10 | 67.70 | 73.10 | 71.70 | 82.50 | 74.40 | 80.00 |

TABLE 173-continued

Measured parameters in additional *Sorghum* accessions under low N conditions

| Line/Corr. ID | Line-8 | Line-9 | Line-10 | Line-11 | Line-12 | Line-13 | Line-14 |
|---|---|---|---|---|---|---|---|
| 35 | 12833.30 | 20833.30 | 13166.70 | 14150.00 | 25900.00 | 18950.00 | 18250.00 |
| 36 | 1.07 | 1.41 | 0.95 | 1.13 | 1.46 | 1.26 | 1.11 |
| 37 | 1.83 | 2.47 | 1.20 | 2.27 | 2.53 | 3.83 | 1.54 |
| 38 | 0.19 | 0.23 | 0.07 | 0.09 | 0.17 | 0.36 | 0.30 |
| 39 | 0.36 | 0.36 | 0.12 | 0.18 | 0.47 | 0.51 | 0.46 |
| 40 | 26.20 | 120.00 | 241.00 | 200.80 | 55.30 | 64.60 | 68.00 |
| 41 | 0.08 | 0.22 | 0.42 | 0.29 | 0.12 | 0.13 | 0.17 |
| 42 | 19.40 | 109.00 | 230.80 | 169.10 | 47.60 | 54.50 | 58.50 |
| 43 | 0.05 | 0.12 | 0.47 | 0.19 | 0.06 | 0.05 | 0.07 |
| 44 | 2.50 | 0.65 | 1.15 | 0.96 | 0.71 | 1.00 | 1.12 |
| 45 | NA | 87.40 | 85.50 | 93.10 | 55.40 | 74.10 | 67.40 |
| 46 | NA | 5.22 | 4.97 | 6.28 | 2.15 | 4.02 | 2.83 |
| 47 | 3501.0 | 12503.7 | 15699.7 | 22712.4 | 8595.4 | 8279.6 | 14579.4 |
| 48 | 41.90 | 40.10 | 36.00 | 39.40 | 36.30 | 40.40 | 45.40 |
| 49 | NA | 51.20 | 46.20 | 57.40 | 49.60 | 53.60 | 48.50 |
| 50 | 50.10 | 53.10 | 42.80 | 56.90 | 49.10 | 50.50 | 48.80 |
| 51 | NA | 1.35 | 2.88 | 2.15 | 1.06 | 0.88 | 1.05 |
| 52 | 9.00 | 19.40 | 20.60 | 22.70 | 18.00 | 13.90 | 17.00 |
| 53 | 7.89 | 9.50 | 6.88 | 11.01 | 9.43 | 8.68 | 8.36 |
| 54 | 8654.40 | 22138.70 | 48187.80 | 46278.30 | 15264.70 | 9784.80 | 13167.00 |
| 55 | 630.50 | 734.90 | NA | 945.20 | 661.90 | 670.00 | 717.10 |
| 56 | 76.00 | 91.00 | 120.60 | 113.80 | 85.80 | 84.40 | 86.80 |
| 57 | 630.50 | 802.20 | 1189.10 | 1097.00 | 740.60 | 725.10 | 751.50 |
| 58 | 1084.00 | 1239.20 | 1492.20 | 1478.10 | 1189.10 | 1126.00 | 1117.60 |
| 59 | 76.00 | 316.70 | 194.50 | 153.20 | 141.50 | 279.20 | 345.20 |
| 60 | NA | 104.40 | NA | NA | NA | NA | NA |
| 61 | NA | 22.90 | NA | NA | NA | NA | NA |
| 62 | NA | 11.61 | NA | NA | NA | NA | NA |
| 63 | NA | 0.40 | NA | NA | NA | NA | NA |
| 64 | NA | 1.31 | NA | NA | NA | NA | NA |
| 65 | NA | 1.16 | NA | NA | NA | NA | NA |
| 66 | NA | 0.89 | NA | NA | NA | NA | NA |
| 67 | NA | 1.76 | NA | NA | NA | NA | NA |

Table 173: Provided are the values of each of the parameters (as described above) measured in *Sorghum* accessions (Line) under low N conditions. Growth conditions are specified in the experimental procedure section.

TABLE 174

Measured parameters in additional *Sorghum* accessions under low N conditions

| Line/Corr. ID | Line-15 | Line-16 | Line-17 | Line-18 | Line-19 | Line-20 | Line-21 |
|---|---|---|---|---|---|---|---|
| 1 | 605.10 | 366.70 | 423.10 | 280.20 | 590.60 | 454.70 | 263.70 |
| 2 | 85.50 | 44.30 | 66.90 | 23.60 | 95.70 | 68.20 | 43.30 |
| 3 | 37.10 | 17.60 | 16.10 | 5.70 | 36.40 | 28.10 | 13.20 |
| 4 | 46.20 | 24.50 | 31.90 | 7.70 | 40.60 | 35.60 | 14.20 |
| 5 | 0.85 | 0.50 | 6.54 | 3.62 | 4.04 | 0.62 | 11.12 |
| 6 | 0.69 | 0.58 | 0.47 | 0.58 | 0.68 | 0.51 | 0.26 |
| 7 | 9.90 | 11.40 | 19.70 | 16.10 | 17.30 | 13.90 | 8.30 |
| 8 | −12.96 | −13.07 | −12.94 | −12.77 | −13.35 | −12.60 | −12.83 |
| 9 | 1.18 | 0.73 | 0.79 | 0.50 | 1.23 | 0.93 | 0.57 |
| 10 | 0.01 | 0.02 | 0.04 | 0.03 | 0.01 | 0.02 | 0.01 |
| 11 | 0.03 | 0.03 | 0.05 | 0.03 | 0.02 | 0.03 | 0.02 |
| 12 | 0.41 | 0.28 | 0.69 | 0.32 | 0.32 | 0.41 | 0.23 |
| 13 | 0.39 | 0.24 | 0.63 | 0.28 | 0.26 | 0.37 | 0.19 |
| 14 | 44.00 | 26.30 | 19.70 | 12.00 | 31.10 | 41.70 | 25.80 |
| 15 | 25344720 | 20035920 | 11582823 | 14659840 | 20818740 | 23299560 | 11431484 |
| 16 | 3864.40 | 2620.70 | 1944.00 | 1369.30 | 3561.90 | 3839.10 | 1999.40 |
| 17 | 2037.50 | 1422.10 | 854.80 | 449.60 | 1466.90 | 1989.80 | 659.50 |
| 18 | 22.70 | 16.50 | 37.00 | 16.80 | 26.60 | 17.80 | 21.10 |
| 19 | 0.12 | 0.08 | 0.14 | 0.09 | 0.11 | 0.09 | 0.10 |
| 20 | 22.20 | 29.20 | 29.50 | 30.00 | 35.40 | 24.60 | 42.60 |
| 21 | 293.60 | 384.40 | 389.20 | 405.60 | 454.60 | 323.10 | 527.50 |
| 22 | 27.30 | 13.00 | 14.80 | 9.30 | 16.70 | 18.50 | 6.20 |
| 23 | 2.11 | 0.88 | 1.35 | 0.37 | 1.25 | 1.46 | 0.59 |
| 24 | 107.00 | 176.30 | 83.00 | 66.70 | 117.50 | 98.10 | 47.50 |
| 25 | 143.00 | NA | 149.00 | 148.40 | 144.00 | 137.00 | NA |
| 26 | 1498.30 | NA | 1584.50 | 1576.20 | 1512.80 | 1412.00 | NA |
| 27 | 0.28 | 0.11 | 0.14 | 0.20 | 0.04 | 0.18 | 0.01 |
| 28 | 0.28 | 0.22 | 0.08 | 0.23 | 0.03 | 0.15 | 0.06 |
| 29 | 29.70 | 30.30 | 30.70 | 32.60 | 29.90 | 29.90 | 27.90 |
| 30 | 153.20 | 149.90 | 148.20 | 123.30 | 147.80 | 130.50 | 150.10 |

TABLE 174-continued

Measured parameters in additional *Sorghum* accessions under low N conditions

| Line/ Corr. ID | Line-15 | Line-16 | Line-17 | Line-18 | Line-19 | Line-20 | Line-21 |
|---|---|---|---|---|---|---|---|
| 31 | 0.18 | 0.17 | 0.20 | 0.16 | 0.18 | 0.19 | NA |
| 32 | 91.40 | 84.50 | 92.50 | 85.10 | 88.20 | 87.00 | 92.40 |
| 33 | 68.70 | 70.90 | 73.20 | 65.30 | 75.60 | 63.00 | NA |
| 34 | 47.50 | 78.80 | 48.80 | 65.80 | 74.60 | 43.80 | NA |
| 35 | 15050.00 | 18650.00 | 26500.00 | 47771.40 | 15378.60 | 14791.30 | 23437.30 |
| 36 | 1.06 | 1.11 | 1.78 | 2.30 | 1.15 | 1.22 | 2.54 |
| 37 | 1.24 | 1.30 | 4.79 | 4.27 | 2.37 | 1.43 | 4.93 |
| 38 | 0.33 | 0.20 | 0.15 | 0.07 | 0.35 | 0.26 | 0.29 |
| 39 | 0.49 | 0.35 | 0.26 | 0.20 | 0.53 | 0.39 | 0.37 |
| 40 | 159.40 | 90.70 | 240.20 | 133.70 | 88.70 | 138.10 | 48.10 |
| 41 | 0.14 | 0.13 | 0.27 | 0.19 | 0.12 | 0.13 | 0.09 |
| 42 | 149.50 | 79.30 | 220.50 | 117.60 | 71.40 | 123.40 | 39.80 |
| 43 | 0.07 | 0.06 | 0.15 | 0.11 | 0.07 | 0.09 | 0.09 |
| 44 | 0.77 | 0.77 | 1.07 | 1.26 | 0.69 | 0.64 | 0.88 |
| 45 | 71.20 | 87.70 | 66.60 | 88.70 | 69.20 | 83.00 | 61.30 |
| 46 | 3.57 | 5.91 | 3.22 | 6.07 | 3.70 | 4.37 | 2.22 |
| 47 | 16710.3 | 13218.2 | 14464.5 | 11759.2 | 8621.8 | 13816.8 | 6363.6 |
| 48 | 39.90 | 39.10 | 42.00 | 42.00 | 44.50 | 39.40 | 38.20 |
| 49 | 46.30 | 50.00 | 56.20 | 49.70 | 51.30 | 48.10 | 52.50 |
| 50 | 47.40 | 55.90 | 55.50 | 49.90 | 51.20 | 48.10 | 44.40 |
| 51 | 2.35 | 1.03 | 3.93 | 1.50 | 1.32 | 1.68 | 0.78 |
| 52 | 21.00 | 20.00 | 21.50 | 17.70 | 18.50 | 20.70 | 14.80 |
| 53 | 9.78 | 8.57 | 12.73 | 7.75 | 10.95 | 7.75 | 7.52 |
| 54 | 14934.20 | 18163.10 | 28962.40 | 18746.50 | 12235.20 | 15453.20 | 7723.90 |
| 55 | 892.60 | 769.50 | 814.20 | 905.80 | 641.50 | 773.00 | 534.20 |
| 56 | 103.80 | 94.00 | 97.80 | 107.40 | 84.60 | 95.80 | 74.00 |
| 57 | 967.40 | 840.00 | 889.20 | 1013.40 | 726.80 | 863.50 | 607.20 |
| 58 | 1261.00 | 1224.30 | 1278.50 | 1419.00 | 1181.30 | 1186.60 | 1134.70 |
| 59 | 302.50 | 183.30 | 211.60 | 140.10 | 295.30 | 227.30 | 131.80 |
| 60 | NA | NA | NA | NA | NA | NA | NA |
| 61 | NA | NA | NA | NA | NA | NA | NA |
| 62 | NA | NA | NA | NA | NA | NA | NA |
| 63 | NA | NA | NA | NA | NA | NA | NA |
| 64 | NA | NA | NA | NA | NA | NA | NA |
| 65 | NA | NA | NA | NA | NA | NA | NA |
| 66 | NA | NA | NA | NA | NA | NA | NA |
| 67 | NA | NA | NA | NA | NA | NA | NA |

Table 174: Provided are the values of each of the parameters (as described above) measured in *Sorghum* accessions (Line) under low N conditions. Growth conditions are specified in the experimental procedure section.

TABLE 175

Measured parameters in additional *Sorghum* accessions under low N conditions

| Line/ Corr. ID | Line-22 | Line-23 | Line-24 | Line-25 | Line-26 | Line-27 | Line-28 |
|---|---|---|---|---|---|---|---|
| 1 | 145.50 | 282.20 | 605.50 | 378.00 | 581.10 | 291.80 | 671.50 |
| 2 | 17.50 | 43.20 | 111.30 | 59.10 | 109.30 | 52.90 | 93.90 |
| 3 | 9.50 | 19.10 | 36.40 | 22.00 | 36.60 | 19.10 | 33.90 |
| 4 | 4.80 | 24.80 | 66.90 | 27.10 | 58.60 | 30.30 | 42.60 |
| 5 | 1.76 | NA | 3.74 | 10.92 | 36.79 | 0.50 | 6.36 |
| 6 | 0.35 | 0.49 | 0.71 | 0.50 | 0.72 | 0.64 | 0.77 |
| 7 | 20.40 | 19.80 | 37.00 | 11.00 | NA | 18.20 | 14.50 |
| 8 | −12.90 | −12.36 | −13.10 | −13.06 | −12.75 | −12.90 | −13.03 |
| 9 | 0.33 | 0.50 | 1.27 | 0.80 | 1.13 | 0.63 | 1.41 |
| 10 | 0.03 | 0.03 | 0.02 | 0.02 | 0.03 | 0.02 | 0.01 |
| 11 | 0.03 | 0.04 | 0.04 | 0.03 | 0.05 | 0.03 | 0.03 |
| 12 | 0.63 | 0.80 | 0.61 | 0.19 | NA | 0.27 | 0.34 |
| 13 | 0.59 | 0.76 | 0.49 | 0.15 | NA | 0.21 | 0.27 |
| 14 | 5.00 | 23.20 | 44.90 | 30.10 | 36.30 | 25.40 | 33.80 |
| 15 | 4496747 | 11541518 | 18740650 | 16305080 | 20382340 | 12164286 | 23557125 |
| 16 | 592.60 | 1907.30 | 3702.60 | 2806.60 | 3624.30 | 2363.90 | 3599.60 |
| 17 | 161.40 | 1071.80 | 2162.90 | 1311.70 | 1900.60 | 1326.50 | 1619.00 |
| 18 | 26.70 | 22.70 | 31.60 | 20.30 | 31.20 | 21.50 | 26.00 |
| 19 | 0.13 | 0.11 | 0.14 | 0.10 | 0.13 | 0.11 | 0.11 |
| 20 | 29.00 | 29.20 | 32.80 | 31.80 | 22.40 | 29.40 | 42.20 |
| 21 | 395.40 | 404.20 | 428.20 | 411.50 | 295.70 | 380.90 | 522.00 |
| 22 | 7.60 | 9.90 | 19.80 | 12.10 | 25.90 | 10.00 | 15.90 |
| 23 | 0.39 | 0.87 | 2.19 | 1.01 | 2.44 | 1.05 | 1.13 |
| 24 | 178.30 | 124.00 | 150.20 | 82.50 | 123.70 | 113.70 | 108.20 |
| 25 | 148.30 | 149.20 | 125.20 | 134.00 | 152.20 | NA | NA |
| 26 | 1575.20 | 1586.70 | 1250.80 | 1369.00 | 1631.00 | NA | NA |

TABLE 175-continued

Measured parameters in additional *Sorghum* accessions under low N conditions

| Line/Corr. ID | Line-22 | Line-23 | Line-24 | Line-25 | Line-26 | Line-27 | Line-28 |
|---|---|---|---|---|---|---|---|
| 27 | 0.19 | 0.21 | 0.15 | 0.15 | NA | 0.07 | 0.01 |
| 28 | 0.41 | 0.69 | 0.23 | 0.28 | 0.47 | 0.18 | 0.05 |
| 29 | 28.40 | 28.60 | 30.20 | 30.90 | 30.90 | 30.50 | 28.20 |
| 30 | 96.90 | 165.90 | 153.40 | 165.20 | NA | 153.10 | 143.30 |
| 31 | 0.16 | 0.16 | 0.18 | 0.15 | NA | 0.19 | NA |
| 32 | 88.60 | 88.90 | 89.90 | 93.10 | 90.60 | 92.40 | 93.30 |
| 33 | 60.40 | 72.80 | 66.80 | 73.90 | NA | 76.30 | NA |
| 34 | 52.30 | 62.90 | 56.20 | 78.70 | NA | 81.80 | NA |
| 35 | 26033.30 | 13200.00 | 14404.80 | 13600.00 | 15500.00 | 13466.70 | 20520.80 |
| 36 | 1.69 | 0.98 | 1.34 | 1.02 | 1.53 | 1.16 | 1.43 |
| 37 | 5.33 | 1.00 | 1.43 | 1.83 | 1.40 | 1.07 | 3.50 |
| 38 | 0.05 | 0.09 | 0.31 | 0.24 | 0.22 | 0.21 | 0.36 |
| 39 | 0.16 | 0.24 | 0.52 | 0.44 | 0.34 | 0.43 | 0.52 |
| 40 | 306.10 | 385.00 | 180.80 | 53.30 | NA | 80.80 | 70.30 |
| 41 | 0.20 | 0.25 | 0.21 | 0.13 | 0.27 | 0.14 | 0.13 |
| 42 | 285.70 | 365.30 | 143.90 | 42.30 | NA | 62.60 | 55.80 |
| 43 | 0.24 | 0.27 | 0.08 | 0.07 | 0.19 | 0.06 | 0.06 |
| 44 | 0.84 | 0.85 | 1.55 | 0.82 | 0.83 | 0.57 | 0.74 |
| 45 | 90.30 | 85.70 | 71.20 | 60.10 | 94.80 | 60.60 | 81.10 |
| 46 | 4.00 | 2.98 | 2.92 | 2.88 | 6.85 | 2.32 | 3.89 |
| 47 | 16953.3 | 26482.6 | 15781.4 | 8543.0 | NA | 15080.6 | 9350.7 |
| 48 | 35.90 | 38.50 | 40.50 | 48.40 | 40.60 | 41.10 | 44.60 |
| 49 | 47.80 | 47.10 | 54.90 | 50.30 | 43.20 | 50.70 | 55.10 |
| 50 | 49.00 | 41.00 | 49.20 | 49.60 | 48.70 | 52.50 | 52.90 |
| 51 | 3.40 | 4.56 | 2.64 | 0.91 | NA | 1.35 | 0.85 |
| 52 | 20.90 | 24.40 | 18.20 | 16.90 | NA | 21.50 | 16.80 |
| 53 | 9.43 | 11.94 | 12.75 | 9.97 | NA | 10.98 | 9.12 |
| 54 | 32879.70 | 62130.20 | 28010.30 | 8132.70 | NA | 18761.80 | 13549.20 |
| 55 | 912.20 | NA | 751.50 | 677.80 | 901.20 | 727.20 | 574.80 |
| 56 | 111.00 | 118.00 | 88.60 | 86.60 | 102.80 | 87.80 | 74.00 |
| 57 | 1060.40 | 1153.70 | 771.50 | 748.30 | 955.10 | 762.20 | 607.20 |
| 58 | 1483.80 | 1558.00 | 1199.70 | 1159.80 | 1250.80 | 1143.10 | 1129.20 |
| 59 | 72.70 | 141.10 | 302.80 | 189.00 | 290.50 | 145.90 | 335.80 |
| 60 | NA | 194.90 | 128.50 | NA | NA | NA | NA |
| 61 | NA | 18.14 | 40.26 | NA | NA | NA | NA |
| 62 | NA | 8.79 | 7.16 | NA | NA | NA | NA |
| 63 | NA | 0.27 | 0.57 | NA | NA | NA | NA |
| 64 | NA | 0.70 | 0.99 | NA | NA | NA | NA |
| 65 | NA | 1.98 | 1.64 | NA | NA | NA | NA |
| 66 | NA | 0.49 | 0.70 | NA | NA | NA | NA |
| 67 | NA | 1.47 | 1.41 | NA | NA | NA | NA |

Table 175: Provided are the values of each of the parameters (as described above) measured in *Sorghum* accessions (Line) under low N conditions. Growth conditions are specified in the experimental procedure section.

TABLE 176

Measured parameters in additional *Sorghum* accessions under low N conditions

| Line/Corr. ID | Line-29 | Line-30 | Line-31 | Line-32 | Line-33 | Line-34 |
|---|---|---|---|---|---|---|
| 1 | 510.90 | 774.60 | 816.40 | 922.40 | 828.40 | 485.50 |
| 2 | 68.20 | 95.30 | 127.80 | 139.40 | 101.20 | 76.10 |
| 3 | 27.90 | 40.00 | 57.50 | 50.80 | 48.70 | 26.40 |
| 4 | 36.00 | 48.80 | 69.20 | 79.20 | 49.60 | 36.40 |
| 5 | 5.12 | 1.57 | NA | 12.83 | 0.77 | 5.67 |
| 6 | 0.64 | 0.93 | 0.97 | 1.00 | 1.04 | 0.59 |
| 7 | 10.90 | 11.10 | 16.00 | 22.60 | 19.80 | 14.70 |
| 8 | −13.02 | −12.98 | −13.03 | −12.84 | −12.64 | −13.03 |
| 9 | 1.10 | 1.66 | 1.63 | 1.74 | 1.69 | 0.96 |
| 10 | 0.01 | 0.01 | 0.03 | 0.02 | 0.02 | 0.07 |
| 11 | 0.02 | 0.03 | 0.05 | 0.04 | 0.03 | 0.08 |
| 12 | 0.22 | 0.28 | 0.87 | 0.81 | 0.39 | 1.11 |
| 13 | 0.17 | 0.23 | 0.82 | 0.75 | 0.32 | 1.06 |
| 14 | 26.90 | 35.30 | 69.80 | 61.60 | 45.60 | 31.90 |
| 15 | 16479475 | 25747580 | 36116975 | 36860650 | 33562075 | 18000140 |
| 16 | 2406.10 | 3436.20 | 6082.50 | 5855.70 | 4395.80 | 3020.80 |
| 17 | 1259.40 | 1724.00 | 3230.20 | 3170.30 | 2099.20 | 1383.30 |
| 18 | 27.90 | 28.40 | 20.90 | 24.40 | 23.50 | 26.10 |
| 19 | 0.12 | 0.12 | 0.10 | 0.11 | 0.10 | 0.11 |
| 20 | 42.20 | 42.00 | 26.20 | 31.20 | 29.80 | 33.20 |
| 21 | 522.50 | 518.80 | 344.90 | 412.30 | 391.00 | 436.90 |

TABLE 176-continued

Measured parameters in additional *Sorghum* accessions under low N conditions

| Line/Corr. ID | Line-29 | Line-30 | Line-31 | Line-32 | Line-33 | Line-34 |
|---|---|---|---|---|---|---|
| 22 | 12.20 | 18.40 | 31.90 | 29.90 | 27.80 | 14.90 |
| 23 | 0.91 | 1.18 | 2.67 | 2.66 | 1.67 | 1.32 |
| 24 | 138.60 | 112.20 | 185.60 | 222.30 | 140.80 | 115.60 |
| 25 | NA | 125.00 | 145.00 | NA | 136.50 | 135.50 |
| 26 | NA | 1247.50 | 1528.00 | NA | 1405.50 | 1392.60 |
| 27 | 0.08 | 0.25 | 0.09 | 0.12 | 0.22 | 0.21 |
| 28 | 0.09 | 0.07 | 0.18 | 0.14 | 0.33 | 0.40 |
| 29 | 27.80 | 28.00 | 30.50 | 29.70 | 32.50 | 29.50 |
| 30 | 151.10 | 142.90 | 152.40 | 133.10 | 159.40 | 139.70 |
| 31 | NA | NA | 0.20 | 0.18 | 0.16 | 0.16 |
| 32 | 93.50 | 94.20 | 85.90 | 87.60 | 92.20 | 92.00 |
| 33 | NA | NA | 67.30 | 68.60 | 71.70 | 69.00 |
| 34 | NA | NA | 30.30 | 39.90 | 72.50 | 50.50 |
| 35 | 16495.80 | 17950.00 | 12910.70 | 15812.50 | 15567.90 | 18400.00 |
| 36 | 1.08 | 1.16 | 1.02 | 1.14 | 1.06 | 1.28 |
| 37 | 3.46 | 3.40 | 2.25 | 1.00 | 1.08 | 2.83 |
| 38 | 0.34 | 0.33 | 0.26 | 0.37 | 0.30 | 0.11 |
| 39 | 0.61 | 0.53 | 0.43 | 0.54 | 0.49 | 0.18 |
| 40 | 45.40 | 58.60 | 293.90 | 275.50 | 124.40 | 344.00 |
| 41 | 0.11 | 0.15 | 0.26 | 0.21 | 0.16 | 0.41 |
| 42 | 34.50 | 47.50 | 277.90 | 252.90 | 104.50 | 329.20 |
| 43 | 0.05 | 0.08 | 0.15 | 0.09 | 0.08 | 0.22 |
| 44 | 0.85 | 1.17 | 0.82 | 0.77 | 0.91 | 1.54 |
| 45 | 74.00 | 88.20 | 94.30 | 84.50 | 68.60 | 84.00 |
| 46 | 3.18 | 5.37 | 6.86 | 4.96 | 3.39 | 4.38 |
| 47 | 5454.0 | 9065.6 | 20008.0 | 21922.8 | 15977.0 | 18430.4 |
| 48 | 46.90 | 41.40 | 39.90 | 41.80 | 39.50 | 38.30 |
| 49 | 55.50 | 49.80 | 45.80 | 51.00 | 45.00 | 50.60 |
| 50 | 52.20 | 49.90 | 47.30 | 53.80 | 45.90 | 50.90 |
| 51 | 0.60 | 0.65 | 3.13 | 3.28 | 1.84 | 4.08 |
| 52 | 15.40 | 15.40 | 21.20 | 20.80 | 17.50 | 20.50 |
| 53 | 8.63 | 8.78 | 9.05 | 9.40 | 9.41 | 9.06 |
| 54 | 9492.30 | 14554.40 | 27230.60 | 18260.10 | 18322.30 | 42073.40 |
| 55 | 574.80 | 607.20 | 814.20 | 749.10 | 769.50 | 773.00 |
| 56 | 74.00 | 74.00 | 96.50 | 96.00 | 92.50 | 92.00 |
| 57 | 607.20 | 607.20 | 872.80 | 866.20 | 820.00 | 813.40 |
| 58 | 1129.80 | 1126.00 | 1217.60 | 1278.60 | 1211.00 | 1250.30 |
| 59 | 255.40 | 387.30 | 408.20 | 461.20 | 414.20 | 242.80 |
| 60 | NA | 102.20 | NA | 112.40 | NA | 154.20 |
| 61 | NA | 35.16 | NA | 43.48 | NA | 15.48 |
| 62 | NA | 11.09 | NA | 10.96 | NA | 13.24 |
| 63 | NA | 0.59 | NA | 0.58 | NA | 0.31 |
| 64 | NA | 1.38 | NA | 1.14 | NA | 1.58 |
| 65 | NA | 1.53 | NA | 1.48 | NA | 1.70 |
| 66 | NA | 0.86 | NA | 0.81 | NA | 0.54 |
| 67 | NA | 1.68 | NA | 1.33 | NA | 2.02 |

Table 176: Provided are the values of each of the parameters (as described above) measured in *Sorghum* accessions (Line) under low N conditions. Growth conditions are specified in the experimental procedure section.

TABLE 177

Correlation between the expression level of selected genes of some embodiments of the invention in various tissues and the phenotypic performance under normal conditions across *Sorghum* accessions

| Gene Name | R | P value | Exp. set | Corr. ID | Gene Name | R | P value | Exp. set | Corr. ID |
|---|---|---|---|---|---|---|---|---|---|
| LBY258 | 0.91 | 5.86E−04 | 3 | 75 | LBY258 | 0.74 | 6.80E−04 | 2 | 51 |
| LBY258 | 0.72 | 1.06E−01 | 2 | 72 | LBY278 | 0.71 | 1.44E−03 | 2 | 54 |
| LBY278 | 0.72 | 1.10E−01 | 2 | 75 | LBY280 | 0.78 | 1.38E−02 | 3 | 78 |
| LBY280 | 0.82 | 4.80E−02 | 2 | 70 | LBY281 | 0.84 | 3.73E−02 | 2 | 69 |
| LBY305 | 0.75 | 3.08E−02 | 1 | 67 | LBY306 | 0.71 | 3.09E−02 | 1 | 73 |
| LBY306 | 0.76 | 3.69E−04 | 2 | 29 | LBY307 | 0.76 | 1.77E−02 | 1 | 72 |
| LBY306 | 0.71 | 3.26E−02 | 3 | 74 | LBY306 | 0.75 | 5.12E−04 | 2 | 28 |
| LBY307 | 0.71 | 3.06E−02 | 3 | 70 | LBY307 | 0.76 | 2.87E−02 | 3 | 67 |
| LBY338 | 0.73 | 9.91E−02 | 2 | 75 | LBY339 | 0.88 | 1.93E−03 | 3 | 75 |
| LBY338 | 0.71 | 1.92E−03 | 2 | 66 | LBY338 | 0.70 | 1.63E−03 | 2 | 36 |
| LBY340 | 0.71 | 3.39E−02 | 3 | 69 | LBY342 | 0.84 | 8.33E−03 | 3 | 67 |
| LBY348 | 0.82 | 1.32E−02 | 3 | 67 | LBY346 | 0.71 | 3.10E−02 | 3 | 72 |
| LBY350 | 0.88 | 1.97E−02 | 2 | 70 | LBY348 | 0.74 | 9.55E−02 | 2 | 76 |

TABLE 177-continued

Correlation between the expression level of selected genes of some embodiments of the invention in various tissues and the phenotypic performance under normal conditions across Sorghum accessions

| Gene Name | R | P value | Exp. set | Corr. ID | Gene Name | R | P value | Exp. set | Corr. ID |
|---|---|---|---|---|---|---|---|---|---|
| LBY353 | 0.85 | 3.96E−03 | 1 | 76 | LBY350 | 0.80 | 5.83E−02 | 2 | 69 |
| LBY354 | 0.75 | 3.07E−02 | 3 | 71 | LBY353 | 0.70 | 2.32E−06 | 1 | 21 |
| LBY354 | 0.76 | 8.08E−02 | 2 | 70 | LBY354 | 0.75 | 3.07E−02 | 3 | 68 |
| LBY382 | 0.71 | 1.16E−01 | 2 | 76 | LBY354 | 0.81 | 5.00E−02 | 2 | 69 |
| LBY383 | 0.71 | 3.10E−02 | 3 | 73 | LBY382 | 0.85 | 7.97E−03 | 2 | 67 |
| LBY383 | 0.71 | 1.12E−01 | 2 | 70 | LBY383 | 0.73 | 2.65E−02 | 3 | 72 |
| LBY385 | 0.82 | 4.49E−02 | 2 | 70 | LBY385 | 0.74 | 3.76E−02 | 3 | 67 |
| LBY387 | 0.74 | 9.21E−02 | 2 | 76 | LBY387 | 0.80 | 1.04E−02 | 3 | 75 |
| LBY389 | 0.74 | 3.41E−02 | 1 | 71 | LBY388 | 0.75 | 8.29E−02 | 2 | 69 |
| LBY389 | 0.75 | 1.91E−02 | 3 | 74 | LBY389 | 0.74 | 3.41E−02 | 1 | 68 |
| LBY389 | 0.78 | 2.22E−04 | 2 | 29 | LBY389 | 0.74 | 7.57E−04 | 2 | 28 |
| LBY393 | 0.71 | 5.06E−02 | 1 | 71 | LBY389 | 0.76 | 7.91E−02 | 2 | 69 |
| LBY395 | 0.72 | 2.89E−02 | 3 | 69 | LBY393 | 0.71 | 5.06E−02 | 1 | 68 |
| LBY395 | 0.72 | 1.05E−01 | 2 | 70 | LBY395 | 0.74 | 2.17E−02 | 3 | 76 |
| LBY396 | 0.73 | 8.88E−04 | 2 | 28 | LBY395 | 0.82 | 4.64E−02 | 2 | 69 |
| LBY396 | 0.84 | 3.65E−02 | 2 | 69 | LBY396 | 0.77 | 2.79E−04 | 2 | 29 |
| LBY446 | 0.71 | 3.26E−02 | 1 | 78 | LBY396 | 0.74 | 9.16E−02 | 2 | 72 |
| LBY446 | 0.95 | 4.41E−03 | 2 | 69 | LBY446 | 0.79 | 1.06E−02 | 1 | 72 |
| LBY447 | 0.72 | 2.83E−02 | 1 | 75 | LBY447 | 0.71 | 4.75E−02 | 1 | 67 |
| LBY449 | 0.74 | 6.54E−04 | 2 | 29 | LBY447 | 0.86 | 2.62E−02 | 2 | 75 |
| LBY450 | 0.79 | 1.95E−02 | 2 | 67 | LBY450 | 0.79 | 1.06E−02 | 1 | 70 |
| LBY450 | 0.89 | 1.45E−03 | 3 | 75 | LGA23 | 0.74 | 2.23E−02 | 3 | 74 |
| LGA23 | 0.77 | 3.11E−04 | 2 | 28 | LBY450 | 0.80 | 5.60E−02 | 2 | 69 |
| LGA23 | 0.74 | 9.24E−02 | 2 | 69 | LGA23 | 0.74 | 6.36E−04 | 2 | 29 |
| MGP32 | 0.70 | 3.47E−02 | 1 | 70 | LGA23 | 0.85 | 3.15E−02 | 2 | 72 |
| MGP36 | 0.79 | 1.86E−02 | 1 | 68 | MGP36 | 0.79 | 1.86E−02 | 1 | 71 |
| MGP36 | 0.81 | 5.15E−02 | 2 | 70 | MGP36 | 0.79 | 1.40E−04 | 2 | 48 |
| MGP59 | 0.85 | 3.81E−03 | 3 | 75 | | | | | |

Table 177. Provided are the correlations (R) between the expression levels of the genes of some embodiments of the invention in various tissues (expression set, Table 158) and the phenotypic performance (Tables 162-166) according to the correlation vectors (Corr. ID) specified in Table 159.
"R" = Pearson correlation coefficient;
"P" = p value.

TABLE 178

Correlation between the expression level of selected genes of some embodiments of the invention in various tissues and the phenotypic performance under drought stress conditions across Sorghum accessions

| Gene Name | R | P value | Exp. set | Corr. ID | Gene Name | R | P value | Exp. set | Corr. ID |
|---|---|---|---|---|---|---|---|---|---|
| LBY338 | 0.76 | 3.58E−07 | 4 | 58 | LBY338 | 0.71 | 5.74E−06 | 4 | 57 |

Table 178. Provided are the correlations (R) between the expression levels of the genes of some embodiments of the invention in various tissues (expression set, Table 158) and the phenotypic performance (Tables 167-171) according to the correlation vectors (Corr. ID) specified in Table 161. "R" = Pearson correlation coefficient;
"P" = p value

TABLE 179

Correlation between the expression level of selected genes of some embodiments of the invention in various tissues and the phenotypic performance under Low N growth stress conditions across Sorghum accessions

| Gene Name | R | P value | Exp. set | Corr. ID | Gene Name | R | P value | Exp. set | Corr. ID |
|---|---|---|---|---|---|---|---|---|---|
| LBY258 | 0.83 | 5.45E−03 | 5 | 60 | LBY278 | 0.80 | 1.01E−02 | 5 | 65 |
| LBY281 | 0.77 | 1.51E−02 | 5 | 65 | LBY305 | 0.74 | 2.18E−02 | 5 | 60 |
| LBY306 | 0.74 | 2.36E−02 | 5 | 67 | LBY338 | 0.70 | 4.91E−06 | 5 | 43 |
| LBY340 | 0.74 | 4.76E−06 | 5 | 5 | LBY350 | 0.75 | 2.09E−02 | 5 | 65 |
| LBY389 | 0.71 | 3.28E−02 | 5 | 62 | LBY389 | 0.70 | 3.42E−02 | 5 | 67 |
| LBY392 | 0.77 | 1.60E−02 | 5 | 60 | LBY395 | 0.75 | 2.03E−02 | 5 | 62 |

TABLE 179-continued

Correlation between the expression level of selected genes of some embodiments of the invention in various tissues and the phenotypic performance under Low N growth stress conditions across Sorghum accessions

| Gene Name | R | P value | Exp. set | Corr. ID | Gene Name | R | P value | Exp. set | Corr. ID |
|---|---|---|---|---|---|---|---|---|---|
| LBY446 | 0.71 | 3.06E−02 | 5 | 66 | LBY449 | 0.77 | 1.62E−02 | 5 | 60 |
| LGA15 | 0.71 | 3.30E−02 | 5 | 65 | | | | | |

Table 179. Provided are the correlations (R) between the expression levels of the genes of some embodiments of the invention in various tissues (expression set, Table 158) and the phenotypic performance (Tables 172-176) according to the correlation vectors (Corr. ID) specified in Table 160.
"R" = Pearson correlation coefficient;
"P" = p value Example 16

Production of Foxtail Millet Transcriptome and High Throughput Correlation Analysis Using 60K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [World Wide Web (dot) chem. (dot) agilent (dot) com/Scripts/PDS (dot) asp?lPage=50879]. The array oligonucleotide represents about 60K foxtail millet genes and transcripts. In order to define correlations between the levels of RNA expression and yield or vigor related parameters, various plant characteristics of 15 different foxtail millet accessions were analyzed. Among them, 11 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Fourteen foxtail millet varieties were grown in 5 repetitive plots, in field. Briefly, the growing protocol was as follows:

1. Regular growth conditions: foxtail millet plants were grown in the field using commercial fertilization and irrigation protocols, which include 283 m³ water per dunam (100 square meters) per entire growth period and fertilization of 16 units of URAN® 32% (Nitrogen Fertilizer Solution; PCS Sales, Northbrook, Ill., USA) (normal growth conditions).

2. Drought conditions: foxtail millet seeds were sown in soil and grown under normal condition until the heading stage (22 days from sowing), and then drought treatment was imposed by irrigating plants with 50% water relative to the normal treatment (171 m³ water per dunam per entire growth period) while maintaining normal fertilization.

Analyzed Foxtail Millet Tissues—All 15 foxtail millet lines were sample per each treatment. Three tissues [leaf, flower, and stem] at 2 different developmental stages [flowering, grain filling], representing different plant characteristics were sampled and RNA was extracted as described above. Each micro-array expression information tissue type has received a Set ID as summarized in Tables 180-183 below.

TABLE 180

Foxtail millet transcriptome expression sets under drought conditions at flowering stage

| Expression Set | Set ID |
|---|---|
| flower: flowering stage, drought | 1 |
| leaf: flowering stage, drought | 2 |
| stem: flowering stage, drought | 3 |

Table 180. Provided are the foxtail millet transcriptome expression sets under drought conditions at flowering stage.

TABLE 181

Foxtail millet transcriptome expression sets under drought conditions at grain filling stage

| Expression Set | Set ID |
|---|---|
| grain: grain filling stage, drought | 4 |
| leaf: grain filling stage, drought | 5 |
| stem: grain filling stage, drought | 6 |

Table 181. Provided are the foxtail millet transcriptome expression sets under drought conditions at grain filling stage.

TABLE 182

Foxtail millet transcriptome expression sets under normal conditions at flowering stage

| Expression Set | Set ID |
|---|---|
| flower: flowering stage, normal | 1 |
| leaf: flowering stage, normal | 2 |

Table 182. Provided are the foxtail millet transcriptome expression sets under normal conditions at flowering stage.

TABLE 183

Foxtail millet transcriptome expression sets under normal conditions at grain filling stage

| Expression Set | Set ID |
|---|---|
| grain: grain filling stage, normal | 4 |
| leaf: grain filling stage, normal | 5 |
| stem: grain filling stage, normal | 6 |

Table 183. Provided are the foxtail millet transcriptome expression sets under normal conditions at grain filling stage.

Foxtail Millet Yield Components and Vigor Related Parameters Assessment—Plants were continuously phenotyped during the growth period and at harvest (Tables 184-185, below). The image analysis system included a personal desktop computer (Intel P4 3.0 GHz processor) and a public domain program—ImageJ 1.37 (Java based image processing program, which was developed at the U.S.

National Institutes of Health and freely available on the internet [rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

Average Grain Area (cm$^2$)—A sample of ~200 grains was weighted, photographed and images were processed using the below described image processing system. The grain area was measured from those images and was divided by the number of grains.

Average Grain Length and width (cm)—A sample of ~200 grains was weighted, photographed and images were processed using the below described image processing system. The sum of grain lengths and width (longest axis) were measured from those images and were divided by the number of grains.

At the end of the growing period 14 'Heads' were photographed and images were processed using the below described image processing system.

Average Grain Perimeter (cm)—At the end of the growing period the grains were separated from the Plant 'Head'. A sample of ~200 grains were weighted, photographed and images were processed using the below described image processing system. The sum of grain perimeter was measured from those images and was divided by the number of grains.

Head Average Area (cm$^2$)—The 'Head' area was measured from those images and was divided by the number of 'Heads'.

Head Average Length and width (cm)—The 'Head' length and width (longest axis) were measured from those images and were divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Head weight (Kg.) and head number (num.)—At the end of the experiment, heads were harvested from each plot and were counted and weighted.

Total Grain Yield (gr.)—At the end of the experiment (plant 'Heads') heads from plots were collected, the heads were threshed and grains were weighted. In addition, the average grain weight per head was calculated by dividing the total grain weight by number of total heads per plot (based on plot).

1000 Seeds weight [gr.]—was calculated based on Formula 14 (above).

Biomass at harvest [kg]—At the end of the experiment the vegetative portion above ground (excluding roots) from plots was weighted.

Total dry mater per plot [kg]—Calculated as Vegetative portion above ground plus all the heads dry weight per plot.

Number (num) of days to anthesis—Calculated as the number of days from sowing till 50% of the plot arrives anthesis.

Maintenance of performance under drought conditions—Represent ratio for the specified parameter of Drought condition results divided by Normal conditions results (maintenance of phenotype under drought in comparison to normal conditions).

Data parameters collected are summarized in Tables 184-185, herein below.

TABLE 184

Foxtail millet correlated parameters under drought and normal conditions (vectors)

| Correlated parameter with | Correlation ID |
| --- | --- |
| 1000 grain weight [gr.] | 1 |
| Biomass at harvest [kg] | 2 |
| Grain area [cm$^2$] | 3 |
| Grain length [cm] | 4 |
| Grain Perimeter [cm] | 5 |
| Grain width [cm] | 6 |
| Grains yield per Head (plot) [gr.] | 7 |
| Head Area [cm$^2$] | 8 |
| Head length [cm] | 9 |
| Head Width [cm] | 10 |
| Heads number [number] | 11 |
| Num days to Anthesis [days] | 12 |
| Total dry matter [kg] | 13 |
| Total Grains yield [gr.] | 14 |
| Total heads weight [kg] | 15 |

Table 184. Provided are the foxtail millet collected parameters under drought and normal conditions.

TABLE 185

Foxtail millet correlated parameters under drought vs. normal conditions (maintenance) (vectors)

| Correlated parameter with | Correlation ID |
| --- | --- |
| 1000 grain weight D/N [gr.] | 1 |
| Biomass at harvest D/N [kg] | 2 |
| Grain area D/N [cm$^2$] | 3 |
| Grain length D/N [cm] | 4 |
| Grain Perimeter D/N [cm] | 5 |
| Grain width D/N [cm] | 6 |
| Grains yield per Head (plot) D/N [gr.] | 7 |
| Head Area D/N [cm$^2$] | 8 |
| Head length D/N [cm] | 9 |
| Head Width D/N [cm] | 10 |
| Heads num D/N [num] | 11 |
| Total dry matter D/N [kg] | 12 |
| Total Grains yield D/N [gr.] | 13 |
| Total heads weight D/N [kg] | 14 |

Table 185. Provided are the foxtail millet collected parameters under drought vs. (versus) normal conditions (maintenance).

Experimental Results

Fifteen different foxtail millet accessions were grown and characterized for different parameters as described above (Table 184-185). The average for each of the measured parameters was calculated using the JMP software and values are summarized in Tables 186-191 below. Subsequent correlation analysis between the various transcriptome sets and the average parameters was conducted (Tables 192-197). Follow, results were integrated to the database.

TABLE 186

Measured parameters of correlation IDs in foxtail millet accessions under drought conditions

| Line/Corr. ID | 1 | 2 | 3 | 4 | 5 | 6 | 7 | 8 |
|---|---|---|---|---|---|---|---|---|
| 1 | 2.64 | 3.33 | 2.61 | 2.29 | 2.30 | 2.64 | 2.22 | 1.84 |
| 3 | 0.033 | 0.037 | 0.034 | 0.032 | 0.033 | 0.033 | 0.030 | 0.024 |
| 4 | 0.24 | 0.24 | 0.25 | 0.25 | 0.26 | 0.25 | 0.23 | 0.19 |
| 5 | 0.68 | 0.72 | 0.69 | 0.68 | 0.69 | 0.69 | 0.65 | 0.57 |
| 6 | 0.18 | 0.19 | 0.17 | 0.16 | 0.16 | 0.17 | 0.16 | 0.16 |
| 2 | 1.53 | 3.46 | 2.87 | 2.93 | 3.02 | 2.66 | 2.98 | 0.77 |
| 7 | 3.05 | 8.83 | 1.34 | 1.09 | 1.31 | 0.49 | 1.63 | 3.74 |
| 8 | 35.70 | 50.70 | 18.40 | 14.90 | 17.70 | 9.90 | 21.00 | 39.90 |
| 9 | 22.40 | 21.90 | 16.50 | 13.30 | 14.00 | 9.10 | 15.10 | 21.10 |
| 10 | 1.87 | 2.68 | 1.33 | 1.33 | 1.50 | 1.17 | 1.67 | 2.15 |
| 11 | 374.40 | 127.00 | 737.80 | 1100.80 | 1047.20 | 2050.00 | 581.50 | 311.60 |
| 12 | 34.00 | 41.00 | 51.00 | 41.00 | 41.00 | 30.00 | 38.00 | 30.00 |
| 14 | 1141.50 | 1116.20 | 988.20 | 1202.80 | 1360.50 | 995.20 | 946.80 | 1159.80 |
| 13 | 0.50 | 0.73 | 0.80 | 0.62 | 0.71 | 0.47 | 0.61 | 0.35 |
| 15 | 2.89 | 6.09 | 5.33 | 5.40 | 5.57 | 5.28 | 5.12 | 2.29 |

Table 186: Provided are the values of each of the parameters (as described above) measured in Foxtail millet accessions (Line). Growth conditions are specified in the experimental procedure section.

TABLE 187

Additional measured parameters of correlation IDs in foxtail millet accessions under drought conditions

| Line/Corr. ID | 9 | 10 | 11 | 12 | 13 | 14 |
|---|---|---|---|---|---|---|
| 1 | 2.54 | 1.69 | 3.10 | 2.54 | 3.24 | 2.25 |
| 3 | 0.032 | 0.025 | 0.037 | 0.032 | 0.039 | 0.030 |
| 4 | 0.22 | 0.20 | 0.26 | 0.25 | 0.27 | 0.24 |
| 5 | 0.66 | 0.59 | 0.72 | 0.68 | 0.75 | 0.66 |
| 6 | 0.18 | 0.16 | 0.18 | 0.17 | 0.18 | 0.16 |
| 2 | 2.66 | 2.95 | 3.23 | 3.30 | 2.63 | 0.89 |
| 7 | 9.90 | 4.14 | 2.97 | 1.30 | 0.36 | 1.74 |
| 8 | 42.10 | 43.50 | 26.90 | 21.20 | 7.30 | 13.10 |
| 9 | 20.00 | 21.80 | 20.80 | 15.80 | 6.40 | 9.20 |
| 10 | 2.36 | 2.32 | 1.54 | 1.59 | 1.25 | 1.74 |
| 11 | 147.20 | 95.40 | 414.40 | 667.80 | 2441.00 | 687.50 |
| 12 | 38.00 | NA | 44.00 | 51.00 | 31.00 | 27.00 |
| 14 | 1391.40 | 394.50 | 1199.50 | 872.50 | 873.90 | 1188.00 |
| 13 | 0.44 | 0.65 | 0.75 | 0.87 | 0.52 | 0.36 |
| 15 | 5.83 | 4.32 | 5.64 | 5.13 | 5.13 | 2.31 |

Table 187: Provided are the values of each of the parameters (as described above) measured in Foxtail millet accessions (Line). Growth conditions are specified in the experimental procedure section.

TABLE 188

Measured parameters of correlation IDs in foxtail millet accessions for Maintenance of performance under drought conditions

| Line/Corr. ID | 1 | 2 | 3 | 4 | 5 | 6 | 7 |
|---|---|---|---|---|---|---|---|
| 1 | 107.30 | 97.40 | 99.90 | 97.30 | 95.70 | 99.50 | 101.40 |
| 2 | 63.80 | 86.70 | 90.60 | 82.00 | 84.00 | 87.20 | 73.60 |
| 3 | 103.10 | 101.10 | 102.80 | 100.90 | 101.60 | 99.80 | 101.10 |
| 4 | 100.70 | 101.10 | 100.40 | 100.40 | 100.20 | 99.50 | 101.00 |
| 5 | 101.10 | 100.60 | 101.00 | 100.30 | 100.60 | 99.40 | 100.90 |
| 6 | 102.30 | 100.00 | 102.40 | 100.40 | 101.30 | 100.20 | 100.20 |
| 7 | 89.90 | 121.20 | 76.40 | 84.00 | 83.20 | 70.00 | 77.40 |
| 8 | 94.50 | 87.60 | 93.90 | 87.40 | 89.50 | 105.30 | 91.60 |
| 9 | 96.70 | 90.20 | 94.00 | 90.00 | 91.00 | 106.40 | 93.90 |
| 10 | 98.20 | 98.30 | 99.90 | 98.40 | 97.90 | 98.80 | 99.00 |
| 11 | 87.60 | 85.10 | 85.10 | 91.40 | 91.30 | 96.20 | 77.30 |
| 12 | 71.70 | 85.80 | 82.90 | 66.70 | 78.30 | 98.00 | 66.30 |

TABLE 188-continued

Measured parameters of correlation IDs in foxtail millet accessions for Maintenance of performance under drought conditions

| Line/ Corr. ID | 1 | 2 | 3 | 4 | 5 | 6 | 7 |
|---|---|---|---|---|---|---|---|
| 13 | 78.70 | 104.50 | 64.40 | 76.70 | 75.80 | 67.40 | 59.80 |
| 14 | 75.80 | 102.30 | 85.90 | 95.80 | 88.80 | 86.90 | 81.00 |

Table 188: Provided are the values of each of the parameters (as described above) measured in Foxtail millet accessions (Line). Growth conditions are specified in the experimental procedure section.

TABLE 189

Additional measured parameters of correlation IDs in foxtail millet accessions for Maintenance of performance under drought conditions

| Line/ Corr. ID | 8 | 9 | 10 | 11 | 12 | 13 | 14 |
|---|---|---|---|---|---|---|---|
| 1 | 102.20 | 94.50 | 102.70 | 97.60 | 97.80 | 101.70 | 99.50 |
| 2 | 66.80 | 83.20 | 75.50 | 90.20 | 89.80 | 89.50 | 59.90 |
| 3 | 100.00 | 98.90 | 102.70 | 97.90 | 96.40 | 101.20 | 99.20 |
| 4 | 99.20 | 100.70 | 102.00 | 99.40 | 97.80 | 100.30 | 99.00 |
| 5 | 99.60 | 99.80 | 101.80 | 98.90 | 98.00 | 100.40 | 99.20 |
| 6 | 100.80 | 98.20 | 100.60 | 98.50 | 98.50 | 100.90 | 100.30 |
| 7 | 111.70 | 86.40 | 57.80 | 68.40 | 57.60 | 83.20 | 132.40 |
| 8 | 97.70 | 93.10 | 88.20 | 97.30 | 87.80 | 102.50 | 89.40 |
| 9 | 96.60 | 98.10 | 93.50 | 99.70 | 88.10 | 101.50 | 93.80 |
| 10 | 101.30 | 94.50 | 95.70 | 99.50 | 100.40 | 100.80 | 95.50 |
| 11 | 79.00 | 78.90 | 72.40 | 95.40 | 103.30 | 87.20 | 69.10 |
| 12 | 77.00 | 73.50 | 64.60 | 82.00 | 85.00 | 83.90 | 77.80 |
| 13 | 88.00 | 65.30 | 42.10 | 63.80 | 61.10 | 71.90 | 91.60 |
| 14 | 81.20 | 80.40 | 82.30 | 85.80 | 87.70 | 91.20 | 84.40 |

Table 189: Provided are the values of each of the parameters (as described above) measured in Foxtail millet accessions (Line). Growth conditions are specified in the experimental procedure section.

TABLE 190

Measured parameters of correlation IDs in foxtail millet accessions under normal conditions

| Line/ Corr. ID | 1 | 2 | 3 | 4 | 5 | 6 | 7 | 8 |
|---|---|---|---|---|---|---|---|---|
| 1 | 2.46 | 3.42 | 2.61 | 2.36 | 2.41 | 2.65 | 2.18 | 1.80 |
| 2 | 2.40 | 3.99 | 3.17 | 3.58 | 3.60 | 3.06 | 4.04 | 1.15 |
| 3 | 0.032 | 0.037 | 0.033 | 0.032 | 0.032 | 0.034 | 0.029 | 0.024 |
| 4 | 0.24 | 0.24 | 0.25 | 0.25 | 0.26 | 0.25 | 0.23 | 0.20 |
| 5 | 0.68 | 0.72 | 0.68 | 0.68 | 0.69 | 0.70 | 0.64 | 0.57 |
| 6 | 0.17 | 0.19 | 0.17 | 0.16 | 0.16 | 0.17 | 0.16 | 0.16 |
| 7 | 3.40 | 7.29 | 1.75 | 1.30 | 1.57 | 0.69 | 2.10 | 3.34 |
| 8 | 37.80 | 57.90 | 19.60 | 17.10 | 19.80 | 9.40 | 22.90 | 40.90 |
| 9 | 23.10 | 24.20 | 17.60 | 14.80 | 15.40 | 8.60 | 16.10 | 21.90 |
| 10 | 1.91 | 2.72 | 1.33 | 1.36 | 1.53 | 1.18 | 1.68 | 2.12 |
| 11 | 427.60 | 149.20 | 867.00 | 1204.00 | 1146.40 | 2132.00 | 752.20 | 394.20 |
| 12 | 34.00 | 41.00 | 45.00 | 41.00 | 41.00 | 30.00 | 38.00 | 30.00 |
| 13 | 0.70 | 0.85 | 0.96 | 0.92 | 0.90 | 0.48 | 0.92 | 0.45 |
| 14 | 1449.60 | 1067.90 | 1534.90 | 1567.20 | 1794.80 | 1476.10 | 1582.60 | 1317.90 |
| 15 | 3.81 | 5.95 | 6.20 | 5.64 | 6.27 | 6.07 | 6.32 | 2.82 |

Table 190: Provided are the values of each of the parameters (as described above) measured in Foxtail millet accessions (Line). Growth conditions are specified in the experimental procedure section.

TABLE 191

Additional measured parameters of correlation IDs in foxtail millet accessions under normal conditions

| Line/ Corr. ID | 9 | 10 | 11 | 12 | 13 | 14 |
|---|---|---|---|---|---|---|
| 1 | 2.69 | 1.65 | 3.17 | 2.60 | 3.18 | 2.26 |
| 2 | 3.20 | 3.90 | 3.58 | 3.68 | 2.94 | 1.48 |
| 3 | 0.032 | 0.025 | 0.037 | 0.033 | 0.039 | 0.030 |
| 4 | 0.22 | 0.20 | 0.26 | 0.25 | 0.27 | 0.24 |
| 5 | 0.66 | 0.58 | 0.73 | 0.69 | 0.75 | 0.67 |
| 6 | 0.18 | 0.16 | 0.18 | 0.17 | 0.18 | 0.16 |
| 7 | 11.46 | 7.17 | 4.35 | 2.26 | 0.44 | 1.31 |
| 8 | 45.30 | 49.30 | 27.70 | 24.20 | 7.10 | 14.70 |
| 9 | 20.40 | 23.30 | 20.90 | 18.00 | 6.40 | 9.80 |
| 10 | 2.50 | 2.43 | 1.55 | 1.58 | 1.24 | 1.82 |
| 11 | 186.60 | 131.80 | 434.20 | 646.40 | 2797.80 | 994.60 |
| 12 | 38.00 | 51.00 | 44.00 | 51.00 | 31.00 | 27.00 |
| 13 | 0.59 | 1.00 | 0.91 | 1.03 | 0.62 | 0.46 |
| 14 | 2131.60 | 937.90 | 1880.20 | 1427.10 | 1216.20 | 1296.70 |
| 15 | 7.25 | 5.24 | 6.58 | 5.85 | 5.62 | 2.73 |

Table 191: Provided are the values of each of the parameters (as described above) measured in Foxtail millet accessions (Line). Growth conditions are specified in the experimental procedure section.

TABLE 192

Correlation between the expression level of selected genes of some embodiments of the invention in various tissues and the phenotypic performance under drought conditions at flowering stage across foxtail millet varieties

| Gene Name | R | P value | Exp. set | Corr. ID | Gene Name | R | P value | Exp. set | Corr. ID |
|---|---|---|---|---|---|---|---|---|---|
| LBY290 | 0.76 | 1.00E−02 | 1 | 9 | LBY291 | 0.75 | 8.43E−03 | 2 | 8 |
| LBY291 | 0.71 | 1.50E−02 | 2 | 7 | LBY291 | 0.79 | 4.20E−03 | 2 | 10 |
| LBY291 | 0.77 | 9.54E−03 | 1 | 9 | LBY291 | 0.82 | 3.76E−03 | 1 | 8 |
| LBY291 | 0.84 | 2.10E−03 | 1 | 1 | LBY291 | 0.85 | 1.83E−03 | 1 | 6 |
| LBY291 | 0.79 | 6.70E−03 | 1 | 3 | LBY291 | 0.71 | 2.04E−02 | 1 | 10 |
| LBY292 | 0.75 | 8.43E−03 | 2 | 1 | LBY292 | 0.74 | 9.06E−03 | 2 | 6 |
| LBY292 | 0.82 | 3.31E−03 | 1 | 1 | LBY292 | 0.75 | 1.25E−02 | 1 | 6 |
| LBY292 | 0.71 | 2.06E−02 | 1 | 3 | LBY293 | 0.73 | 1.62E−02 | 1 | 8 |
| LBY293 | 0.75 | 1.27E−02 | 1 | 7 | LBY295 | 0.71 | 2.09E−02 | 1 | 9 |
| LBY295 | 0.73 | 1.62E−02 | 1 | 8 | LBY296 | 0.73 | 1.61E−02 | 1 | 11 |
| LBY299 | 0.80 | 5.44E−03 | 1 | 9 | LBY299 | 0.78 | 8.29E−03 | 1 | 8 |
| LBY299 | 0.70 | 2.28E−02 | 1 | 10 | LBY317 | 0.77 | 9.74E−03 | 1 | 9 |
| LBY317 | 0.87 | 1.22E−03 | 1 | 8 | LBY317 | 0.72 | 1.92E−02 | 1 | 1 |
| LBY317 | 0.82 | 4.07E−03 | 1 | 6 | LBY317 | 0.76 | 1.00E−02 | 1 | 7 |
| LBY317 | 0.78 | 8.06E−03 | 1 | 10 | LBY318 | 0.76 | 1.09E−02 | 1 | 5 |
| LBY318 | 0.91 | 2.12E−04 | 1 | 1 | LBY318 | 0.84 | 2.17E−03 | 1 | 6 |
| LBY318 | 0.86 | 1.39E−03 | 1 | 3 | LBY319 | 0.76 | 1.08E−02 | 1 | 9 |
| LBY320 | 0.71 | 2.15E−02 | 1 | 9 | LBY322 | 0.72 | 1.22E−02 | 2 | 10 |
| LBY322 | 0.82 | 3.85E−03 | 1 | 9 | LBY322 | 0.75 | 1.33E−02 | 1 | 5 |
| LBY322 | 0.77 | 8.90E−03 | 1 | 8 | LBY322 | 0.80 | 5.44E−03 | 1 | 1 |
| LBY322 | 0.75 | 1.30E−02 | 1 | 6 | LBY322 | 0.81 | 4.17E−03 | 1 | 3 |
| LBY369 | 0.79 | 1.15E−02 | 3 | 11 | LBY414 | 0.71 | 2.04E−02 | 1 | 2 |
| LBY417 | 0.90 | 3.42E−04 | 1 | 9 | LBY417 | 0.78 | 8.37E−03 | 1 | 8 |
| LBY418 | 0.75 | 1.24E−02 | 1 | 1 | LBY418 | 0.72 | 2.01E−02 | 1 | 6 |
| LBY418 | 0.72 | 1.98E−02 | 1 | 3 | LBY419 | 0.74 | 2.32E−02 | 3 | 3 |
| LBY419 | 0.76 | 1.01E−02 | 1 | 11 | MGP66 | 0.71 | 1.42E−02 | 2 | 3 |

Table 192. Provided are the correlations (R) between the genes expression levels in various tissues and the phenotypic performance "Corr. ID "—correlation set ID according to the correlated parameters specified in Table 184.

"Exp. Set"—Expression set specified in Table 180.

"R" = Pearson correlation coefficient;

"P" = p value.

TABLE 193

Correlation between the expression level of selected genes of some embodiments of the invention in various tissues and the phenotypic performance under drought conditions at grain filling stage across foxtail millet varieties

| Gene Name | R | P value | Exp. set | Corr. ID | Gene Name | R | P value | Exp. set | Corr. ID |
|---|---|---|---|---|---|---|---|---|---|
| LBY243 | 0.71 | 2.07E−02 | 3 | 13 | LBY266 | 0.73 | 1.00E−01 | 1 | 12 |
| LBY266 | 0.85 | 3.24E−02 | 1 | 14 | LBY266 | 0.71 | 2.17E−02 | 3 | 4 |
| LBY267 | 0.71 | 1.16E−01 | 1 | 14 | LBY267 | 0.73 | 1.55E−02 | 2 | 11 |
| LBY267 | 0.80 | 5.45E−03 | 2 | 4 | LBY291 | 0.89 | 1.62E−02 | 1 | 3 |
| LBY291 | 0.84 | 3.69E−02 | 1 | 5 | LBY291 | 0.82 | 4.58E−02 | 1 | 6 |
| LBY291 | 0.86 | 2.70E−02 | 1 | 1 | LBY292 | 0.75 | 1.28E−02 | 2 | 7 |
| LBY292 | 0.72 | 1.85E−02 | 2 | 6 | LBY292 | 0.71 | 2.23E−02 | 2 | 1 |
| LBY294 | 0.80 | 5.53E−03 | 3 | 11 | LBY295 | 0.80 | 5.35E−02 | 1 | 3 |
| LBY295 | 0.72 | 1.08E−01 | 1 | 5 | LBY295 | 0.90 | 1.34E−02 | 1 | 6 |
| LBY295 | 0.85 | 3.13E−02 | 1 | 1 | LBY296 | 0.93 | 7.86E−03 | 1 | 11 |
| LBY296 | 0.75 | 8.39E−02 | 1 | 4 | LBY297 | 0.86 | 2.99E−02 | 1 | 3 |
| LBY297 | 0.81 | 5.05E−02 | 1 | 5 | LBY297 | 0.82 | 4.54E−02 | 1 | 6 |
| LBY297 | 0.85 | 3.20E−02 | 1 | 1 | LBY298 | 0.92 | 1.43E−04 | 2 | 13 |
| LBY298 | 0.89 | 5.84E−04 | 2 | 12 | LBY299 | 0.82 | 4.61E−02 | 1 | 3 |
| LBY299 | 0.72 | 1.10E−01 | 1 | 5 | LBY299 | 0.91 | 1.15E−02 | 1 | 6 |
| LBY299 | 0.88 | 2.10E−02 | 1 | 1 | LBY318 | 0.79 | 6.46E−03 | 2 | 10 |
| LBY319 | 0.85 | 3.25E−02 | 1 | 3 | LBY319 | 0.71 | 1.17E−01 | 1 | 4 |
| LBY319 | 0.84 | 3.57E−02 | 1 | 5 | LBY319 | 0.74 | 9.12E−02 | 1 | 1 |
| LBY320 | 0.75 | 8.89E−02 | 1 | 3 | LBY320 | 0.77 | 7.32E−02 | 1 | 6 |
| LBY320 | 0.74 | 9.15E−02 | 1 | 1 | LBY322 | 0.76 | 7.80E−02 | 1 | 3 |
| LBY322 | 0.72 | 1.04E−01 | 1 | 5 | LBY322 | 0.71 | 1.11E−01 | 1 | 6 |
| LBY322 | 0.75 | 8.78E−02 | 1 | 1 | LBY322 | 0.72 | 1.82E−02 | 2 | 13 |
| LBY322 | 0.72 | 2.01E−02 | 2 | 12 | LBY371 | 0.83 | 4.22E−02 | 1 | 9 |
| LBY371 | 0.73 | 1.03E−01 | 1 | 4 | LBY371 | 0.83 | 3.92E−02 | 1 | 14 |
| LBY371 | 0.76 | 7.90E−02 | 1 | 8 | LBY371 | 0.81 | 4.53E−03 | 2 | 10 |
| LBY371 | 0.89 | 6.06E−04 | 2 | 7 | LBY371 | 0.82 | 4.01E−03 | 2 | 8 |
| LBY414 | 0.73 | 1.64E−02 | 2 | 10 | LBY414 | 0.73 | 1.63E−02 | 2 | 7 |
| LBY417 | 0.84 | 2.32E−03 | 3 | 15 | LBY417 | 0.79 | 5.93E−02 | 1 | 6 |
| LBY417 | 0.79 | 6.48E−03 | 3 | 12 | LBY417 | 0.83 | 3.18E−03 | 3 | 9 |
| LBY419 | 0.74 | 9.15E−02 | 1 | 9 | LBY417 | 0.85 | 1.72E−03 | 3 | 2 |
| MGP66 | 0.93 | 8.04E−05 | 2 | 10 | MGP66 | 0.89 | 4.80E−04 | 2 | 7 |
| MGP66 | 0.82 | 3.34E−03 | 2 | 8 | MGP67 | 0.77 | 9.31E−03 | 2 | 10 |
| MGP67 | 0.83 | 3.13E−03 | 2 | 7 | MGP67 | 0.76 | 1.15E−02 | 2 | 6 |
| MGP67 | 0.78 | 8.33E−03 | 2 | 8 | | | | | |

Table 193. Provided are the correlations (R) between the genes expression levels in various tissues and the phenotypic performance.
"Corr. ID" - correlation set ID according to the correlated parameters specified in Table 184.
"Exp. Set" - Expression set specified in Table 181.
"R" = Pearson correlation coefficient;
"P" = p value.

TABLE 194

Correlation between the expression level of selected genes of some embodiments of the invention in various tissues and the phenotypic performance under normal conditions at flowering stage across foxtail millet varieties

| Gene Name | R | P value | Exp. set | Corr. ID | Gene Name | R | P value | Exp. set | Corr. ID |
|---|---|---|---|---|---|---|---|---|---|
| LBY266 | 0.83 | 2.76E−03 | 2 | 14 | LBY267 | 0.73 | 1.61E−02 | 2 | 10 |
| LBY290 | 0.82 | 2.10E−03 | 1 | 14 | LBY290 | 0.73 | 1.04E−02 | 1 | 7 |
| LBY294 | 0.79 | 6.95E−03 | 2 | 14 | LBY297 | 0.75 | 8.32E−03 | 1 | 7 |
| LBY298 | 0.77 | 5.75E−03 | 1 | 12 | LBY317 | 0.79 | 6.61E−03 | 2 | 7 |
| LBY317 | 0.73 | 1.75E−02 | 2 | 10 | LBY322 | 0.75 | 8.40E−03 | 1 | 6 |
| LBY322 | 0.76 | 7.03E−03 | 1 | 1 | LBY417 | 0.90 | 4.43E−04 | 2 | 14 |

Table 194. Provided are the correlations (R) between the genes expression levels in various tissues and the phenotypic performance.
"Corr. ID" - correlation set ID according to the correlated parameters specified in Table 184.
"Exp. Set" - Expression set specified in Table 182.
"R" = Pearson correlation coefficient;
"P" = p value.

TABLE 195

Correlation between the expression level of selected genes of some embodiments of the invention in various tissues and the phenotypic performance under normal conditions at grain filling stage across foxtail millet varieties

| Gene Name | R | P value | Exp. set | Corr. ID | Gene Name | R | P value | Exp. set | Corr. ID |
|---|---|---|---|---|---|---|---|---|---|
| LBY243 | 0.88 | 2.14E−02 | 1 | 15 | LBY243 | 0.80 | 5.48E−02 | 1 | 7 |
| LBY243 | 0.71 | 1.17E−01 | 1 | 10 | LBY266 | 0.80 | 1.66E−02 | 3 | 11 |
| LBY266 | 0.72 | 1.07E−01 | 1 | 7 | LBY266 | 0.71 | 1.12E−01 | 1 | 10 |
| LBY267 | 0.73 | 1.00E−01 | 1 | 11 | LBY290 | 0.74 | 1.44E−02 | 2 | 3 |
| LBY290 | 0.76 | 1.14E−02 | 2 | 5 | LBY290 | 0.93 | 6.73E−03 | 1 | 9 |
| LBY290 | 0.73 | 9.71E−02 | 1 | 3 | LBY290 | 0.82 | 4.48E−02 | 1 | 1 |
| LBY290 | 0.90 | 1.42E−02 | 1 | 6 | LBY290 | 0.89 | 1.69E−02 | 1 | 7 |
| LBY290 | 0.94 | 4.72E−03 | 1 | 8 | LBY290 | 0.92 | 8.43E−03 | 1 | 10 |
| LBY291 | 0.84 | 3.59E−02 | 1 | 9 | LBY291 | 0.77 | 7.26E−02 | 1 | 1 |
| LBY291 | 0.85 | 3.12E−02 | 1 | 6 | LBY291 | 0.88 | 2.02E−02 | 1 | 8 |
| LBY291 | 0.85 | 3.31E−02 | 1 | 10 | LBY292 | 0.86 | 2.81E−02 | 1 | 12 |
| LBY292 | 0.80 | 5.53E−02 | 1 | 13 | LBY292 | 0.80 | 5.57E−02 | 1 | 4 |
| LBY293 | 0.72 | 1.79E−02 | 2 | 5 | LBY293 | 0.75 | 1.24E−02 | 2 | 4 |
| LBY293 | 0.87 | 5.01E−03 | 3 | 7 | LBY293 | 0.77 | 2.66E−02 | 3 | 8 |
| LBY293 | 0.95 | 2.49E−04 | 3 | 10 | LBY293 | 0.93 | 8.17E−03 | 1 | 9 |
| LBY293 | 0.81 | 5.08E−02 | 1 | 6 | LBY293 | 0.88 | 2.23E−02 | 1 | 8 |
| LBY293 | 0.82 | 4.58E−02 | 1 | 10 | LBY293 | 0.73 | 3.96E−02 | 3 | 6 |
| LBY294 | 0.93 | 7.22E−03 | 1 | 9 | LBY294 | 0.74 | 9.53E−02 | 1 | 3 |
| LBY294 | 0.84 | 3.76E−02 | 1 | 1 | LBY294 | 0.92 | 9.49E−03 | 1 | 6 |
| LBY294 | 0.95 | 3.45E−03 | 1 | 8 | LBY294 | 0.90 | 1.54E−02 | 1 | 10 |
| LBY295 | 0.72 | 4.54E−02 | 3 | 15 | LBY295 | 0.90 | 1.34E−02 | 1 | 9 |
| LBY295 | 0.76 | 7.66E−02 | 1 | 1 | LBY295 | 0.83 | 3.94E−02 | 1 | 6 |
| LBY295 | 0.89 | 1.82E−02 | 1 | 8 | LBY295 | 0.84 | 3.58E−02 | 1 | 10 |
| LBY296 | 0.77 | 2.64E−02 | 3 | 9 | LBY296 | 0.83 | 1.14E−02 | 3 | 11 |
| LBY296 | 0.72 | 1.08E−01 | 1 | 4 | LBY297 | 0.85 | 3.07E−02 | 1 | 9 |
| LBY297 | 0.70 | 1.18E−01 | 1 | 3 | LBY298 | 0.79 | 7.05E−03 | 2 | 12 |
| LBY298 | 0.74 | 3.62E−02 | 3 | 14 | LBY298 | 0.72 | 4.34E−02 | 3 | 6 |
| LBY298 | 0.96 | 2.13E−04 | 3 | 7 | LBY298 | 0.91 | 1.58E−03 | 3 | 8 |
| LBY298 | 0.80 | 1.68E−02 | 3 | 10 | LBY298 | 0.77 | 7.63E−02 | 1 | 9 |
| LBY298 | 0.83 | 4.29E−02 | 1 | 6 | LBY298 | 0.71 | 1.16E−01 | 1 | 7 |
| LBY298 | 0.84 | 3.65E−02 | 1 | 8 | LBY298 | 0.85 | 3.12E−02 | 1 | 10 |
| LBY299 | 0.89 | 5.02E−04 | 2 | 3 | LBY299 | 0.90 | 3.74E−04 | 2 | 1 |
| LBY299 | 0.84 | 2.44E−03 | 2 | 5 | LBY299 | 0.76 | 1.14E−02 | 2 | 6 |
| LBY299 | 0.70 | 5.20E−02 | 3 | 14 | LBY299 | 0.82 | 1.35E−02 | 3 | 7 |
| LBY299 | 0.89 | 1.73E−02 | 1 | 9 | LBY299 | 0.84 | 3.70E−02 | 1 | 6 |
| LBY299 | 0.73 | 9.97E−02 | 1 | 7 | LBY299 | 0.89 | 1.77E−02 | 1 | 8 |
| LBY299 | 0.86 | 2.81E−02 | 1 | 10 | LBY300 | 0.71 | 4.72E−02 | 3 | 7 |
| LBY300 | 0.70 | 5.23E−02 | 3 | 10 | LBY300 | 0.86 | 2.62E−02 | 1 | 9 |
| LBY300 | 0.73 | 9.99E−02 | 1 | 6 | LBY300 | 0.79 | 5.96E−02 | 1 | 8 |
| LBY300 | 0.75 | 8.52E−02 | 1 | 10 | LBY317 | 0.81 | 5.24E−02 | 1 | 7 |
| LBY317 | 0.71 | 1.14E−01 | 1 | 6 | LBY317 | 0.80 | 5.45E−02 | 1 | 10 |
| LBY317 | 0.71 | 1.13E−01 | 1 | 8 | LBY318 | 0.77 | 7.47E−02 | 1 | 1 |
| LBY318 | 0.86 | 2.80E−02 | 1 | 15 | LBY318 | 0.78 | 6.59E−02 | 1 | 10 |
| LBY318 | 0.74 | 9.19E−02 | 1 | 6 | LBY319 | 0.72 | 4.28E−02 | 3 | 12 |
| LBY319 | 0.74 | 3.69E−02 | 3 | 9 | LBY319 | 0.78 | 6.73E−02 | 1 | 7 |
| LBY319 | 0.74 | 3.63E−02 | 3 | 8 | LBY320 | 0.78 | 6.99E−02 | 1 | 6 |
| LBY320 | 0.97 | 1.60E−03 | 1 | 9 | LBY320 | 0.74 | 8.94E−02 | 1 | 10 |
| LBY320 | 0.85 | 3.00E−02 | 1 | 8 | LBY321 | 0.88 | 4.13E−03 | 3 | 10 |
| LBY321 | 0.83 | 1.10E−02 | 3 | 7 | LBY321 | 0.73 | 9.61E−02 | 1 | 4 |
| LBY321 | 0.82 | 4.57E−02 | 1 | 11 | LBY322 | 0.94 | 5.63E−04 | 3 | 14 |
| LBY322 | 0.81 | 1.57E−02 | 3 | 9 | LBY322 | 0.89 | 2.83E−03 | 3 | 8 |
| LBY322 | 0.89 | 2.80E−03 | 3 | 7 | LBY322 | 0.80 | 5.87E−02 | 1 | 7 |
| LBY322 | 0.75 | 8.42E−02 | 1 | 9 | LBY368 | 0.73 | 3.80E−02 | 3 | 7 |
| LBY322 | 0.71 | 1.14E−01 | 1 | 8 | LBY368 | 0.93 | 7.23E−03 | 1 | 9 |
| LBY368 | 0.83 | 1.14E−02 | 3 | 10 | LBY368 | 0.86 | 2.77E−02 | 1 | 6 |
| LBY368 | 0.81 | 5.25E−02 | 1 | 1 | LBY368 | 0.91 | 1.27E−02 | 1 | 8 |
| LBY368 | 0.74 | 9.12E−02 | 1 | 7 | LBY368 | 0.91 | 1.06E−02 | 1 | 10 |
| LBY417 | 0.77 | 7.38E−02 | 1 | 9 | LBY414 | 0.74 | 9.02E−02 | 1 | 10 |
| LBY417 | 0.79 | 5.90E−02 | 1 | 8 | LBY417 | 0.75 | 8.65E−02 | 1 | 6 |
| LBY418 | 0.87 | 5.27E−03 | 3 | 11 | LBY417 | 0.80 | 5.60E−02 | 1 | 10 |
| LBY418 | 0.73 | 1.01E−01 | 1 | 6 | LBY418 | 0.87 | 2.32E−02 | 1 | 11 |
| LBY418 | 0.72 | 1.09E−01 | 1 | 8 | LBY418 | 0.90 | 1.32E−02 | 1 | 7 |
| LBY418 | 0.80 | 5.73E−02 | 1 | 4 | LBY418 | 0.76 | 7.83E−02 | 1 | 10 |
| LBY421 | 0.72 | 1.07E−01 | 1 | 9 | LBY419 | 0.79 | 6.42E−02 | 1 | 12 |
| MGP48 | 0.76 | 1.06E−02 | 2 | 12 | MGP67 | 0.84 | 3.51E−02 | 1 | 10 |
| MGP48 | 0.79 | 6.41E−02 | 1 | 4 | MGP48 | 0.94 | 5.12E−03 | 1 | 11 |
| MGP66 | 0.86 | 2.65E−02 | 1 | 6 | MGP66 | 0.71 | 1.14E−01 | 1 | 9 |
| MGP66 | 0.86 | 2.83E−02 | 1 | 8 | MGP66 | 0.89 | 1.73E−02 | 1 | 7 |
| MGP67 | 0.70 | 1.19E−01 | 1 | 9 | MGP66 | 0.93 | 6.88E−03 | 1 | 10 |

TABLE 195-continued

Correlation between the expression level of selected genes of some embodiments of the invention in various tissues and the phenotypic performance under normal conditions at grain filling stage across foxtail millet varieties

| Gene Name | R | P value | Exp. set | Corr. ID | Gene Name | R | P value | Exp. set | Corr. ID |
|---|---|---|---|---|---|---|---|---|---|
| MGP67 | 0.80 | 5.49E−02 | 1 | 7 | MGP67 | 0.78 | 6.58E−02 | 1 | 6 |
|  |  |  |  |  | MGP67 | 0.79 | 5.93E−02 | 1 | 8 |

Table 195. Provided are the correlations (R) between the genes expression levels in various tissues and the phenotypic performance.
"Corr. ID" - correlation set ID according to the correlated parameters specified in Table 184.
"Exp. Set" - Expression set specified in Table 183.
"R" = Pearson correlation coefficient;
"P" = p value.

TABLE 196

Correlation between the expression level of selected genes of some embodiments of the invention in various tissues and the phenotypic performance of maintenance of performance under drought vs. normal conditions at flowering stage across foxtail millet varieties

| Gene Name | R | P value | Exp. set | Corr. ID | Gene Name | R | P value | Exp. set | Corr. ID |
|---|---|---|---|---|---|---|---|---|---|
| LBY290 | 0.76 | 6.54E−03 | 2 | 7 | LBY296 | 0.83 | 2.65E−03 | 1 | 8 |
| LBY296 | 0.82 | 4.03E−03 | 1 | 9 | LBY299 | 0.75 | 1.21E−02 | 1 | 3 |
| LBY299 | 0.80 | 5.47E−03 | 1 | 5 | LBY321 | 0.75 | 8.07E−03 | 2 | 3 |
| LBY321 | 0.81 | 2.52E−03 | 2 | 6 | LBY369 | 0.79 | 6.64E−03 | 1 | 8 |
| LBY368 | 0.72 | 2.80E−02 | 3 | 1 | LBY371 | 0.76 | 1.86E−02 | 3 | 11 |
| LBY369 | 0.75 | 1.30E−02 | 1 | 9 | LBY417 | 0.76 | 1.13E−02 | 1 | 4 |
| LBY417 | 0.72 | 1.78E−02 | 1 | 5 | LBY418 | 0.82 | 6.77E−03 | 3 | 14 |
| LBY421 | 0.79 | 3.87E−03 | 2 | 9 | LBY421 | 0.84 | 1.37E−03 | 2 | 8 |
| MGP66 | 0.74 | 2.39E−02 | 3 | 13 | MGP67 | 0.71 | 3.21E−02 | 3 | 11 |
| MGP66 | 0.87 | 2.10E−03 | 3 | 14 |  |  |  |  |  |

Table 196. Provided are the correlations (R) between the genes expression levels in various tissues and the phenotypic performance.
"Corr. ID" - correlation set ID according to the correlated parameters specified in Table 185.
"Exp. Set" - Expression set specified in Table 180.
"R" = Pearson correlation coefficient;
"P" = p value.

TABLE 197

Correlation between the expression level of selected genes of some embodiments of the invention in various tissues and the phenotypic performance of maintenance of performance under drought vs. normal conditions at grain filling stage across foxtail millet varieties

| Gene Name | R | value | Exp. set | Corr. ID | Gene Name | R | P value | Exp. set | Corr. ID |
|---|---|---|---|---|---|---|---|---|---|
| LBY243 | 0.76 | 8.14E−02 | 1 | 4 | LBY243 | 0.80 | 5.35E−02 | 1 | 5 |
| LBY243 | 0.72 | 1.91E−02 | 3 | 14 | LBY266 | 0.71 | 2.13E−02 | 3 | 3 |
| LBY266 | 0.70 | 2.38E−02 | 3 | 6 | LBY267 | 0.71 | 2.17E−02 | 2 | 9 |
| LBY267 | 0.76 | 1.04E−02 | 2 | 8 | LBY267 | 0.77 | 8.62E−03 | 3 | 4 |
| LBY267 | 0.79 | 6.40E−03 | 3 | 3 | LBY267 | 0.88 | 8.00E−04 | 3 | 5 |
| LBY290 | 0.71 | 2.23E−02 | 2 | 7 | LBY290 | 0.84 | 2.10E−03 | 3 | 7 |
| LBY292 | 0.79 | 5.99E−02 | 1 | 11 | LBY292 | 0.72 | 1.96E−02 | 2 | 14 |
| LBY293 | 0.83 | 4.10E−02 | 1 | 1 | LBY293 | 0.85 | 3.09E−02 | 1 | 6 |
| LBY293 | 0.75 | 1.33E−02 | 2 | 7 | LBY294 | 0.78 | 6.51E−02 | 1 | 3 |
| LBY294 | 0.77 | 7.04E−02 | 1 | 6 | LBY294 | 0.81 | 4.77E−03 | 3 | 8 |
| LBY295 | 0.71 | 1.11E−01 | 1 | 13 | LBY295 | 0.73 | 1.01E−01 | 1 | 7 |
| LBY296 | 0.89 | 1.78E−02 | 1 | 9 | LBY296 | 0.93 | 6.63E−03 | 1 | 8 |
| LBY296 | 0.76 | 1.12E−02 | 3 | 1 | LBY297 | 0.82 | 4.39E−02 | 1 | 13 |
| LBY297 | 0.71 | 1.16E−01 | 1 | 14 | LBY298 | 0.76 | 8.03E−02 | 1 | 3 |
| LBY298 | 0.77 | 7.13E−02 | 1 | 5 | LBY300 | 0.85 | 3.29E−02 | 1 | 3 |
| LBY300 | 0.74 | 9.20E−02 | 1 | 6 | LBY317 | 0.89 | 1.77E−02 | 1 | 10 |
| LBY368 | 0.81 | 4.98E−02 | 1 | 1 | LBY368 | 0.87 | 2.61E−02 | 1 | 3 |
| LBY368 | 0.88 | 2.09E−02 | 1 | 6 | LBY369 | 0.77 | 8.79E−03 | 3 | 1 |
| LBY371 | 0.76 | 8.08E−02 | 1 | 3 | LBY371 | 0.72 | 1.10E−01 | 1 | 13 |
| LBY371 | 0.70 | 1.19E−01 | 1 | 7 | LBY371 | 0.83 | 4.17E−02 | 1 | 10 |
| LBY414 | 0.79 | 6.27E−02 | 1 | 7 | LBY414 | 0.76 | 7.64E−02 | 1 | 13 |

TABLE 197-continued

Correlation between the expression level of selected genes of some embodiments of the invention in various tissues and the phenotypic performance of maintenance of performance under drought vs. normal conditions at grain filling stage across foxtail millet varieties

| Gene Name | R | P value | Exp. set | Corr. ID | Gene Name | R | P value | Exp. set | Corr. ID |
|---|---|---|---|---|---|---|---|---|---|
| LBY417 | 0.98 | 7.93E−04 | 1 | 1 | LBY417 | 0.88 | 2.18E−02 | 1 | 3 |
| LBY417 | 0.96 | 2.29E−03 | 1 | 6 | LBY417 | 0.87 | 9.35E−04 | 2 | 10 |
| LBY418 | 0.76 | 1.06E−02 | 3 | 4 | LBY418 | 0.73 | 1.64E−02 | 3 | 3 |
| LBY418 | 0.81 | 4.69E−03 | 3 | 5 | LBY419 | 0.84 | 3.42E−02 | 1 | 3 |
| LBY419 | 0.85 | 3.25E−02 | 1 | 6 | LBY419 | 0.76 | 1.11E−02 | 2 | 7 |
| LBY421 | 0.82 | 4.50E−02 | 1 | 8 | LBY421 | 0.79 | 6.16E−02 | 1 | 9 |
|  |  |  |  |  | MGP48 | 0.93 | 6.72E−03 | 1 | 8 |

Table 197. Provided are the correlations (R) between the genes expression levels in various tissues and the phenotypic performance.
"Corr. ID" - correlation set ID according to the correlated parameters specified in Table 185.
"Exp. Set"- Expression set specified in Table 181.
"R" = Pearson correlation coefficient;
"P" = p value.

Example 17

Production of Foxtail Millet Transcriptome and High Throughput Correlation Analysis Using 60K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [chem. (dot) agilent (dot) com/Scripts/PDS (dot) asp?l-Page=50879]. The array oligonucleotide represents about 60K foxtail millet genes and transcripts. In order to define correlations between the levels of RNA expression and yield or vigor related parameters, various plant characteristics of 14 different foxtail millet accessions were analyzed. Among them, 11 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Fourteen Foxtail millet accessions in 5 repetitive plots, in the field. Foxtail millet seeds were sown in soil and grown under normal condition [15 units of Nitrogen (kg nitrogen per dunam)] and reduced nitrogen fertilization (2.5-3.0 units of Nitrogen in the soil (based on soil measurements)).

Analyzed Foxtail millet tissues—tissues at different developmental stages [leaf, flower, head, root, vein and stem], representing different plant characteristics, were sampled and RNA was extracted as described above. Each micro-array expression information tissue type has received a Set ID as summarized in Tables 198-199 below.

TABLE 198

Foxtail millet transcriptome expression sets under normal conditions

| Expression Set | Set ID |
|---|---|
| flag leaf grown under Normal conditions, grain filling stage | 1 |
| flag leaf grown under Normal conditions, heading stage | 2 |
| flower grown under Normal conditions, heading stage | 3 |
| head grown under Normal conditions, grain filling stage | 4 |
| leaf grown under Normal conditions, seedling stage | 5 |
| low stem grown under Normal conditions, heading stage | 6 |
| mature leaf grown under Normal conditions, grain filling stage | 7 |
| root grown under Normal conditions, seedling stage | 8 |
| stem grown under Normal conditions, seedling stage | 9 |
| stem node grown under Normal conditions, grain filling stage | 10 |
| up stem grown under Normal conditions, grain filling stage | 11 |
| up stem grown under Normal conditions, heading stage | 12 |
| vein grown under Normal conditions, grain filling stage | 13 |

Table 198. Provided are the foxtail millet transcriptome expression sets under normal conditions

TABLE 199

Foxtail millet transcriptome expression sets under low N conditions

| Expression Set | Set ID |
|---|---|
| flag leaf grown under Low N conditions, grain filling stage | 1 |
| flag leaf grown under Low N conditions, heading stage | 2 |
| flower grown under Low N conditions, heading stage | 3 |
| head grown under Low N conditions, grain filling stage | 4 |
| low stem grown under Low N conditions, heading stage | 5 |
| mature leaf grown under Low N conditions, grain filling stage | 6 |
| stem node grown under Low N conditions, grain filling stage | 7 |
| up stem grown under Low N conditions, grain filling stage | 8 |
| up stem grown under Low N conditions, heading stage | 9 |
| vein grown under Low N conditions, grain filling stage | 10 |

Table 199. Provided are the foxtail millet transcriptome expression sets under low N conditions.

Foxtail Millet Yield Components and Vigor Related Parameters Assessment—Plants were continuously phenotyped during the growth period and at harvest (Tables 200-201, below). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length and width (cm)—A sample of ~200 grains was weighted, photographed and images were processed using the below described image processing system. The sum of grain lengths and width (longest axis) was measured from those images and was divided by the number of grains.

At the end of the growing period 14 'Heads' were photographed and images were processed using the below described image processing system.

(i) Head Average Area (cm$^2$)—The 'Head' area was measured from those images and was divided by the number of 'Heads'.

(ii) HeadAverage Length (mm)—The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot (SP) or by measuring the parameter across all the plants within the plot (RP).

Total Grain Weight (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Head weight and head number—At the end of the experiment, heads were harvested from each plot and were counted and weighted (kg.).

Biomass at harvest—At the end of the experiment the vegetative material from plots was weighted.

Dry weight—total weight of the vegetative portion above ground (excluding roots) after drying at 70° C. in oven for 48 hours at harvest.

Total dry mater per plot—Calculated as Vegetative portion above ground plus all the heads dry weight per plot.

Number days to anthesis—Calculated as the number of days from sowing till 50% of the plot arrives anthesis.

Total No. of tillers—all tillers were counted per plot at two time points at the Vegetative growth (30 days after sowing) and at harvest.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—one plant per plot (5 repeated plots) were selected for measurement of root weight, root length and for counting the number of lateral roots formed.

Shoot FW (fresh weight)—weight of one plant per plot were recorded at different time-points.

Grain N (H)—% N (nitrogen) content of dry matter in the grain at harvest.

Head N (GF)—% N content of dry matter in the head at grain filling.

Total shoot N—calculated as the % N content multiplied by the weight of plant shoot Total grain N—calculated as the % N content multiplied by the weight of plant grain yield.

NUE [kg/kg]—was calculated based on Formula 51.

NUpE [kg/kg]—was calculated based on Formula 52.

Grain NUtE—was calculated based on Formula 55.

Total NUtE was calculated based on Formula 53.

Stem volume—was calculated based on Formula 50 above.

Stem density—was calculated based on Formula 54.

Maintenance of performance under low N conditions—Represent ratio for the specified parameter of low N condition results divided by Normal conditions results (maintenance of phenotype under low N in comparison to normal conditions).

Data parameters collected are summarized in Tables 200-201 herein below

TABLE 200

Foxtail millet correlated parameters under normal and low N conditions (vectors) - set 1

| Correlated parameter with | Correlation ID |
|---|---|
| Grain area [mm$^2$] | 1 |
| Grain length [mm] | 2 |
| Grain Perimeter [mm] | 3 |
| Grain width [mm] | 4 |
| Grains yield (RP) [gr.] | 5 |
| Grains Yield per plant (RP) [gr.] | 6 |
| Heads FW (RP) [gr.] | 7 |
| Heads FW (SP) [gr.] | 8 |
| Heads num (SP) [number] | 9 |
| Heads weight (RP) [gr.] | 10 |
| Heads weight (SP) [gr.] | 11 |
| 1000 grain weight [gr.] | 12 |
| Heads weight per plant (RP) [gr.] | 13 |
| Leaves num_1 [number] | 14 |
| Leaves num_2 [number] | 15 |
| Leaves num_3 [number] | 16 |
| Leaves num_4 [number] | 17 |
| Leaves temperature_1 [° C.] | 18 |
| Leaves temperature_2 [° C.] | 19 |
| Lower Stem DW (F) [gr.] | 20 |
| Lower Stem FW (F) [gr.] | 21 |
| Lower Stem length (F) [cm] | 22 |
| Lower Stem width (F) [cm] | 23 |
| Num days to Heading (field) [days] | 24 |
| Num days to Maturity [days] | 25 |
| Num lateral roots [number] | 26 |
| Plant height growth [cm/day] | 27 |
| Plant height_1 [cm] | 28 |
| Plant height_2 [cm] | 29 |
| Plant height_3 [cm] | 30 |
| Plant height_4 [cm] | 31 |
| Plant num at harvest [number] | 32 |
| Plant weight growth [gr./day] | 33 |
| Root length [cm] | 34 |
| Shoot DW_1 [gr.] | 35 |
| Shoot DW_2 [gr.] | 36 |
| Shoot DW_3 [gr.] | 37 |
| SPAD (F) [SPAD unit] | 38 |
| SPAD_1 [SPAD unit] | 39 |
| SPAD_2 [SPAD unit] | 40 |
| Tillering_1 [number] | 41 |
| Tillering_2 [number] | 42 |
| Tillering_3 [number] | 43 |
| Upper Stem DW (F) [gr.] | 44 |
| Upper Stem FW (F) [gr.] | 45 |
| Upper Stem length (F) [cm] | 46 |
| Upper Stem width (F) [cm] | 47 |
| Vegetative DW (RP) [gr.] | 48 |
| Vegetative DW (SP) [gr.] | 49 |

TABLE 200-continued

Foxtail millet correlated parameters under normal and low N conditions (vectors) - set 1

| Correlated parameter with | Correlation ID |
|---|---|
| Vegetative DW per plant [gr.] | 50 |
| Vegetative FW (RP) [gr.] | 51 |
| Vegetative FW (SP) [gr.] | 52 |

Table 200. Provided are the foxtail millet collected parameters under normal conditions.
"num" = number;
"gr." = grams;
"F" = flowering stage;
"H" = harvest stage;
"cm" = centimeter;
"N" = nitrogen;
"GF" = grain filling stage;
"FW" = fresh weight;
"DW" = dry weight;
"num" = number;
"NutE" = Nitrogen utilization efficiency;
"NUE" = Nitrogen use efficiency;
"NHI" = nitrogen harvest index;
"NupE" = Nitrogen uptake efficiency;
"SPAD" = chlorophyll levels;
"Avr" = average;
"RGR" = relative growth rate.

TABLE 201

Foxtail millet additional correlated parameters under normal and low N conditions (vectors) - set 2

| Correlated parameter with | Correlation ID |
|---|---|
| NUE [ratio] | 1 |
| Total NUtE [ratio] | 2 |
| Grain NUtE [ratio] | 3 |
| NUpE [ratio] | 4 |
| N harvest index [ratio] | 5 |
| Head N (GF) [%] | 6 |
| Total grain N (H) [mg] | 7 |
| Grain N (H) [%] | 8 |
| Total shoot N (H) [mg] | 9 |
| Shoot N (H) [%] | 10 |
| Grain C_vs_N (H) [ratio] | 11 |
| Head C_vs._N (GF) [ratio] | 12 |
| Shoot C_vs_N (H) [ratio] | 13 |

TABLE 201. Provided are the foxtail millet collected parameters under normal conditions.
"num" = number;
"gr." = grams;
"mg" = milligram;
"F" = flowering stage;
"H" = harvest stage;
"cm" = centimeter;
"N" = nitrogen;
"GF" = grain filling stage;
"FW" = fresh weight;
"DW" = dry weight;
"num" = number;
"NutE" = Nitrogen utilization efficiency;
"NUE" = Nitrogen use efficiency;
"NHI" = nitrogen harvest index;
"NupE" = Nitrogen uptake efficiency;
"SPAD" = chlorophyll levels;
"vs." = versus.

Experimental Results

Fourteen different foxtail millet accessions were grown and characterized for different parameters as described above. The average for each of the measured parameters was calculated using the JMP software and values are summarized in Tables 202-209 below. Subsequent correlation analysis between the various transcriptome sets and the average parameters was conducted (Tables 210-213). Follow, results were integrated to the database.

TABLE 202

Measured parameters of correlation IDs in foxtail millet accessions under normal conditions (set 1 parameters)

| Line/Corr. ID | Line-1 | Line-2 | Line-3 | Line-4 | Line-5 | Line-6 | Line-7 |
|---|---|---|---|---|---|---|---|
| 1 | 0.18 | 0.10 | 0.12 | 0.25 | 0.21 | 0.23 | 0.22 |
| 2 | 3.48 | 2.20 | 2.49 | 2.63 | 2.66 | 2.66 | 2.18 |
| 3 | 0.04 | 0.03 | 0.03 | 0.03 | 0.03 | 0.03 | 0.02 |
| 4 | 0.25 | 0.26 | 0.26 | 0.25 | 0.27 | 0.27 | 0.20 |
| 5 | 0.72 | 0.68 | 0.69 | 0.69 | 0.72 | 0.72 | 0.58 |
| 6 | 0.19 | 0.15 | 0.15 | 0.16 | 0.16 | 0.16 | 0.16 |
| 7 | 1086.00 | 679.20 | 727.60 | 797.60 | 792.40 | 856.80 | 902.80 |
| 8 | 34.70 | 23.00 | 24.80 | 31.10 | 26.60 | 28.30 | 34.90 |
| 9 | 1.80 | 1.12 | 1.07 | 1.34 | 1.32 | 1.11 | 1.36 |
| 10 | 0.25 | 0.17 | 0.18 | 0.27 | 0.21 | 0.23 | 0.28 |
| 11 | 7.20 | 94.00 | 87.60 | 295.40 | 114.00 | 122.40 | 29.80 |
| 12 | 1.31 | 0.87 | 0.89 | 1.07 | 1.02 | 0.98 | 1.10 |
| 13 | 41.80 | 29.30 | 30.30 | 41.60 | 34.40 | 32.50 | 41.80 |
| 14 | 4.07 | 5.33 | 4.13 | 5.07 | 5.00 | 4.27 | 3.67 |
| 15 | NA | NA | NA | NA | NA | NA | NA |
| 16 | 5.30 | 2.90 | 2.94 | 3.55 | 3.90 | 4.12 | 4.40 |
| 17 | 7.90 | 4.70 | 4.50 | 5.30 | 6.55 | 6.35 | 7.15 |
| 18 | NA | NA | NA | 27.70 | 28.00 | 28.30 | 28.20 |
| 19 | 30.18 | NA | NA | NA | NA | NA | NA |
| 20 | 0.71 | NA | 0.30 | 0.16 | 0.15 | 0.20 | 0.61 |
| 21 | 4.21 | NA | 1.43 | 0.69 | 0.64 | 0.64 | 2.50 |
| 22 | 8.35 | NA | 10.25 | 8.75 | 6.69 | 7.64 | 8.07 |
| 23 | 7.24 | NA | 4.16 | 3.12 | 3.33 | 3.18 | 5.57 |
| 24 | 54.00 | 63.40 | 59.40 | 39.60 | 46.00 | 40.80 | 50.00 |
| 25 | NA | NA | NA | NA | 75.00 | 75.00 | NA |
| 26 | NA | NA | NA | NA | NA | NA | NA |
| 27 | 2.10 | 1.42 | 1.32 | 2.10 | 1.93 | 2.44 | 1.84 |
| 28 | 3.72 | 2.92 | 3.25 | 3.55 | 3.45 | 3.68 | 2.92 |
| 29 | NA | NA | NA | NA | NA | NA | NA |
| 30 | 26.60 | 17.70 | 18.00 | 25.80 | 23.40 | 28.60 | 21.50 |
| 31 | 46.00 | 31.80 | 29.80 | 46.10 | 42.90 | 53.60 | 40.70 |
| 32 | 31.40 | 29.60 | 29.80 | 26.00 | 30.00 | 30.20 | 27.80 |
| 33 | 2.85 | 3.12 | 5.11 | 4.35 | 2.87 | 3.11 | 2.93 |
| 34 | NA | NA | NA | NA | NA | NA | NA |
| 35 | 12.70 | 19.50 | 14.40 | 20.70 | 20.60 | 21.00 | 14.00 |
| 36 | 57.10 | 65.70 | 54.30 | 59.80 | 60.80 | 72.00 | 54.00 |
| 37 | 88.90 | 97.90 | 162.70 | 136.00 | 100.40 | 103.30 | 97.30 |
| 38 | 60.80 | NA | NA | 54.70 | 49.90 | 57.50 | 58.60 |
| 39 | NA | NA | NA | 54.70 | 49.90 | 57.50 | 58.60 |
| 40 | 60.82 | NA | NA | NA | NA | NA | NA |
| 41 | NA | NA | NA | NA | NA | NA | NA |
| 42 | 1.10 | 21.10 | 16.80 | 34.30 | 17.10 | 10.80 | 3.30 |
| 43 | 1.40 | 10.30 | 7.60 | 10.70 | 6.40 | 9.20 | 2.22 |
| 44 | 0.81 | NA | 0.24 | 0.24 | 0.14 | 0.21 | 0.32 |
| 45 | 3.24 | NA | 0.48 | 0.67 | 0.43 | 0.50 | 1.28 |
| 46 | 33.70 | NA | 17.70 | 36.20 | 19.60 | 27.90 | 26.20 |
| 47 | 3.68 | NA | 1.78 | 1.51 | 1.59 | 1.50 | 2.55 |
| 48 | 1.06 | 1.56 | 1.17 | 0.67 | 0.67 | 0.71 | 0.87 |
| 49 | 0.13 | 0.23 | 0.21 | 0.11 | 0.11 | 0.13 | 0.16 |
| 50 | 33.30 | 52.80 | 41.10 | 25.80 | 22.50 | 23.50 | 31.90 |
| 51 | 3.19 | 3.85 | 2.78 | 1.98 | 2.15 | 1.57 | 2.19 |
| 52 | 0.45 | 0.57 | 0.53 | 0.39 | 0.27 | 0.37 | NA |

Table 202: Provided are the values of each of the parameters (as described above) measured in Foxtail millet accessions (L = Line). Growth conditions are specified in the experimental procedure section.
"NA" = not available

TABLE 203

Measured parameters of correlation IDs in additional foxtail millet accessions under normal conditions (set 1 parameters)

| Line/Corr. ID | Line-8 | Line-9 | Line-10 | Line-11 | Line-12 | Line-13 | Line-14 |
|---|---|---|---|---|---|---|---|
| 1 | 0.24 | 0.30 | 0.18 | 0.10 | 0.22 | 0.24 | 0.23 |
| 2 | 2.57 | 2.90 | 1.93 | 2.19 | 2.82 | 2.49 | 3.19 |

TABLE 203-continued

Measured parameters of correlation IDs in additional foxtail millet accessions under normal conditions (set 1 parameters)

| Line/Corr. ID | Line-8 | Line-9 | Line-10 | Line-11 | Line-12 | Line-13 | Line-14 |
|---|---|---|---|---|---|---|---|
| 3 | 0.03 | 0.03 | 0.03 | 0.03 | 0.03 | 0.03 | 0.04 |
| 4 | 0.24 | 0.23 | 0.21 | 0.22 | 0.26 | 0.24 | 0.27 |
| 5 | 0.67 | 0.68 | 0.62 | 0.62 | 0.71 | 0.67 | 0.74 |
| 6 | 0.16 | 0.18 | 0.16 | 0.15 | 0.17 | 0.16 | 0.17 |
| 7 | 803.60 | 1120.80 | 584.40 | 268.00 | 818.80 | 800.80 | 818.40 |
| 8 | 26.40 | 48.40 | 22.30 | 9.40 | 31.50 | 30.10 | 30.00 |
| 9 | 1.16 | 1.69 | 1.44 | 0.57 | 1.13 | 1.23 | 1.27 |
| 10 | 0.25 | 0.40 | 0.25 | 0.13 | 0.25 | 0.31 | 0.29 |
| 11 | 129.20 | 11.00 | 13.20 | 53.60 | 32.80 | 60.60 | 323.20 |
| 12 | 0.98 | 1.29 | 1.04 | 0.42 | 1.00 | 0.99 | 1.02 |
| 13 | 32.10 | 60.60 | 39.90 | 14.60 | 38.40 | 37.50 | 37.40 |
| 14 | 3.77 | 3.79 | 3.73 | 4.00 | 3.90 | 4.03 | 5.23 |
| 15 | NA | NA | NA | NA | NA | NA | NA |
| 16 | 4.10 | 3.90 | 4.35 | 3.25 | 3.30 | 3.75 | 3.70 |
| 17 | 7.00 | 6.65 | 5.90 | 4.80 | 5.20 | 5.20 | 9.25 |
| 18 | 28.00 | NA | NA | NA | NA | NA | 27.50 |
| 19 | NA | 30.92 | NA | NA | NA | NA | NA |
| 20 | 0.17 | 0.87 | NA | NA | 0.55 | 0.93 | 0.09 |
| 21 | 0.76 | 3.13 | NA | NA | 3.64 | 5.49 | 0.39 |
| 22 | 7.15 | 9.15 | NA | NA | 10.18 | 12.26 | 8.97 |
| 23 | 3.61 | 6.95 | NA | NA | 6.23 | 6.75 | 2.23 |
| 24 | 39.00 | 54.00 | 71.00 | 61.00 | 63.00 | 61.00 | 42.00 |
| 25 | 75.00 | NA | 98.00 | 109.00 | 98.00 | 98.00 | NA |
| 26 | NA | NA | NA | NA | NA | NA | NA |
| 27 | 2.56 | 1.91 | 0.97 | 1.16 | 1.35 | 1.50 | 2.12 |
| 28 | 3.63 | 4.12 | 2.47 | 3.10 | 3.58 | 3.43 | 3.63 |
| 29 | NA | NA | NA | NA | NA | NA | NA |
| 30 | 30.50 | 26.00 | 16.80 | 17.80 | 19.50 | 20.80 | 24.60 |
| 31 | 55.60 | 42.10 | 20.50 | 25.80 | 30.30 | 33.30 | 47.30 |
| 32 | 30.80 | 23.60 | 26.00 | 29.40 | 26.20 | 27.00 | 27.40 |
| 33 | 3.40 | 4.79 | 3.15 | 3.41 | 3.12 | 2.04 | 4.51 |
| 34 | NA | NA | NA | NA | NA | NA | NA |
| 35 | 18.80 | 14.20 | 11.60 | 19.60 | 18.40 | 10.80 | 17.10 |
| 36 | 71.70 | 87.50 | 52.60 | 52.30 | 77.30 | 63.50 | 66.50 |
| 37 | 118.40 | 142.40 | 98.20 | 116.80 | 103.20 | 72.90 | 143.60 |
| 38 | 55.40 | 55.00 | NA | NA | NA | NA | 55.90 |
| 39 | 55.40 | NA | NA | NA | NA | NA | 55.90 |
| 40 | NA | 55.04 | NA | NA | NA | NA | NA |
| 41 | NA | NA | NA | NA | NA | NA | NA |
| 42 | 11.80 | 2.20 | 3.00 | 9.50 | 6.80 | 4.50 | 39.10 |
| 43 | 4.67 | 2.70 | 3.50 | 6.50 | 5.80 | 6.80 | 16.70 |
| 44 | 0.53 | 0.41 | NA | NA | 0.37 | 0.77 | 0.08 |
| 45 | 0.93 | 1.49 | NA | NA | 0.68 | 0.89 | 0.21 |
| 46 | 38.70 | 24.50 | NA | NA | 21.90 | 16.50 | 21.90 |
| 47 | 1.90 | 3.19 | NA | NA | 1.92 | 2.69 | 0.97 |
| 48 | 0.58 | 0.98 | 1.91 | 2.80 | 1.34 | 1.53 | 0.88 |
| 49 | 0.12 | 0.18 | 0.34 | 0.57 | 0.29 | 0.44 | 0.18 |
| 50 | 18.90 | 42.00 | 73.70 | 101.20 | 51.40 | 57.70 | 35.10 |
| 51 | 1.68 | 2.42 | 5.52 | 5.17 | 3.34 | 3.63 | 2.05 |
| 52 | 0.37 | 0.58 | 0.97 | 1.10 | 0.72 | 1.04 | 0.44 |

Table 203: Provided are the values of each of the parameters (as described above) measured in Foxtail millet accessions (L = Line). Growth conditions are specified in the experimental procedure section.
"NA" = not available

TABLE 204

Additional measured parameters of correlation IDs in foxtail millet accessions under normal conditions (set 2 parameters)

| Line/Corr. ID | Line-1 | Line-2 | Line-3 | Line-4 | Line-5 | Line-6 | Line-7 |
|---|---|---|---|---|---|---|---|
| 1 | 1.83 | 1.21 | 1.31 | 1.64 | 1.40 | 1.49 | 1.84 |
| 2 | 0.10 | 0.12 | NA | 0.09 | 0.08 | 0.08 | 0.08 |
| 3 | 0.56 | 0.29 | NA | 0.68 | 0.60 | 0.67 | 0.67 |
| 4 | 35.50 | 32.90 | NA | 34.70 | 31.40 | 33.90 | 41.80 |
| 5 | 1.83 | 1.21 | 1.31 | 1.64 | 1.40 | 1.49 | 1.84 |
| 6 | 1.72 | 2.21 | NA | 2.30 | 1.97 | 2.07 | 2.45 |
| 7 | 612.80 | 543.70 | NA | 613.70 | 551.80 | 602.00 | 742.80 |
| 8 | 1.77 | 2.36 | NA | 1.98 | 2.07 | 2.13 | 2.13 |
| 9 | 62.40 | 80.50 | NA | 45.90 | 44.80 | 42.00 | 51.80 |
| 10 | 1.87 | 1.52 | NA | 1.78 | 1.99 | 1.79 | 1.63 |
| 11 | 23.80 | 18.00 | NA | 21.30 | 20.40 | 19.70 | 19.50 |
| 12 | 24.80 | 19.60 | NA | 18.30 | 21.70 | 20.30 | 17.00 |
| 13 | 22.20 | 27.60 | NA | 23.00 | 19.80 | 20.00 | 23.60 |

Table 204: Provided are the values of each of the parameters (as described above) measured in Foxtail millet accessions (L = Line). Growth conditions are specified in the experimental procedure section.
"NA" = not available

TABLE 205

Additional measured parameters of correlation IDs in additional foxtail millet accessions under normal conditions (set 2 parameters)

| Line/Corr. ID | Line-8 | Line-9 | Line-10 | Line-11 | Line-12 | Line-13 | Line-14 |
|---|---|---|---|---|---|---|---|
| 1 | 1.39 | 2.54 | 1.18 | 0.49 | 1.66 | 1.58 | 1.58 |
| 2 | NA | 0.10 | 0.12 | NA | 0.13 | NA | 0.10 |
| 3 | NA | 0.76 | 0.25 | NA | 0.50 | NA | 0.33 |
| 4 | NA | 48.90 | 40.60 | 0.00 | 34.00 | NA | 35.90 |
| 5 | 1.39 | 2.54 | 1.18 | 0.49 | 1.66 | 1.58 | 1.58 |
| 6 | NA | 1.93 | 1.81 | NA | 2.17 | NA | 2.26 |
| 7 | NA | 865.00 | 682.10 | NA | 583.60 | NA | 590.90 |
| 8 | NA | 1.79 | 3.05 | NA | 1.85 | NA | 1.97 |
| 9 | NA | 64.00 | 89.20 | NA | 63.00 | NA | 91.30 |
| 10 | NA | 1.53 | 1.21 | NA | 1.23 | NA | 2.60 |
| 11 | NA | 23.20 | 13.60 | NA | 22.70 | NA | 21.50 |
| 12 | NA | 21.70 | 24.10 | NA | 19.80 | NA | 18.40 |
| 13 | NA | 25.00 | 31.70 | NA | 30.80 | NA | 15.60 |

Table 205: Provided are the values of each of the parameters (as described above) measured in Foxtail millet accessions (L = Line). Growth conditions are specified in the experimental procedure section.
"NA" = not available

TABLE 206

Measured parameters of correlation IDs in foxtail millet accessions under low N conditions (set 1 parameters)

| Line/Corr. ID | Line-1 | Line-2 | Line-3 | Line-4 | Line-5 | Line-6 | Line-7 |
|---|---|---|---|---|---|---|---|
| 1 | 0.036 | 0.030 | 0.031 | 0.032 | 0.034 | 0.034 | 0.024 |
| 2 | 0.25 | 0.26 | 0.26 | 0.25 | 0.27 | 0.28 | 0.20 |
| 3 | 0.73 | 0.68 | 0.69 | 0.70 | 0.72 | 0.73 | 0.58 |
| 4 | 0.19 | 0.15 | 0.15 | 0.16 | 0.16 | 0.16 | 0.16 |
| 5 | 936.40 | 622.80 | 923.60 | 819.50 | 726.80 | 683.50 | 622.80 |
| 6 | 29.90 | 20.50 | 34.40 | 29.70 | 22.30 | 23.00 | 22.60 |
| 7 | 1.60 | 1.01 | 1.38 | 1.42 | 1.14 | 0.89 | 0.97 |
| 8 | 0.26 | 0.16 | 0.22 | 0.26 | 0.16 | 0.18 | 0.19 |
| 9 | 8.20 | 57.00 | 64.60 | 214.00 | 69.20 | 117.80 | 31.80 |
| 10 | 1.18 | 0.81 | 1.17 | 1.07 | 0.88 | 0.77 | 0.76 |
| 11 | 0.18 | 0.16 | 0.18 | 0.23 | 0.17 | 0.19 | 0.14 |
| 12 | 3.71 | 2.38 | 2.52 | 2.72 | 2.78 | 2.82 | 2.30 |
| 13 | 37.60 | 26.50 | 37.20 | 38.70 | 27.00 | 25.90 | 27.60 |
| 14 | 4.27 | 2.60 | 2.80 | 2.53 | 2.60 | 2.28 | 3.57 |
| 15 | NA | NA | NA | NA | NA | NA | NA |
| 16 | 5.90 | 3.45 | 3.20 | 3.50 | 3.95 | 4.15 | 4.90 |
| 17 | 6.50 | 3.65 | 3.15 | 3.90 | 3.75 | 5.05 | 6.15 |
| 18 | NA | NA | NA | 26.30 | 27.10 | 27.80 | 27.70 |
| 19 | 30.83 | NA | NA | NA | NA | NA | NA |
| 20 | 0.99 | NA | 0.30 | 0.18 | 0.14 | 0.25 | 0.55 |
| 21 | 3.57 | NA | 1.50 | 0.68 | 0.54 | 0.94 | 1.93 |
| 22 | 6.81 | NA | 10.46 | 8.34 | 6.76 | 7.46 | 6.44 |
| 23 | 6.85 | NA | 3.89 | 2.96 | 3.19 | 3.18 | 5.08 |

TABLE 206-continued

Measured parameters of correlation IDs in foxtail millet accessions under low N conditions (set 1 parameters)

| Line/Corr. ID | Line-1 | Line-2 | Line-3 | Line-4 | Line-5 | Line-6 | Line-7 |
|---|---|---|---|---|---|---|---|
| 24 | 54.00 | 64.00 | 58.60 | 40.40 | 46.00 | 41.60 | 51.60 |
| 25 | 90.00 | 90.00 | 90.00 | NA | 75.00 | NA | NA |
| 26 | NA | NA | NA | NA | NA | NA | NA |
| 27 | 1.64 | 1.00 | 1.01 | 1.81 | 1.50 | 1.88 | 1.38 |
| 28 | 4.21 | 3.76 | 3.72 | 3.87 | 4.27 | 4.19 | 3.43 |
| 29 | NA | NA | NA | NA | NA | NA | NA |
| 30 | 22.50 | 14.00 | 16.20 | 23.90 | 20.90 | 25.10 | 17.80 |
| 31 | 37.10 | 24.10 | 23.50 | 40.30 | 34.30 | 41.90 | 31.40 |
| 32 | 31.40 | 31.00 | 28.60 | 27.50 | 32.40 | 30.00 | 28.20 |
| 33 | 2.21 | 3.42 | 3.31 | 2.21 | 2.83 | 3.79 | 1.75 |
| 34 | NA | NA | NA | NA | NA | NA | NA |
| 35 | 11.00 | 8.20 | 9.40 | 14.40 | 13.50 | 14.90 | 8.00 |
| 36 | 54.70 | 53.90 | 70.20 | 67.80 | 76.00 | 85.70 | 48.30 |
| 37 | 67.30 | 101.50 | 95.20 | 66.70 | 84.30 | 100.30 | 55.00 |
| 38 | 58.60 | 35.90 | 39.10 | 48.30 | 40.70 | 52.30 | 59.10 |
| 39 | 57.90 | 35.90 | 39.10 | 48.30 | 40.70 | 52.30 | 59.10 |
| 40 | 60.61 | NA | NA | NA | NA | NA | NA |
| 41 | NA | NA | NA | NA | NA | NA | NA |
| 42 | 1.05 | 10.95 | 12.35 | 22.60 | 14.00 | 10.60 | 1.60 |
| 43 | 1.30 | 9.10 | 8.25 | 17.00 | 8.10 | 12.25 | 2.20 |
| 44 | 0.75 | NA | 0.31 | 0.18 | 0.18 | 0.25 | 0.51 |
| 45 | 2.65 | NA | 0.59 | 0.54 | 0.49 | 0.55 | 1.57 |
| 46 | 29.10 | NA | 20.10 | 34.90 | 26.90 | 32.60 | 28.30 |
| 47 | 3.29 | NA | 1.71 | 1.33 | 1.53 | 1.54 | 2.58 |
| 48 | 0.97 | 1.11 | 1.14 | 0.59 | 0.51 | 0.58 | 0.56 |
| 49 | 0.13 | 0.16 | 0.18 | 0.11 | 0.08 | 0.12 | 0.11 |
| 50 | 30.70 | 35.90 | 36.90 | 21.70 | 15.50 | 19.30 | 20.20 |
| 51 | 3.03 | 2.55 | 2.86 | 2.22 | 1.97 | 1.21 | 1.37 |
| 52 | 0.39 | 0.36 | 0.44 | 0.38 | 0.19 | 0.32 | NA |

Table 206: Provided are the values of each of the parameters (as described above) measured in Foxtail millet accessions (L = Line). Growth conditions are specified in the experimental procedure section. "NA" = not available.

TABLE 207

Measured parameters of correlation IDs in additional foxtail millet accessions under low N conditions (set 1 parameters)

| Line/Corr. ID | Line-8 | Line-9 | Line-10 | Line-11 | Line-12 | Line-13 | Line-14 |
|---|---|---|---|---|---|---|---|
| 1 | 0.030 | 0.033 | 0.026 | 0.028 | 0.035 | 0.032 | 0.037 |
| 2 | 0.25 | 0.23 | 0.21 | 0.23 | 0.26 | 0.25 | 0.28 |
| 3 | 0.68 | 0.69 | 0.62 | 0.63 | 0.72 | 0.69 | 0.75 |
| 4 | 0.16 | 0.18 | 0.16 | 0.16 | 0.17 | 0.16 | 0.17 |
| 5 | 636.50 | 944.00 | 693.60 | 644.80 | 866.40 | 896.00 | 662.50 |
| 6 | 20.70 | 37.10 | 25.40 | 21.00 | 34.00 | 34.80 | 26.20 |
| 7 | 0.98 | 1.52 | 1.48 | 0.99 | 1.15 | 1.28 | 0.98 |
| 8 | 0.17 | 0.31 | 0.28 | 0.15 | 0.27 | 0.30 | 0.23 |
| 9 | 99.20 | 7.00 | 14.60 | 30.80 | 28.80 | 68.20 | 215.20 |
| 10 | 0.78 | 1.14 | 1.07 | 0.81 | 1.01 | 1.09 | 0.82 |
| 11 | 0.18 | 0.24 | 0.21 | 0.12 | 0.24 | 0.26 | 0.17 |
| 12 | 2.59 | 3.15 | 2.03 | 2.48 | 3.45 | 2.85 | 3.06 |
| 13 | 25.30 | 45.10 | 39.30 | 26.10 | 39.70 | 42.40 | 32.70 |
| 14 | 3.00 | 3.40 | 3.83 | 2.90 | 3.07 | 3.37 | 3.20 |
| 15 | NA | NA | NA | NA | NA | NA | NA |
| 16 | 5.00 | 3.95 | 4.45 | 3.55 | 3.75 | 3.80 | 3.35 |
| 17 | 5.20 | 4.75 | 5.15 | 3.20 | 3.65 | 4.30 | 3.30 |
| 18 | 27.90 | NA | NA | NA | NA | NA | 27.20 |
| 19 | NA | 30.61 | NA | NA | NA | NA | NA |
| 20 | 0.16 | 0.96 | NA | NA | 0.48 | 0.94 | 0.08 |
| 21 | 0.54 | 2.98 | NA | NA | 3.93 | 4.39 | 0.30 |
| 22 | 7.16 | 8.50 | NA | NA | 9.94 | 11.84 | 8.67 |
| 23 | 3.11 | 6.43 | NA | NA | 6.52 | 6.08 | 2.13 |
| 24 | 39.00 | 55.40 | 72.40 | 61.00 | 62.20 | 62.40 | 42.80 |
| 25 | 75.00 | 90.00 | 98.00 | 109.00 | 98.00 | 98.00 | NA |
| 26 | NA | NA | NA | NA | NA | NA | NA |
| 27 | 2.10 | 1.47 | 0.84 | 0.83 | 1.10 | 1.18 | 1.25 |
| 28 | 3.72 | 4.66 | 3.11 | 3.57 | 4.01 | 3.75 | 3.48 |
| 29 | NA | NA | NA | NA | NA | NA | NA |
| 30 | 24.20 | 20.70 | 15.10 | 14.00 | 17.70 | 17.40 | 19.20 |
| 31 | 47.50 | 32.80 | 18.20 | 19.80 | 25.60 | 27.20 | 27.90 |
| 32 | 30.80 | 25.20 | 27.60 | 30.60 | 26.80 | 26.60 | 25.50 |
| 33 | 2.18 | 2.52 | 2.71 | 2.37 | 2.63 | 4.09 | 3.44 |
| 34 | NA | NA | NA | NA | NA | NA | NA |
| 35 | 12.90 | 7.90 | 5.60 | 9.90 | 8.70 | 7.60 | 12.70 |
| 36 | 64.00 | 54.80 | 48.00 | 34.80 | 40.30 | 62.00 | 92.40 |
| 37 | 65.90 | 74.20 | 69.50 | 76.90 | 81.10 | 118.80 | 94.60 |
| 38 | 52.90 | 52.20 | 43.80 | 36.60 | 38.70 | 46.20 | 45.40 |
| 39 | 52.90 | 52.30 | 43.80 | 36.60 | 38.70 | 46.20 | 45.40 |
| 40 | NA | 52.50 | NA | NA | NA | NA | NA |
| 41 | NA | NA | NA | NA | NA | NA | NA |
| 42 | 8.45 | 1.20 | 2.20 | 7.80 | 4.90 | 7.56 | 26.95 |
| 43 | 5.40 | 1.90 | 3.30 | 6.11 | 4.00 | 8.60 | 20.62 |
| 44 | 0.34 | 0.51 | NA | NA | 0.68 | 0.76 | 0.09 |

TABLE 207-continued

Measured parameters of correlation IDs in additional foxtail millet accessions under low N conditions (set 1 parameters)

| Line/Corr. ID | Line-8 | Line-9 | Line-10 | Line-11 | Line-12 | Line-13 | Line-14 |
|---|---|---|---|---|---|---|---|
| 45 | 0.72 | 1.53 | NA | NA | 0.90 | 1.34 | 0.20 |
| 46 | 38.60 | 22.30 | NA | NA | 27.20 | 18.10 | 26.90 |
| 47 | 1.71 | 2.82 | NA | NA | 2.00 | 2.57 | 0.90 |
| 48 | 0.47 | 0.74 | 1.74 | 2.39 | 1.17 | 1.53 | 0.74 |
| 49 | 0.08 | 0.13 | 0.33 | 0.35 | 0.28 | 0.38 | 0.13 |
| 50 | 15.40 | 29.10 | 59.50 | 76.50 | 45.20 | 59.10 | 28.70 |
| 51 | 1.35 | 1.99 | 4.55 | 4.37 | 2.75 | 2.67 | 1.43 |
| 52 | 0.24 | 0.43 | 0.87 | 0.64 | 0.65 | 0.80 | 0.33 |

Table 207: Provided are the values of each of the parameters (as described above) measured in Foxtail millet accessions (L = Line). Growth conditions are specified in the experimental procedure section. "NA" = not available

TABLE 208

Measured parameters of correlation IDs in foxtail millet accessions under low N conditions (set 2 parameters)

| Line/Corr. ID | Line-1 | Line-2 | Line-3 | Line-4 | Line-5 | Line-6 | Line-7 |
|---|---|---|---|---|---|---|---|
| 1 | 29.90 | 20.50 | 34.40 | 29.70 | 22.30 | 23.00 | 22.60 |
| 2 | NA | 0.12 | 0.10 | 0.10 | 0.10 | 0.09 | NA |
| 3 | NA | 0.41 | 0.73 | 0.74 | 0.85 | 0.74 | NA |
| 4 | NA | 464.80 | 688.20 | 516.10 | 380.00 | 484.90 | NA |
| 5 | NA | 0.89 | 0.93 | 0.92 | 0.93 | 0.94 | NA |
| 6 | NA | 1.97 | 1.84 | 1.20 | 1.64 | 1.23 | NA |
| 7 | NA | 415.30 | 641.00 | 475.70 | 353.90 | 453.80 | NA |
| 8 | NA | 2.03 | 1.86 | 1.60 | 1.59 | 1.97 | NA |
| 9 | NA | 49.50 | 47.20 | 40.40 | 26.20 | 31.10 | NA |
| 10 | NA | 1.38 | 1.28 | 1.86 | 1.68 | 1.61 | NA |
| 11 | NA | 20.70 | 22.70 | 25.70 | 26.40 | 21.30 | NA |
| 12 | NA | 59.70 | 23.30 | 36.00 | 25.70 | 33.80 | NA |
| 13 | NA | 28.20 | 29.60 | 20.60 | 22.40 | 20.20 | NA |

Table 208: Provided are the values of each of the parameters (as described above) measured in Foxtailmillet accessions (L = Line). Growth conditions are specified in the experimental procedure section. "NA" = not available

TABLE 209

Measured parameters of correlation IDs in additional foxtail millet accessions under low N conditions (set 2 parameters)

| Line/Corr. ID | Line-8 | Line-9 | Line-10 | Line-11 | Line-12 | Line-13 | Line-14 |
|---|---|---|---|---|---|---|---|
| 1 | 20.70 | 37.10 | 25.40 | 21.00 | 34.00 | 34.80 | 26.20 |
| 2 | 0.07 | 0.12 | 0.16 | NA | 0.12 | NA | 0.10 |
| 3 | 0.78 | 0.87 | 0.36 | NA | 0.72 | NA | 0.47 |
| 4 | 493.50 | 572.80 | 517.90 | 0.00 | 661.90 | NA | 565.20 |
| 5 | 0.95 | 0.93 | 0.86 | NA | 0.93 | NA | 0.90 |
| 6 | 1.91 | 1.92 | 1.71 | NA | 2.10 | NA | 2.13 |
| 7 | 466.80 | 529.90 | 446.50 | NA | 614.60 | NA | 508.80 |
| 8 | 2.26 | 1.43 | 1.76 | NA | 1.81 | NA | 1.94 |
| 9 | 26.70 | 42.80 | 71.50 | NA | 47.30 | NA | 56.40 |
| 10 | 1.73 | 1.47 | 1.20 | NA | 1.05 | NA | 1.96 |
| 11 | 18.80 | 28.90 | 23.90 | NA | 23.20 | NA | 21.70 |
| 12 | 22.60 | 22.10 | 25.40 | NA | 20.60 | NA | 19.80 |
| 13 | 22.10 | 25.00 | 31.80 | NA | 35.80 | NA | 20.10 |

Table 209: Provided are the values of each of the parameters (as described above) measured in Foxtail millet accessions (L = Line). Growth conditions are specified in the experimental procedure section. "NA" = not available

TABLE 210

Correlation between the expression level of selected genes of some embodiments of the invention in various tissues and the phenotypic performance under normal conditions across Foxtail millet varieties (set 1)

| Gene Name | R | P value | Exp. set | Corr. ID | Gene Name | R | P value | Exp. set | Corr. ID |
|---|---|---|---|---|---|---|---|---|---|
| LBY243 | 0.75 | 3.26E−02 | 12 | 22 | LBY266 | 0.71 | 2.03E−02 | 3 | 2 |
| LBY243 | 0.97 | 1.52E−05 | 4 | 43 | LBY243 | 0.72 | 2.84E−02 | 4 | 14 |
| LBY243 | 0.84 | 4.78E−03 | 3 | 52 | LBY243 | 0.86 | 2.90E−03 | 2 | 14 |
| LBY243 | 0.93 | 2.40E−03 | 9 | 20 | LBY243 | 0.79 | 3.32E−02 | 9 | 21 |
| LBY243 | 0.80 | 5.81E−03 | 1 | 24 | LBY243 | 0.80 | 9.53E−03 | 1 | 22 |
| LBY243 | 0.88 | 9.60E−03 | 9 | 44 | LBY243 | 0.89 | 7.62E−03 | 9 | 23 |
| LBY243 | 0.72 | 3.00E−02 | 5 | 24 | LBY243 | 0.75 | 1.18E−02 | 11 | 24 |
| LBY243 | 0.81 | 5.33E−02 | 8 | 17 | LBY243 | 0.73 | 9.61E−02 | 8 | 32 |
| LBY243 | 0.82 | 6.73E−03 | 4 | 9 | LBY243 | 0.87 | 2.15E−03 | 4 | 42 |
| LBY243 | 0.93 | 2.82E−03 | 9 | 47 | LBY243 | 0.88 | 8.59E−03 | 9 | 45 |
| LBY243 | 0.88 | 4.31E−03 | 11 | 22 | LBY243 | 0.75 | 1.22E−02 | 1 | 48 |
| LBY243 | 0.79 | 1.12E−02 | 3 | 22 | LBY243 | 0.73 | 1.74E−02 | 3 | 49 |
| LBY243 | 0.75 | 1.24E−02 | 3 | 48 | LBY243 | 0.77 | 9.70E−03 | 3 | 50 |
| LBY266 | 0.84 | 1.75E−02 | 2 | 45 | LBY266 | 0.83 | 5.51E−03 | 2 | 5 |
| LBY266 | 0.75 | 2.12E−02 | 9 | 43 | LBY267 | 0.82 | 4.59E−02 | 8 | 16 |
| LBY266 | 0.71 | 3.04E−02 | 5 | 17 | LBY266 | 0.77 | 9.03E−03 | 1 | 27 |
| LBY266 | 0.73 | 6.33E−02 | 2 | 47 | LBY266 | 0.83 | 5.11E−03 | 2 | 28 |
| LBY266 | 0.77 | 9.76E−03 | 1 | 31 | LBY266 | 0.76 | 1.06E−02 | 1 | 30 |
| LBY266 | 0.72 | 2.83E−02 | 2 | 4 | LBY266 | 0.80 | 9.54E−03 | 5 | 43 |
| LBY266 | 0.85 | 3.98E−03 | 2 | 12 | LBY266 | 0.95 | 1.07E−03 | 2 | 44 |
| LBY267 | 0.83 | 2.18E−02 | 4 | 22 | LBY267 | 0.72 | 2.01E−02 | 3 | 8 |

TABLE 210-continued

Correlation between the expression level of selected genes of some embodiments of the invention in various tissues and the phenotypic performance under normal conditions across Foxtail millet varieties (set 1)

| Gene Name | R | P value | Exp. set | Corr. ID | Gene Name | R | P value | Exp. set | Corr. ID |
|---|---|---|---|---|---|---|---|---|---|
| LBY267 | 0.74 | 2.33E−02 | 5 | 12 | LBY267 | 0.73 | 2.69E−02 | 5 | 17 |
| LBY267 | 0.79 | 6.21E−02 | 8 | 11 | LBY267 | 0.94 | 5.57E−03 | 8 | 17 |
| LBY267 | 0.80 | 3.11E−02 | 9 | 46 | LBY290 | 0.70 | 1.20E−01 | 8 | 17 |
| LBY267 | 0.70 | 1.19E−01 | 8 | 30 | LBY267 | 0.83 | 4.14E−02 | 4 | 38 |
| LBY267 | 0.79 | 6.70E−03 | 3 | 36 | LBY267 | 0.71 | 3.12E−02 | 5 | 43 |
| LBY267 | 0.76 | 1.70E−02 | 5 | 1 | LBY267 | 0.74 | 2.32E−02 | 1 | 46 |
| LBY290 | 0.82 | 2.51E−02 | 5 | 20 | LBY290 | 0.78 | 1.25E−02 | 5 | 5 |
| LBY290 | 0.87 | 1.10E−03 | 3 | 30 | LBY290 | 0.82 | 4.02E−03 | 3 | 5 |
| LBY290 | 0.84 | 1.69E−02 | 5 | 47 | LBY290 | 0.76 | 1.71E−02 | 5 | 6 |
| LBY290 | 0.76 | 1.13E−02 | 3 | 7 | LBY290 | 0.79 | 6.29E−03 | 3 | 10 |
| LBY290 | 0.74 | 1.52E−02 | 12 | 28 | LBY290 | 0.79 | 6.53E−03 | 12 | 17 |
| LBY290 | 0.82 | 7.01E−03 | 2 | 32 | LBY290 | 0.81 | 2.82E−02 | 5 | 23 |
| LBY290 | 0.84 | 4.54E−03 | 9 | 16 | LBY290 | 0.93 | 1.23E−04 | 12 | 27 |
| LBY290 | 0.79 | 1.10E−02 | 4 | 43 | LBY290 | 0.81 | 4.09E−03 | 3 | 27 |
| LBY290 | 0.73 | 4.17E−02 | 12 | 46 | LBY290 | 0.90 | 3.36E−04 | 12 | 30 |
| LBY290 | 0.81 | 4.11E−03 | 12 | 9 | LBY290 | 0.93 | 1.19E−04 | 12 | 31 |
| LBY290 | 0.89 | 6.32E−04 | 3 | 16 | LBY290 | 0.81 | 4.33E−03 | 3 | 31 |
| LBY290 | 0.70 | 3.51E−02 | 5 | 7 | LBY290 | 0.72 | 6.55E−02 | 5 | 45 |
| LBY290 | 0.72 | 1.93E−02 | 3 | 17 | LBY290 | 0.80 | 9.50E−03 | 3 | 46 |
| LBY291 | 0.82 | 6.60E−03 | 5 | 30 | LBY291 | 0.73 | 2.49E−02 | 5 | 1 |
| LBY291 | 0.90 | 1.01E−03 | 5 | 31 | LBY291 | 0.74 | 2.36E−02 | 5 | 3 |
| LBY291 | 0.72 | 1.06E−01 | 8 | 33 | LBY291 | 0.74 | 9.40E−02 | 8 | 7 |
| LBY291 | 0.90 | 1.02E−03 | 5 | 27 | LBY291 | 0.77 | 1.50E−02 | 5 | 9 |
| LBY291 | 0.85 | 3.83E−03 | 11 | 52 | LBY291 | 0.73 | 1.72E−02 | 12 | 13 |
| LBY291 | 0.93 | 8.71E−05 | 3 | 16 | LBY291 | 0.89 | 7.61E−03 | 3 | 38 |
| LBY291 | 0.76 | 1.69E−02 | 3 | 45 | LBY291 | 0.72 | 2.89E−02 | 5 | 43 |
| LBY291 | 0.82 | 1.36E−02 | 12 | 20 | LBY291 | 0.71 | 3.24E−02 | 12 | 52 |
| LBY292 | 0.77 | 1.50E−02 | 4 | 37 | LBY292 | 0.77 | 8.86E−03 | 3 | 12 |
| LBY292 | 0.79 | 6.49E−03 | 3 | 5 | LBY292 | 0.77 | 9.38E−03 | 3 | 4 |
| LBY292 | 0.80 | 1.82E−02 | 11 | 21 | LBY292 | 0.76 | 1.08E−02 | 11 | 4 |
| LBY292 | 0.72 | 4.29E−02 | 11 | 47 | LBY292 | 0.77 | 9.57E−03 | 11 | 7 |
| LBY292 | 0.73 | 1.62E−02 | 12 | 7 | LBY292 | 0.71 | 2.06E−02 | 12 | 10 |
| LBY292 | 0.76 | 1.69E−02 | 4 | 33 | LBY292 | 0.71 | 3.34E−02 | 4 | 11 |
| LBY292 | 0.77 | 9.85E−03 | 1 | 36 | LBY292 | 0.76 | 1.66E−02 | 9 | 16 |
| LBY292 | 0.73 | 2.60E−02 | 2 | 12 | LBY292 | 0.71 | 3.11E−02 | 2 | 28 |
| LBY292 | 0.77 | 9.50E−03 | 3 | 7 | LBY292 | 0.77 | 9.66E−03 | 3 | 28 |
| LBY292 | 0.73 | 4.07E−02 | 12 | 45 | LBY293 | 0.70 | 1.20E−01 | 8 | 33 |
| LBY292 | 0.87 | 2.58E−02 | 8 | 32 | LBY292 | 0.72 | 1.06E−01 | 8 | 36 |
| LBY292 | 0.75 | 1.92E−02 | 2 | 4 | LBY292 | 0.78 | 2.24E−02 | 11 | 44 |
| LBY292 | 0.76 | 1.04E−02 | 3 | 10 | LBY292 | 0.72 | 3.04E−02 | 3 | 45 |
| LBY292 | 0.71 | 2.19E−02 | 11 | 10 | LBY292 | 0.90 | 2.21E−03 | 11 | 45 |
| LBY293 | 0.81 | 4.39E−03 | 3 | 27 | LBY293 | 0.89 | 4.73E−04 | 3 | 16 |
| LBY293 | 0.81 | 7.56E−03 | 2 | 24 | LBY293 | 0.96 | 4.51E−04 | 2 | 22 |
| LBY293 | 0.80 | 5.41E−03 | 1 | 24 | LBY293 | 0.88 | 1.61E−03 | 1 | 22 |
| LBY293 | 0.81 | 4.50E−03 | 3 | 31 | LBY293 | 0.76 | 1.03E−02 | 3 | 30 |
| LBY293 | 0.76 | 1.78E−02 | 2 | 48 | LBY293 | 0.82 | 7.27E−03 | 2 | 50 |
| LBY293 | 0.72 | 1.90E−02 | 1 | 48 | LBY293 | 0.79 | 6.42E−03 | 1 | 50 |
| LBY293 | 0.72 | 2.95E−02 | 5 | 35 | LBY293 | 0.90 | 7.94E−04 | 11 | 52 |
| LBY293 | 0.89 | 1.25E−03 | 2 | 49 | LBY293 | 0.85 | 7.29E−03 | 2 | 52 |
| LBY293 | 0.84 | 2.61E−03 | 1 | 49 | LBY293 | 0.78 | 1.31E−02 | 1 | 52 |
| LBY294 | 0.81 | 4.14E−03 | 3 | 27 | LBY294 | 0.72 | 1.84E−02 | 3 | 16 |
| LBY294 | 0.70 | 1.19E−01 | 8 | 36 | LBY294 | 0.81 | 8.65E−03 | 4 | 17 |
| LBY294 | 0.75 | 2.12E−02 | 9 | 50 | LBY294 | 0.72 | 3.01E−02 | 9 | 24 |
| LBY294 | 0.81 | 4.39E−03 | 3 | 31 | LBY294 | 0.80 | 5.57E−03 | 3 | 30 |
| LBY294 | 0.72 | 3.03E−02 | 9 | 52 | LBY295 | 0.77 | 7.50E−02 | 8 | 32 |
| LBY294 | 0.77 | 1.48E−02 | 9 | 48 | LBY294 | 0.79 | 1.19E−02 | 9 | 51 |
| LBY295 | 0.87 | 2.56E−03 | 12 | 52 | LBY296 | 0.76 | 8.21E−02 | 8 | 2 |
| LBY295 | 0.74 | 2.18E−02 | 4 | 8 | LBY295 | 0.83 | 2.19E−02 | 4 | 22 |
| LBY295 | 0.70 | 3.40E−02 | 4 | 52 | LBY295 | 0.77 | 9.31E−03 | 3 | 27 |
| LBY295 | 0.78 | 7.91E−03 | 3 | 16 | LBY295 | 0.76 | 1.03E−02 | 3 | 31 |
| LBY295 | 0.79 | 6.54E−03 | 12 | 50 | LBY295 | 0.79 | 6.25E−03 | 12 | 49 |
| LBY295 | 0.73 | 1.64E−02 | 12 | 48 | LBY295 | 0.73 | 1.62E−02 | 12 | 51 |
| LBY295 | 0.75 | 1.27E−02 | 11 | 49 | LBY295 | 0.89 | 1.51E−03 | 11 | 52 |
| LBY296 | 0.71 | 2.21E−02 | 12 | 36 | LBY296 | 0.81 | 4.75E−03 | 12 | 5 |
| LBY296 | 0.78 | 1.28E−02 | 9 | 30 | LBY296 | 0.76 | 1.11E−02 | 12 | 8 |
| LBY296 | 0.90 | 4.39E−04 | 12 | 6 | LBY296 | 0.82 | 4.00E−03 | 12 | 13 |
| LBY296 | 0.76 | 1.72E−02 | 3 | 47 | LBY296 | 0.73 | 1.61E−02 | 3 | 16 |
| LBY296 | 0.70 | 2.42E−02 | 12 | 10 | LBY296 | 0.79 | 1.84E−02 | 12 | 20 |
| LBY296 | 0.83 | 3.29E−03 | 11 | 50 | LBY296 | 0.81 | 4.50E−03 | 11 | 24 |
| LBY296 | 0.71 | 3.26E−02 | 2 | 43 | LBY296 | 0.70 | 3.56E−02 | 2 | 27 |
| LBY296 | 0.70 | 3.45E−02 | 1 | 44 | LBY296 | 0.80 | 9.08E−03 | 9 | 27 |
| LBY296 | 0.77 | 7.22E−02 | 8 | 3 | LBY296 | 0.97 | 9.53E−04 | 8 | 32 |
| LBY296 | 0.80 | 9.14E−03 | 9 | 31 | LBY296 | 0.71 | 3.15E−02 | 9 | 35 |

TABLE 210-continued

Correlation between the expression level of selected genes of some embodiments of the invention in various tissues and the phenotypic performance under normal conditions across Foxtail millet varieties (set 1)

| Gene Name | R | P value | Exp. set | Corr. ID | Gene Name | R | P value | Exp. set | Corr. ID |
|---|---|---|---|---|---|---|---|---|---|
| LBY296 | 0.71 | 3.18E−02 | 2 | 31 | LBY296 | 0.87 | 2.30E−03 | 2 | 42 |
| LBY296 | 0.75 | 8.47E−02 | 8 | 1 | LBY296 | 0.94 | 1.30E−04 | 3 | 44 |
| LBY296 | 0.71 | 7.61E−02 | 3 | 38 | LBY296 | 0.84 | 5.05E−03 | 3 | 45 |
| LBY296 | 0.72 | 2.82E−02 | 3 | 22 | LBY296 | 0.80 | 1.02E−02 | 3 | 46 |
| LBY296 | 0.81 | 4.60E−03 | 11 | 48 | LBY296 | 0.84 | 2.60E−03 | 11 | 51 |
| LBY296 | 0.87 | 1.12E−03 | 11 | 49 | LBY296 | 0.92 | 4.14E−04 | 11 | 52 |
| LBY297 | 0.70 | 1.20E−01 | 8 | 3 | LBY297 | 0.71 | 3.07E−02 | 2 | 50 |
| LBY297 | 0.87 | 2.38E−03 | 2 | 49 | LBY297 | 0.85 | 7.18E−03 | 2 | 52 |
| LBY298 | 0.76 | 8.26E−02 | 8 | 8 | LBY298 | 0.83 | 3.87E−02 | 8 | 16 |
| LBY298 | 0.76 | 7.71E−02 | 8 | 11 | LBY298 | 0.86 | 2.86E−02 | 8 | 17 |
| LBY298 | 0.84 | 4.99E−03 | 12 | 52 | LBY299 | 0.82 | 4.64E−02 | 8 | 17 |
| LBY298 | 0.76 | 1.11E−02 | 3 | 12 | LBY298 | 0.72 | 2.86E−02 | 3 | 45 |
| LBY298 | 0.73 | 1.61E−02 | 1 | 24 | LBY298 | 0.72 | 1.96E−02 | 1 | 49 |
| LBY298 | 0.80 | 5.78E−03 | 12 | 50 | LBY298 | 0.74 | 1.43E−02 | 12 | 49 |
| LBY298 | 0.72 | 1.93E−02 | 3 | 4 | LBY298 | 0.72 | 2.81E−02 | 2 | 50 |
| LBY298 | 0.72 | 2.00E−02 | 12 | 48 | LBY298 | 0.74 | 1.34E−02 | 12 | 51 |
| LBY298 | 0.85 | 4.04E−03 | 2 | 49 | LBY298 | 0.78 | 2.26E−02 | 2 | 52 |
| LBY299 | 0.76 | 4.53E−02 | 5 | 21 | LBY299 | 0.79 | 6.96E−02 | 11 | 9 |
| LBY299 | 0.70 | 7.97E−02 | 5 | 45 | LBY299 | 0.75 | 5.04E−02 | 5 | 20 |
| LBY299 | 0.85 | 3.75E−03 | 9 | 52 | LBY299 | 0.70 | 7.81E−02 | 9 | 21 |
| LBY299 | 0.78 | 7.44E−03 | 1 | 24 | LBY299 | 0.78 | 1.32E−02 | 1 | 22 |
| LBY299 | 0.79 | 1.19E−02 | 5 | 50 | LBY299 | 0.89 | 1.14E−03 | 5 | 24 |
| LBY299 | 0.73 | 2.66E−02 | 4 | 52 | LBY299 | 0.84 | 2.38E−03 | 3 | 27 |
| LBY299 | 0.74 | 1.49E−02 | 3 | 11 | LBY299 | 0.72 | 1.92E−02 | 3 | 28 |
| LBY299 | 0.83 | 3.11E−03 | 3 | 17 | LBY299 | 0.86 | 1.33E−03 | 3 | 30 |
| LBY299 | 0.83 | 2.78E−03 | 3 | 16 | LBY299 | 0.84 | 2.27E−03 | 3 | 31 |
| LBY299 | 0.77 | 8.53E−03 | 1 | 49 | LBY299 | 0.83 | 2.08E−02 | 9 | 44 |
| LBY299 | 0.75 | 5.42E−02 | 5 | 23 | LBY299 | 0.84 | 1.77E−02 | 5 | 47 |
| LBY299 | 0.72 | 6.58E−02 | 9 | 23 | LBY299 | 0.79 | 1.20E−02 | 9 | 48 |
| LBY299 | 0.85 | 3.28E−02 | 8 | 32 | LBY299 | 0.73 | 2.52E−02 | 4 | 48 |
| LBY299 | 0.72 | 7.07E−02 | 4 | 22 | LBY299 | 0.72 | 3.03E−02 | 4 | 49 |
| LBY299 | 0.81 | 7.72E−03 | 9 | 24 | LBY299 | 0.79 | 1.14E−02 | 9 | 49 |
| LBY299 | 0.80 | 5.39E−02 | 4 | 38 | LBY299 | 0.74 | 2.35E−02 | 4 | 50 |
| LBY299 | 0.75 | 1.29E−02 | 1 | 48 | LBY299 | 0.71 | 2.18E−02 | 1 | 50 |
| LBY299 | 0.83 | 5.87E−03 | 9 | 51 | LBY299 | 0.79 | 1.14E−02 | 9 | 50 |
| LBY299 | 0.80 | 1.00E−02 | 5 | 48 | LBY299 | 0.84 | 4.29E−03 | 5 | 51 |
| LBY299 | 0.71 | 2.19E−02 | 11 | 17 | LBY299 | 0.70 | 3.43E−02 | 11 | 52 |
| LBY299 | 0.81 | 8.42E−03 | 5 | 49 | LBY299 | 0.77 | 1.43E−02 | 5 | 52 |
| LBY299 | 0.71 | 2.17E−02 | 12 | 50 | LBY299 | 0.80 | 9.34E−03 | 12 | 52 |
| LBY300 | 0.76 | 1.66E−02 | 9 | 52 | LBY300 | 0.78 | 1.40E−02 | 9 | 48 |
| LBY300 | 0.71 | 3.31E−02 | 5 | 24 | LBY300 | 0.72 | 2.74E−02 | 9 | 49 |
| LBY300 | 0.76 | 1.83E−02 | 9 | 50 | LBY300 | 0.72 | 1.03E−01 | 8 | 52 |
| LBY300 | 0.81 | 4.87E−02 | 8 | 7 | LBY317 | 0.70 | 2.41E−02 | 3 | 16 |
| LBY317 | 0.79 | 6.01E−02 | 8 | 32 | LBY317 | 0.75 | 1.93E−02 | 2 | 16 |
| LBY317 | 0.75 | 5.44E−02 | 2 | 44 | LBY317 | 0.73 | 2.53E−02 | 2 | 17 |
| LBY317 | 0.90 | 6.47E−03 | 2 | 45 | LBY317 | 0.91 | 2.54E−04 | 1 | 24 |
| LBY317 | 0.87 | 1.07E−03 | 1 | 50 | LBY317 | 0.80 | 5.46E−03 | 8 | 32 |
| LBY317 | 0.88 | 1.76E−03 | 1 | 52 | LBY317 | 0.90 | 5.92E−03 | 1 | 38 |
| LBY317 | 0.79 | 6.28E−03 | 1 | 51 | LBY317 | 0.90 | 3.96E−04 | 1 | 48 |
| LBY317 | 0.91 | 1.77E−03 | 11 | 22 | LBY317 | 0.90 | 4.29E−04 | 1 | 49 |
| LBY317 | 0.90 | 9.27E−04 | 1 | 22 | LBY318 | 0.78 | 3.86E−02 | 2 | 22 |
| LBY318 | 0.84 | 5.01E−03 | 2 | 24 | LBY318 | 0.83 | 2.71E−03 | 11 | 24 |
| LBY318 | 0.74 | 1.49E−02 | 11 | 50 | LBY318 | 0.89 | 5.02E−04 | 1 | 24 |
| LBY318 | 0.84 | 2.53E−03 | 1 | 50 | LBY319 | 0.75 | 1.17E−02 | 3 | 28 |
| LBY318 | 0.82 | 6.81E−03 | 1 | 52 | LBY318 | 0.85 | 3.72E−03 | 2 | 48 |
| LBY318 | 0.71 | 2.07E−02 | 3 | 2 | LBY318 | 0.77 | 9.62E−03 | 1 | 49 |
| LBY318 | 0.85 | 3.91E−03 | 1 | 22 | LBY318 | 0.92 | 4.74E−04 | 2 | 50 |
| LBY318 | 0.83 | 5.55E−03 | 2 | 51 | LBY318 | 0.71 | 2.02E−02 | 11 | 51 |
| LBY318 | 0.78 | 8.43E−03 | 11 | 48 | LBY318 | 0.75 | 1.17E−02 | 1 | 51 |
| LBY318 | 0.83 | 2.95E−03 | 1 | 48 | LBY318 | 0.70 | 3.46E−02 | 11 | 52 |
| LBY318 | 0.82 | 1.31E−02 | 11 | 22 | LBY318 | 0.94 | 5.15E−04 | 2 | 52 |
| LBY318 | 0.85 | 3.34E−03 | 2 | 49 | LBY320 | 0.84 | 3.76E−02 | 8 | 16 |
| LBY319 | 0.76 | 1.75E−02 | 12 | 52 | LBY319 | 0.75 | 1.27E−02 | 12 | 49 |
| LBY319 | 0.89 | 1.33E−03 | 11 | 52 | LBY320 | 0.78 | 6.79E−02 | 8 | 10 |
| LBY320 | 0.87 | 2.36E−02 | 8 | 7 | LBY321 | 0.76 | 7.97E−02 | 8 | 16 |
| LBY320 | 0.78 | 1.33E−02 | 9 | 52 | LBY320 | 0.75 | 5.19E−02 | 9 | 22 |
| LBY320 | 0.72 | 2.75E−02 | 9 | 24 | LBY320 | 0.79 | 3.55E−02 | 4 | 45 |
| LBY320 | 0.73 | 2.47E−02 | 4 | 24 | LBY320 | 0.77 | 1.48E−02 | 9 | 48 |
| LBY320 | 0.72 | 1.84E−02 | 3 | 16 | LBY320 | 0.79 | 1.14E−02 | 4 | 48 |
| LBY320 | 0.72 | 6.59E−02 | 4 | 44 | LBY320 | 0.74 | 2.15E−02 | 4 | 50 |
| LBY320 | 0.84 | 4.45E−03 | 4 | 51 | LBY320 | 0.78 | 1.30E−02 | 9 | 50 |
| LBY320 | 0.72 | 3.00E−02 | 9 | 51 | LBY321 | 0.78 | 7.53E−03 | 12 | 16 |
| LBY321 | 0.73 | 3.84E−02 | 12 | 44 | LBY321 | 0.72 | 2.83E−02 | 5 | 17 |

TABLE 210-continued

Correlation between the expression level of selected genes of some embodiments of the invention in various tissues and the phenotypic performance under normal conditions across Foxtail millet varieties (set 1)

| Gene Name | R | P value | Exp. set | Corr. ID | Gene Name | R | P value | Exp. set | Corr. ID |
|---|---|---|---|---|---|---|---|---|---|
| LBY321 | 0.90 | 8.55E−04 | 5 | 9 | LBY321 | 0.73 | 1.55E−02 | 11 | 28 |
| LBY321 | 0.82 | 6.25E−03 | 5 | 42 | LBY322 | 0.92 | 1.00E−02 | 8 | 33 |
| LBY321 | 0.80 | 1.83E−02 | 12 | 46 | LBY321 | 0.72 | 1.83E−02 | 3 | 36 |
| LBY321 | 0.72 | 1.84E−02 | 3 | 11 | LBY321 | 0.72 | 1.96E−02 | 1 | 37 |
| LBY321 | 0.73 | 1.72E−02 | 1 | 33 | LBY321 | 0.86 | 3.11E−03 | 5 | 43 |
| LBY321 | 0.91 | 1.84E−03 | 2 | 52 | LBY321 | 0.73 | 4.01E−02 | 12 | 45 |
| LBY321 | 0.80 | 3.14E−02 | 12 | 38 | LBY321 | 0.81 | 8.10E−03 | 2 | 49 |
| LBY321 | 0.78 | 1.36E−02 | 2 | 50 | LBY321 | 0.81 | 8.11E−03 | 2 | 51 |
| LBY321 | 0.73 | 2.54E−02 | 2 | 48 | LBY322 | 0.77 | 8.68E−03 | 3 | 5 |
| LBY322 | 0.87 | 2.42E−03 | 3 | 45 | LBY322 | 0.80 | 5.78E−03 | 8 | 7 |
| LBY322 | 0.81 | 5.06E−02 | 8 | 37 | LBY322 | 0.81 | 4.35E−03 | 3 | 10 |
| LBY322 | 0.80 | 5.80E−03 | 3 | 7 | LBY322 | 0.74 | 9.00E−02 | 8 | 13 |
| LBY322 | 0.73 | 9.83E−02 | 8 | 9 | LBY322 | 0.90 | 3.18E−04 | 3 | 16 |
| LBY322 | 0.77 | 9.32E−03 | 3 | 12 | LBY322 | 0.77 | 1.63E−02 | 4 | 16 |
| LBY322 | 0.71 | 1.11E−01 | 8 | 42 | LBY322 | 0.78 | 2.13E−02 | 11 | 20 |
| LBY322 | 0.76 | 2.82E−02 | 11 | 45 | LBY322 | 0.82 | 6.51E−03 | 5 | 24 |
| LBY322 | 0.76 | 1.65E−02 | 5 | 51 | LBY322 | 0.81 | 1.37E−02 | 11 | 47 |
| LBY322 | 0.84 | 9.77E−03 | 11 | 23 | LBY322 | 0.77 | 1.52E−02 | 5 | 48 |
| LBY322 | 0.80 | 5.08E−03 | 3 | 4 | LBY368 | 0.79 | 1.18E−02 | 4 | 48 |
| LBY322 | 0.87 | 5.02E−03 | 11 | 21 | LBY368 | 0.82 | 3.73E−03 | 1 | 6 |
| LBY368 | 0.92 | 1.90E−04 | 1 | 8 | LBY368 | 0.72 | 1.90E−02 | 3 | 17 |
| LBY368 | 0.83 | 2.97E−03 | 3 | 31 | LBY368 | 0.81 | 7.55E−03 | 1 | 22 |
| LBY368 | 0.89 | 6.34E−04 | 1 | 13 | LBY368 | 0.82 | 3.32E−03 | 3 | 27 |
| LBY368 | 0.74 | 2.16E−02 | 4 | 50 | LBY368 | 0.91 | 3.93E−03 | 5 | 46 |
| LBY368 | 0.74 | 5.65E−02 | 2 | 46 | LBY368 | 0.91 | 7.55E−04 | 11 | 52 |
| LBY368 | 0.72 | 1.92E−02 | 11 | 49 | LBY369 | 0.86 | 1.36E−02 | 9 | 22 |
| LBY369 | 0.79 | 7.11E−03 | 12 | 43 | LBY369 | 0.84 | 4.62E−03 | 2 | 27 |
| LBY369 | 0.76 | 1.71E−02 | 9 | 50 | LBY369 | 0.75 | 1.89E−02 | 2 | 30 |
| LBY369 | 0.80 | 5.28E−03 | 3 | 9 | LBY369 | 0.74 | 1.36E−02 | 1 | 35 |
| LBY369 | 0.83 | 5.11E−03 | 2 | 31 | LBY369 | 0.74 | 1.40E−02 | 1 | 43 |
| LBY369 | 0.72 | 1.91E−02 | 1 | 9 | LBY369 | 0.74 | 5.66E−02 | 4 | 46 |
| LBY369 | 0.72 | 2.97E−02 | 5 | 16 | LBY369 | 0.76 | 1.77E−02 | 9 | 48 |
| LBY369 | 0.83 | 3.98E−02 | 8 | 7 | LBY369 | 0.77 | 1.47E−02 | 9 | 52 |
| LBY369 | 0.73 | 1.62E−02 | 1 | 30 | LBY371 | 0.80 | 5.71E−02 | 8 | 1 |
| LBY369 | 0.71 | 3.24E−02 | 9 | 49 | LBY371 | 0.71 | 2.19E−02 | 12 | 1 |
| LBY371 | 0.82 | 4.56E−02 | 8 | 3 | LBY371 | 0.79 | 6.25E−02 | 8 | 2 |
| LBY371 | 0.71 | 2.25E−02 | 12 | 32 | LBY371 | 0.71 | 2.05E−02 | 12 | 3 |
| LBY371 | 0.79 | 5.94E−02 | 8 | 43 | LBY371 | 0.70 | 3.50E−02 | 5 | 9 |
| LBY371 | 0.70 | 2.31E−02 | 12 | 12 | LBY371 | 0.71 | 2.19E−02 | 3 | 16 |
| LBY371 | 0.74 | 2.15E−02 | 5 | 43 | LBY371 | 0.75 | 5.43E−02 | 4 | 22 |
| LBY371 | 0.87 | 1.08E−02 | 4 | 21 | LBY371 | 0.76 | 4.84E−02 | 4 | 23 |
| LBY371 | 0.90 | 1.42E−02 | 4 | 38 | LBY371 | 0.79 | 1.06E−02 | 9 | 43 |
| LBY371 | 0.80 | 3.07E−02 | 4 | 44 | LBY414 | 0.80 | 8.90E−03 | 5 | 9 |
| LBY371 | 0.72 | 2.91E−02 | 1 | 45 | LBY414 | 0.70 | 5.18E−02 | 11 | 22 |
| LBY414 | 0.77 | 1.42E−02 | 5 | 43 | LBY414 | 0.76 | 1.69E−02 | 9 | 42 |
| LBY414 | 0.73 | 2.60E−02 | 5 | 1 | LBY414 | 0.76 | 1.74E−02 | 9 | 43 |
| LBY414 | 0.74 | 2.32E−02 | 9 | 9 | LBY414 | 0.72 | 2.77E−02 | 3 | 52 |
| LBY414 | 0.70 | 2.36E−02 | 1 | 4 | LBY417 | 0.76 | 7.94E−02 | 8 | 6 |
| LBY414 | 0.78 | 3.85E−02 | 4 | 20 | LBY417 | 0.71 | 4.68E−02 | 12 | 20 |
| LBY417 | 0.78 | 7.25E−03 | 12 | 24 | LBY417 | 0.87 | 1.09E−03 | 11 | 24 |
| LBY417 | 0.79 | 6.23E−03 | 11 | 50 | LBY417 | 0.73 | 1.54E−02 | 1 | 24 |
| LBY417 | 0.85 | 1.74E−03 | 1 | 50 | LBY417 | 0.79 | 1.08E−02 | 5 | 33 |
| LBY417 | 0.93 | 7.63E−04 | 2 | 52 | LBY417 | 0.78 | 1.33E−02 | 5 | 37 |
| LBY417 | 0.70 | 3.45E−02 | 5 | 16 | LBY417 | 0.82 | 7.13E−03 | 2 | 48 |
| LBY417 | 0.79 | 1.08E−02 | 4 | 24 | LBY417 | 0.85 | 4.06E−03 | 4 | 48 |
| LBY417 | 0.71 | 1.15E−01 | 8 | 35 | LBY417 | 0.83 | 3.20E−02 | 12 | 48 |
| LBY417 | 0.78 | 1.36E−02 | 9 | 52 | LBY417 | 0.71 | 3.18E−02 | 9 | 49 |
| LBY417 | 0.75 | 5.15E−02 | 9 | 22 | LBY417 | 0.92 | 5.41E−04 | 2 | 49 |
| LBY417 | 0.76 | 1.86E−02 | 2 | 24 | LBY417 | 0.76 | 1.75E−02 | 9 | 50 |
| LBY417 | 0.76 | 1.80E−02 | 9 | 48 | LBY417 | 0.79 | 1.21E−02 | 4 | 50 |
| LBY417 | 0.88 | 1.58E−03 | 4 | 51 | LBY417 | 0.85 | 3.65E−03 | 2 | 50 |
| LBY417 | 0.83 | 6.01E−03 | 2 | 51 | LBY417 | 0.86 | 1.60E−03 | 12 | 50 |
| LBY417 | 0.82 | 4.06E−03 | 12 | 51 | LBY417 | 0.86 | 1.45E−03 | 11 | 51 |
| LBY417 | 0.83 | 2.75E−03 | 11 | 48 | LBY417 | 0.78 | 7.44E−03 | 1 | 51 |
| LBY417 | 0.85 | 1.96E−03 | 1 | 48 | LBY417 | 0.88 | 1.86E−03 | 11 | 52 |
| LBY417 | 0.81 | 4.70E−03 | 11 | 49 | LBY417 | 0.80 | 1.01E−02 | 1 | 52 |
| LBY417 | 0.88 | 8.65E−04 | 1 | 49 | LBY417 | 0.91 | 5.75E−04 | 12 | 52 |
| LBY417 | 0.82 | 3.97E−03 | 12 | 49 | LBY418 | 0.74 | 2.15E−02 | 4 | 7 |
| LBY418 | 0.83 | 2.13E−02 | 4 | 47 | LBY418 | 0.78 | 7.35E−03 | 11 | 17 |
| LBY418 | 0.78 | 4.07E−02 | 2 | 22 | LBY418 | 0.85 | 1.45E−02 | 9 | 22 |
| LBY418 | 0.76 | 1.69E−02 | 9 | 24 | LBY418 | 0.73 | 2.71E−02 | 2 | 24 |
| LBY418 | 0.70 | 3.44E−02 | 2 | 48 | LBY418 | 0.77 | 9.05E−03 | 3 | 35 |
| LBY418 | 0.81 | 2.70E−02 | 4 | 45 | LBY418 | 0.76 | 2.82E−02 | 12 | 46 |

TABLE 210-continued

Correlation between the expression level of selected genes of some embodiments of the invention in various tissues and the phenotypic performance under normal conditions across Foxtail millet varieties (set 1)

| Gene Name | R | P value | Exp. set | Corr. ID | Gene Name | R | P value | Exp. set | Corr. ID |
|---|---|---|---|---|---|---|---|---|---|
| LBY418 | 0.77 | 9.75E−03 | 12 | 50 | LBY418 | 0.76 | 1.01E−02 | 12 | 48 |
| LBY418 | 0.73 | 6.23E−02 | 9 | 21 | LBY418 | 0.77 | 1.45E−02 | 9 | 48 |
| LBY418 | 0.78 | 3.91E−02 | 9 | 44 | LBY418 | 0.83 | 5.96E−03 | 9 | 50 |
| LBY418 | 0.81 | 7.86E−03 | 9 | 51 | LBY418 | 0.84 | 2.16E−03 | 12 | 51 |
| LBY418 | 0.76 | 1.11E−02 | 12 | 16 | LBY418 | 0.91 | 5.71E−04 | 9 | 52 |
| LBY418 | 0.82 | 6.89E−03 | 9 | 49 | LBY418 | 0.81 | 8.30E−03 | 12 | 52 |
| LBY418 | 0.75 | 1.17E−02 | 12 | 49 | LBY419 | 0.73 | 2.69E−02 | 4 | 17 |
| LBY419 | 0.78 | 1.31E−02 | 4 | 9 | LBY419 | 0.71 | 4.79E−02 | 12 | 46 |
| LBY419 | 0.79 | 1.14E−02 | 9 | 52 | LBY419 | 0.71 | 3.09E−02 | 9 | 49 |
| LBY419 | 0.76 | 1.71E−02 | 9 | 51 | LBY419 | 0.76 | 1.77E−02 | 1 | 52 |
| LBY419 | 0.74 | 2.37E−02 | 4 | 42 | LBY421 | 0.79 | 1.17E−02 | 4 | 48 |
| LBY421 | 0.75 | 3.38E−02 | 2 | 52 | LBY421 | 0.82 | 3.79E−03 | 11 | 48 |
| LBY421 | 0.78 | 1.36E−02 | 4 | 24 | LBY421 | 0.72 | 2.72E−02 | 2 | 49 |
| LBY421 | 0.71 | 2.07E−02 | 11 | 24 | LBY421 | 0.86 | 1.28E−03 | 11 | 49 |
| LBY421 | 0.80 | 9.31E−03 | 4 | 51 | LBY421 | 0.79 | 1.08E−02 | 4 | 50 |
| LBY421 | 0.79 | 7.08E−03 | 11 | 51 | LBY421 | 0.78 | 7.36E−03 | 11 | 50 |
| LBY421 | 0.80 | 9.89E−03 | 11 | 52 | MGP67 | 0.72 | 1.87E−02 | 1 | 6 |
| MGP48 | 0.79 | 3.30E−02 | 2 | 22 | MGP48 | 0.74 | 1.45E−02 | 11 | 1 |
| MGP66 | 0.73 | 6.32E−02 | 4 | 45 | MGP66 | 0.86 | 6.58E−03 | 11 | 23 |
| MGP66 | 0.83 | 1.04E−02 | 11 | 47 | MGP66 | 0.87 | 1.06E−03 | 11 | 48 |
| MGP66 | 0.90 | 3.49E−04 | 11 | 51 | MGP66 | 0.87 | 1.15E−03 | 11 | 50 |
| MGP66 | 0.87 | 1.00E−03 | 11 | 24 | MGP66 | 0.84 | 8.64E−03 | 11 | 20 |
| MGP66 | 0.79 | 6.88E−03 | 11 | 49 | MGP66 | 0.86 | 3.05E−03 | 11 | 52 |
| MGP66 | 0.79 | 1.90E−02 | 11 | 21 | MGP66 | 0.71 | 2.17E−02 | 1 | 48 |
| MGP66 | 0.73 | 1.60E−02 | 1 | 51 | MGP66 | 0.76 | 1.13E−02 | 1 | 50 |
| MGP66 | 0.75 | 1.19E−02 | 1 | 24 | MGP66 | 0.72 | 1.77E−02 | 1 | 49 |
| MGP66 | 0.80 | 1.02E−02 | 1 | 52 | MGP67 | 0.85 | 3.10E−02 | 8 | 33 |
| MGP67 | 0.79 | 6.34E−02 | 8 | 10 | MGP67 | 0.91 | 1.11E−02 | 8 | 37 |
| MGP67 | 0.81 | 2.72E−02 | 4 | 44 | MGP67 | 0.78 | 3.74E−02 | 4 | 47 |
| MGP67 | 0.89 | 7.64E−03 | 4 | 45 | MGP67 | 0.78 | 1.36E−02 | 5 | 4 |
| MGP67 | 0.81 | 8.42E−03 | 5 | 2 | MGP67 | 0.74 | 1.35E−02 | 1 | 27 |
| MGP67 | 0.75 | 1.33E−02 | 1 | 31 | MGP67 | 0.72 | 1.99E−02 | 1 | 30 |

Table 210. Provided are the correlations (R) between the genes expression levels in various tissues and the phenotypic performance.
"Corr. ID" - correlation vector ID according to the correlated parameters specified in Table 200.
"Exp. Set"- Expression set specified in Table 198.
"R" = Pearson correlation coefficient;
"P" = p value

TABLE 211

Correlation between the expression level of selected genes of some embodiments of the invention in various tissues and the phenotypic performance under normal conditions (set 2 parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY243 | 0.87 | 2.49E−03 | 4 | 6 | LBY243 | 0.72 | 4.20E−02 | 3 | 2 |
| LBY243 | 0.96 | 1.14E−04 | 1 | 2 | LBY243 | 0.89 | 2.93E−03 | 1 | 13 |
| LBY243 | 0.76 | 2.99E−02 | 9 | 12 | LBY243 | 0.82 | 1.37E−02 | 9 | 7 |
| LBY243 | 0.83 | 1.10E−02 | 9 | 4 | LBY266 | 0.74 | 2.24E−02 | 4 | 8 |
| LBY266 | 0.79 | 3.29E−02 | 2 | 11 | LBY266 | 0.78 | 2.32E−02 | 5 | 10 |
| LBY266 | 0.76 | 2.89E−02 | 1 | 6 | LBY267 | 0.79 | 2.05E−02 | 3 | 7 |
| LBY267 | 0.79 | 2.04E−02 | 3 | 4 | LBY267 | 0.82 | 2.42E−02 | 2 | 7 |
| LBY267 | 0.81 | 2.59E−02 | 2 | 4 | LBY267 | 0.75 | 3.30E−02 | 11 | 6 |
| LBY290 | 0.71 | 3.10E−02 | 4 | 10 | LBY290 | 0.87 | 1.09E−02 | 2 | 10 |
| LBY290 | 0.76 | 1.71E−02 | 5 | 1 | LBY290 | 0.76 | 1.71E−02 | 5 | 5 |
| LBY290 | 0.84 | 9.22E−03 | 11 | 6 | LBY290 | 0.87 | 4.96E−03 | 1 | 6 |
| LBY290 | 0.91 | 7.42E−04 | 12 | 10 | LBY291 | 0.83 | 1.05E−02 | 5 | 10 |
| LBY291 | 0.76 | 2.95E−02 | 11 | 8 | LBY291 | 0.88 | 3.79E−03 | 9 | 9 |
| LBY291 | 0.84 | 4.97E−03 | 12 | 7 | LBY291 | 0.87 | 2.19E−03 | 12 | 4 |
| LBY292 | 0.84 | 8.78E−03 | 3 | 12 | LBY292 | 0.92 | 1.07E−03 | 5 | 12 |
| LBY292 | 0.84 | 8.45E−03 | 1 | 6 | LBY292 | 0.89 | 3.43E−03 | 9 | 12 |
| LBY292 | 0.80 | 9.09E−03 | 12 | 12 | LBY293 | 0.87 | 2.11E−03 | 4 | 9 |
| LBY293 | 0.71 | 4.95E−02 | 3 | 3 | LBY293 | 0.79 | 3.54E−02 | 2 | 2 |
| LBY293 | 0.91 | 4.48E−03 | 2 | 13 | LBY293 | 0.73 | 4.09E−02 | 5 | 6 |
| LBY293 | 0.81 | 1.58E−02 | 1 | 2 | LBY293 | 0.79 | 1.94E−02 | 1 | 13 |
| LBY294 | 0.75 | 1.95E−02 | 4 | 9 | LBY294 | 0.72 | 4.56E−02 | 3 | 3 |
| LBY294 | 0.79 | 1.89E−02 | 5 | 12 | LBY294 | 0.86 | 6.51E−03 | 9 | 8 |
| LBY294 | 0.72 | 2.86E−02 | 12 | 4 | LBY295 | 0.72 | 2.94E−02 | 4 | 4 |

TABLE 211-continued

Correlation between the expression level of selected genes of some
embodiments of the invention in various tissues and the phenotypic performance
under normal conditions (set 2 parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY295 | 0.71 | 4.63E-02 | 5 | 12 | LBY295 | 0.82 | 1.21E-02 | 11 | 8 |
| LBY295 | 0.80 | 1.80E-02 | 9 | 12 | LBY295 | 0.86 | 2.93E-03 | 12 | 8 |
| LBY296 | 0.73 | 3.88E-02 | 3 | 9 | LBY296 | 0.76 | 2.88E-02 | 3 | 2 |
| LBY296 | 0.76 | 2.96E-02 | 11 | 10 | LBY296 | 0.81 | 1.42E-02 | 11 | 13 |
| LBY296 | 0.90 | 2.36E-03 | 11 | 8 | LBY296 | 0.70 | 5.21E-02 | 11 | 6 |
| LBY296 | 0.73 | 4.03E-02 | 1 | 6 | LBY296 | 0.90 | 4.39E-04 | 12 | 1 |
| LBY296 | 0.74 | 2.14E-02 | 12 | 7 | LBY296 | 0.70 | 3.57E-02 | 12 | 3 |
| LBY296 | 0.90 | 4.39E-04 | 12 | 5 | LBY297 | 0.75 | 1.92E-02 | 4 | 6 |
| LBY297 | 0.85 | 1.62E-02 | 2 | 13 | LBY297 | 0.76 | 1.69E-02 | 12 | 6 |
| LBY298 | 0.85 | 7.19E-03 | 3 | 12 | LBY298 | 0.72 | 4.28E-02 | 3 | 11 |
| LBY298 | 0.84 | 1.67E-02 | 2 | 2 | LBY298 | 0.89 | 7.21E-03 | 2 | 13 |
| LBY298 | 0.74 | 3.52E-02 | 5 | 12 | LBY298 | 0.77 | 1.43E-02 | 12 | 8 |
| LBY299 | 0.84 | 4.24E-03 | 4 | 9 | LBY299 | 0.71 | 4.83E-02 | 3 | 8 |
| LBY299 | 0.75 | 3.32E-02 | 5 | 2 | LBY299 | 0.99 | 5.60E-06 | 5 | 12 |
| LBY299 | 0.76 | 2.94E-02 | 5 | 7 | LBY299 | 0.86 | 6.56E-03 | 5 | 13 |
| LBY299 | 0.75 | 3.10E-02 | 5 | 4 | LBY299 | 0.80 | 1.80E-02 | 11 | 8 |
| LBY299 | 0.91 | 1.62E-03 | 1 | 2 | LBY299 | 0.86 | 6.29E-03 | 1 | 13 |
| LBY299 | 0.90 | 2.46E-03 | 1 | 6 | LBY299 | 0.87 | 5.42E-03 | 9 | 12 |
| LBY299 | 0.83 | 1.04E-02 | 9 | 13 | LBY299 | 0.90 | 2.32E-03 | 9 | 8 |
| LBY299 | 0.81 | 8.31E-03 | 12 | 8 | LBY300 | 0.91 | 6.41E-04 | 4 | 9 |
| LBY300 | 0.88 | 4.12E-03 | 3 | 3 | LBY300 | 0.85 | 3.65E-03 | 12 | 7 |
| LBY300 | 0.81 | 7.81E-03 | 12 | 4 | LBY317 | 0.84 | 9.49E-03 | 5 | 12 |
| LBY317 | 0.84 | 1.72E-02 | 2 | 10 | LBY317 | 0.88 | 3.92E-03 | 11 | 2 |
| LBY317 | 0.78 | 2.23E-02 | 11 | 9 | LBY317 | 0.91 | 1.73E-03 | 1 | 13 |
| LBY317 | 0.93 | 9.26E-04 | 1 | 2 | LBY317 | 0.72 | 4.25E-02 | 9 | 8 |
| LBY317 | 0.91 | 1.57E-03 | 9 | 12 | LBY318 | 0.89 | 7.91E-03 | 2 | 9 |
| LBY317 | 0.77 | 1.47E-02 | 12 | 8 | LBY318 | 0.80 | 3.22E-02 | 2 | 13 |
| LBY318 | 0.74 | 5.80E-02 | 2 | 2 | LBY318 | 0.82 | 1.33E-02 | 11 | 13 |
| LBY318 | 0.81 | 1.55E-02 | 11 | 2 | LBY318 | 0.87 | 5.04E-03 | 1 | 13 |
| LBY318 | 0.83 | 1.15E-02 | 1 | 2 | LBY319 | 0.71 | 4.93E-02 | 3 | 12 |
| LBY318 | 0.71 | 3.13E-02 | 12 | 8 | LBY319 | 0.72 | 4.58E-02 | 5 | 7 |
| LBY319 | 0.75 | 3.09E-02 | 3 | 3 | LBY319 | 0.79 | 1.18E-02 | 12 | 13 |
| LBY319 | 0.73 | 4.17E-02 | 9 | 12 | LBY320 | 0.70 | 5.28E-02 | 3 | 3 |
| LBY320 | 0.77 | 1.52E-02 | 4 | 9 | LBY320 | 0.73 | 4.04E-02 | 9 | 13 |
| LBY320 | 0.75 | 3.25E-02 | 5 | 2 | LBY320 | 0.74 | 2.18E-02 | 12 | 4 |
| LBY320 | 0.70 | 3.48E-02 | 12 | 7 | LBY321 | 0.79 | 1.89E-02 | 3 | 3 |
| LBY321 | 0.88 | 3.60E-03 | 3 | 7 | LBY321 | 0.71 | 7.33E-02 | 2 | 9 |
| LBY321 | 0.84 | 9.05E-03 | 3 | 4 | LBY321 | 0.82 | 2.35E-02 | 2 | 8 |
| LBY321 | 0.77 | 4.10E-02 | 2 | 13 | LBY321 | 0.85 | 7.32E-03 | 1 | 7 |
| LBY321 | 0.74 | 3.62E-02 | 11 | 11 | LBY322 | 0.73 | 4.16E-02 | 3 | 12 |
| LBY321 | 0.87 | 4.50E-03 | 1 | 4 | LBY322 | 0.76 | 2.78E-02 | 5 | 13 |
| LBY322 | 0.89 | 6.97E-03 | 2 | 8 | LBY322 | 0.71 | 3.33E-02 | 12 | 4 |
| LBY322 | 0.85 | 6.86E-03 | 1 | 12 | LBY368 | 0.74 | 2.37E-02 | 4 | 2 |
| LBY368 | 0.88 | 1.70E-03 | 4 | 9 | LBY368 | 0.75 | 5.13E-02 | 2 | 3 |
| LBY368 | 0.83 | 1.02E-02 | 3 | 10 | LBY368 | 0.72 | 4.28E-02 | 5 | 6 |
| LBY368 | 0.74 | 5.87E-02 | 2 | 6 | LBY368 | 0.80 | 1.62E-02 | 11 | 8 |
| LBY368 | 0.71 | 4.80E-02 | 11 | 13 | LBY368 | 0.88 | 3.91E-03 | 1 | 7 |
| LBY368 | 0.82 | 3.73E-03 | 1 | 1 | LBY368 | 0.82 | 3.73E-03 | 1 | 5 |
| LBY368 | 0.90 | 2.13E-03 | 1 | 4 | LBY368 | 0.73 | 2.58E-02 | 12 | 3 |
| LBY368 | 0.81 | 8.74E-03 | 12 | 7 | LBY369 | 0.83 | 1.08E-02 | 3 | 10 |
| LBY368 | 0.73 | 2.49E-02 | 12 | 4 | LBY369 | 0.72 | 6.90E-02 | 2 | 8 |
| LBY369 | 0.89 | 7.76E-03 | 2 | 10 | LBY371 | 0.80 | 9.14E-03 | 4 | 2 |
| LBY371 | 0.82 | 1.33E-02 | 11 | 6 | LBY371 | 0.75 | 3.18E-02 | 9 | 6 |
| LBY414 | 0.72 | 4.31E-02 | 5 | 6 | LBY414 | 0.79 | 1.97E-02 | 11 | 6 |
| LBY414 | 0.80 | 1.63E-02 | 9 | 6 | LBY414 | 0.74 | 2.32E-02 | 12 | 11 |
| LBY417 | 0.76 | 7.94E-02 | 8 | 5 | LBY417 | 0.76 | 7.94E-02 | 8 | 1 |
| LBY417 | 0.87 | 2.43E-03 | 4 | 8 | LBY417 | 0.85 | 4.11E-03 | 4 | 9 |
| LBY417 | 0.83 | 1.96E-02 | 2 | 2 | LBY417 | 0.96 | 1.71E-04 | 3 | 12 |
| LBY417 | 0.73 | 4.13E-02 | 5 | 12 | LBY417 | 0.88 | 8.63E-03 | 2 | 13 |
| LBY417 | 0.75 | 3.19E-02 | 5 | 4 | LBY417 | 0.74 | 3.66E-02 | 5 | 7 |
| LBY417 | 0.90 | 2.59E-03 | 11 | 13 | LBY417 | 0.74 | 3.40E-02 | 11 | 2 |
| LBY417 | 0.93 | 8.29E-04 | 1 | 8 | LBY417 | 0.83 | 1.07E-02 | 11 | 8 |
| LBY417 | 0.84 | 4.99E-03 | 12 | 8 | LBY417 | 0.78 | 1.36E-02 | 12 | 13 |
| LBY418 | 0.81 | 1.46E-02 | 3 | 8 | LBY418 | 0.83 | 5.42E-03 | 4 | 12 |
| LBY418 | 0.98 | 1.59E-04 | 2 | 2 | LBY418 | 0.83 | 1.97E-02 | 2 | 9 |
| LBY418 | 0.90 | 2.38E-03 | 5 | 12 | LBY418 | 0.88 | 9.37E-03 | 2 | 13 |
| LBY418 | 0.76 | 3.03E-02 | 11 | 10 | LBY418 | 0.75 | 3.04E-02 | 11 | 2 |
| LBY418 | 0.84 | 8.44E-03 | 9 | 13 | LBY418 | 0.70 | 5.08E-02 | 9 | 2 |
| LBY418 | 0.71 | 3.37E-02 | 12 | 13 | LBY418 | 0.77 | 2.40E-02 | 9 | 8 |
| LBY419 | 0.89 | 1.25E-03 | 4 | 10 | LBY418 | 0.85 | 3.32E-03 | 12 | 8 |
| LBY419 | 0.81 | 1.44E-02 | 1 | 2 | LBY419 | 0.73 | 4.08E-02 | 3 | 8 |
| LBY419 | 0.94 | 6.35E-04 | 1 | 13 | LBY419 | 0.80 | 1.62E-02 | 1 | 7 |
| LBY419 | 0.85 | 3.63E-03 | 12 | 7 | LBY419 | 0.80 | 1.75E-02 | 1 | 4 |

TABLE 211-continued

Correlation between the expression level of selected genes of some
embodiments of the invention in various tissues and the phenotypic performance
under normal conditions (set 2 parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY421 | 0.83 | 2.15E−02 | 2 | 13 | LBY419 | 0.88 | 1.56E−03 | 12 | 4 |
| LBY421 | 0.77 | 2.47E−02 | 11 | 2 | LBY421 | 0.78 | 1.27E−02 | 4 | 9 |
| LBY421 | 0.96 | 1.22E−04 | 11 | 8 | LBY421 | 0.78 | 4.07E−02 | 2 | 8 |
| LBY421 | 0.76 | 2.79E−02 | 1 | 13 | LBY421 | 0.76 | 2.87E−02 | 11 | 13 |
| MGP48 | 0.77 | 4.40E−02 | 2 | 2 | LBY421 | 0.97 | 8.75E−05 | 1 | 2 |
| MGP48 | 0.86 | 6.36E−03 | 1 | 8 | MGP67 | 0.84 | 4.23E−03 | 12 | 10 |
| MGP66 | 0.76 | 4.82E−02 | 2 | 13 | MGP48 | 0.72 | 7.04E−02 | 2 | 13 |
| MGP66 | 0.93 | 7.64E−04 | 11 | 13 | MGP66 | 0.93 | 2.44E−03 | 2 | 2 |
| MGP66 | 0.87 | 5.00E−03 | 1 | 13 | MGP66 | 0.84 | 8.47E−03 | 11 | 2 |
|  |  |  |  |  | MGP66 | 0.73 | 4.10E−02 | 1 | 2 |

Table 211. Provided are the correlations (R) between the genes expression levels in various tissues and the phenotypic performance.
"Corr. ID" - correlation vector ID according to the correlated parameters specified in Table 201.
"Exp. Set"- Expression set specified in Table 198.
"R" = Pearson correlation coefficient;
"P" = p value

TABLE 212

Correlation between the expression level of selected genes of some embodiments of the
invention in various tissues and the phenotypic performance under low N conditions (set 1
parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY243 | 0.78 | 7.61E−03 | 3 | 48 | LBY243 | 0.71 | 3.28E−02 | 8 | 37 |
| LBY243 | 0.82 | 2.34E−02 | 8 | 22 | LBY243 | 0.78 | 8.06E−03 | 1 | 48 |
| LBY243 | 0.76 | 1.12E−02 | 1 | 50 | LBY243 | 0.80 | 5.24E−03 | 1 | 24 |
| LBY243 | 0.77 | 1.46E−02 | 1 | 22 | LBY243 | 0.77 | 8.57E−03 | 1 | 49 |
| LBY243 | 0.73 | 1.72E−02 | 9 | 14 | LBY243 | 0.71 | 3.22E−02 | 9 | 47 |
| LBY243 | 0.82 | 3.65E−03 | 9 | 16 | LBY243 | 0.83 | 5.10E−03 | 9 | 45 |
| LBY243 | 0.75 | 1.19E−02 | 9 | 17 | LBY266 | 0.75 | 2.08E−02 | 9 | 22 |
| LBY266 | 0.71 | 3.28E−02 | 8 | 33 | LBY266 | 0.71 | 3.25E−02 | 8 | 37 |
| LBY266 | 0.70 | 2.40E−02 | 1 | 27 | LBY266 | 0.78 | 8.17E−03 | 1 | 35 |
| LBY266 | 0.78 | 8.38E−03 | 1 | 30 | LBY266 | 0.72 | 1.84E−02 | 1 | 36 |
| LBY266 | 0.83 | 3.01E−03 | 9 | 43 | LBY266 | 0.80 | 5.38E−03 | 9 | 9 |
| LBY266 | 0.83 | 2.73E−03 | 9 | 42 | LBY266 | 0.71 | 2.19E−02 | 2 | 31 |
| LBY266 | 0.83 | 5.68E−03 | 2 | 46 | LBY267 | 0.78 | 7.64E−03 | 3 | 27 |
| LBY267 | 0.80 | 5.91E−03 | 3 | 31 | LBY267 | 0.76 | 1.63E−02 | 3 | 46 |
| LBY267 | 0.71 | 3.11E−02 | 8 | 33 | LBY290 | 0.71 | 2.21E−02 | 3 | 14 |
| LBY290 | 0.77 | 1.62E−02 | 3 | 47 | LBY290 | 0.80 | 5.86E−03 | 3 | 16 |
| LBY290 | 0.70 | 2.39E−02 | 3 | 38 | LBY290 | 0.87 | 2.10E−03 | 3 | 45 |
| LBY290 | 0.80 | 5.46E−03 | 3 | 17 | LBY290 | 0.71 | 3.32E−02 | 3 | 20 |
| LBY290 | 0.84 | 4.43E−03 | 8 | 33 | LBY290 | 0.78 | 1.41E−02 | 8 | 37 |
| LBY290 | 0.76 | 1.15E−02 | 1 | 37 | LBY290 | 0.70 | 2.33E−02 | 9 | 32 |
| LBY290 | 0.84 | 2.45E−03 | 2 | 43 | LBY290 | 0.90 | 3.29E−04 | 2 | 9 |
| LBY290 | 0.85 | 1.84E−03 | 2 | 42 | LBY291 | 0.80 | 5.21E−03 | 3 | 16 |
| LBY291 | 0.71 | 3.13E−02 | 8 | 33 | LBY291 | 0.74 | 2.18E−02 | 9 | 23 |
| LBY291 | 0.91 | 7.61E−04 | 9 | 47 | LBY291 | 0.85 | 3.37E−03 | 9 | 45 |
| LBY291 | 0.77 | 9.54E−03 | 9 | 17 | LBY291 | 0.85 | 3.72E−03 | 9 | 20 |
| LBY292 | 0.83 | 3.29E−03 | 3 | 12 | LBY292 | 0.76 | 1.02E−02 | 3 | 14 |
| LBY292 | 0.73 | 1.68E−02 | 3 | 16 | LBY292 | 0.82 | 6.80E−03 | 3 | 45 |
| LBY292 | 0.74 | 1.42E−02 | 3 | 17 | LBY292 | 0.79 | 6.55E−03 | 3 | 4 |
| LBY292 | 0.85 | 3.54E−03 | 8 | 12 | LBY292 | 0.81 | 2.87E−02 | 8 | 44 |
| LBY292 | 0.84 | 1.73E−02 | 8 | 23 | LBY292 | 0.72 | 2.89E−02 | 8 | 14 |
| LBY292 | 0.81 | 2.81E−02 | 8 | 47 | LBY292 | 0.71 | 3.35E−02 | 8 | 1 |
| LBY292 | 0.91 | 4.51E−03 | 8 | 45 | LBY292 | 0.91 | 5.01E−03 | 8 | 20 |
| LBY292 | 0.87 | 1.14E−02 | 8 | 21 | LBY292 | 0.89 | 1.43E−03 | 8 | 4 |
| LBY292 | 0.81 | 4.30E−03 | 4 | 27 | LBY292 | 0.81 | 4.21E−03 | 4 | 31 |
| LBY292 | 0.81 | 4.59E−03 | 4 | 35 | LBY292 | 0.87 | 5.16E−03 | 4 | 46 |
| LBY292 | 0.70 | 2.38E−02 | 4 | 3 | LBY292 | 0.84 | 2.16E−03 | 4 | 30 |
| LBY292 | 0.72 | 2.73E−02 | 9 | 44 | LBY292 | 0.82 | 3.62E−03 | 9 | 14 |
| LBY292 | 0.86 | 3.18E−03 | 9 | 47 | LBY292 | 0.80 | 4.99E−03 | 9 | 16 |
| LBY292 | 0.95 | 6.29E−05 | 9 | 45 | LBY292 | 0.83 | 3.10E−03 | 9 | 17 |
| LBY292 | 0.80 | 1.03E−02 | 9 | 20 | LBY292 | 0.71 | 2.12E−02 | 2 | 1 |
| LBY292 | 0.72 | 1.97E−02 | 2 | 3 | LBY293 | 0.72 | 1.96E−02 | 3 | 27 |
| LBY293 | 0.72 | 1.87E−02 | 3 | 31 | LBY293 | 0.75 | 1.21E−02 | 3 | 30 |
| LBY293 | 0.73 | 2.55E−02 | 8 | 33 | LBY293 | 0.71 | 1.17E−01 | 8 | 25 |
| LBY293 | 0.86 | 1.26E−03 | 1 | 48 | LBY293 | 0.87 | 1.04E−03 | 1 | 51 |
| LBY293 | 0.84 | 2.11E−03 | 1 | 50 | LBY293 | 0.87 | 9.30E−04 | 1 | 24 |

TABLE 212-continued

Correlation between the expression level of selected genes of some embodiments of the invention in various tissues and the phenotypic performance under low N conditions (set 1 parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY293 | 0.73 | 2.62E−02 | 1 | 22 | LBY293 | 0.84 | 2.64E−03 | 1 | 49 |
| LBY293 | 0.85 | 1.67E−03 | 1 | 52 | LBY293 | 0.72 | 2.72E−02 | 9 | 44 |
| LBY293 | 0.77 | 8.69E−03 | 9 | 52 | LBY293 | 0.84 | 2.51E−03 | 2 | 48 |
| LBY293 | 0.87 | 1.09E−03 | 2 | 50 | LBY293 | 0.88 | 7.89E−04 | 2 | 24 |
| LBY293 | 0.90 | 3.62E−04 | 2 | 49 | LBY293 | 0.87 | 9.49E−04 | 2 | 52 |
| LBY293 | 0.75 | 5.24E−02 | 2 | 25 | LBY294 | 0.79 | 6.68E−03 | 3 | 12 |
| LBY294 | 0.76 | 1.06E−02 | 3 | 1 | LBY294 | 0.80 | 5.63E−03 | 3 | 3 |
| LBY294 | 0.81 | 7.61E−03 | 8 | 43 | LBY294 | 0.77 | 1.58E−02 | 8 | 9 |
| LBY294 | 0.82 | 6.85E−03 | 8 | 42 | LBY294 | 0.71 | 2.12E−02 | 4 | 43 |
| LBY294 | 0.79 | 6.92E−03 | 9 | 14 | LBY294 | 0.71 | 3.38E−02 | 9 | 47 |
| LBY294 | 0.85 | 1.99E−03 | 9 | 16 | LBY294 | 0.84 | 4.68E−03 | 9 | 45 |
| LBY294 | 0.81 | 4.20E−03 | 9 | 17 | LBY295 | 0.71 | 2.15E−02 | 3 | 12 |
| LBY295 | 0.88 | 6.92E−04 | 3 | 16 | LBY295 | 0.77 | 8.86E−03 | 3 | 17 |
| LBY295 | 0.80 | 1.03E−02 | 8 | 33 | LBY295 | 0.72 | 2.95E−02 | 8 | 37 |
| LBY295 | 0.70 | 2.34E−02 | 9 | 14 | LBY295 | 0.76 | 1.09E−02 | 9 | 16 |
| LBY295 | 0.71 | 2.26E−02 | 9 | 51 | LBY295 | 0.81 | 8.74E−03 | 9 | 45 |
| LBY295 | 0.76 | 1.10E−02 | 9 | 17 | LBY296 | 0.83 | 2.78E−03 | 3 | 39 |
| LBY296 | 0.78 | 7.60E−03 | 3 | 16 | LBY296 | 0.83 | 2.73E−03 | 3 | 38 |
| LBY296 | 0.89 | 6.09E−04 | 3 | 17 | LBY297 | 0.70 | 2.30E−02 | 3 | 28 |
| LBY297 | 0.73 | 2.49E−02 | 9 | 46 | LBY297 | 0.72 | 1.78E−02 | 2 | 11 |
| LBY297 | 0.73 | 1.66E−02 | 2 | 49 | LBY297 | 0.70 | 3.51E−02 | 2 | 21 |
| LBY298 | 0.72 | 1.05E−01 | 8 | 25 | LBY298 | 0.79 | 6.59E−03 | 4 | 48 |
| LBY298 | 0.75 | 1.34E−02 | 4 | 51 | LBY298 | 0.71 | 2.08E−02 | 4 | 50 |
| LBY298 | 0.74 | 1.48E−02 | 4 | 24 | LBY298 | 0.76 | 2.99E−02 | 4 | 22 |
| LBY298 | 0.76 | 1.13E−02 | 9 | 14 | LBY298 | 0.72 | 3.00E−02 | 9 | 47 |
| LBY298 | 0.74 | 1.47E−02 | 9 | 16 | LBY298 | 0.70 | 2.38E−02 | 9 | 51 |
| LBY298 | 0.83 | 6.08E−03 | 9 | 45 | LBY298 | 0.71 | 2.02E−02 | 9 | 17 |
| LBY298 | 0.72 | 1.89E−02 | 2 | 6 | LBY298 | 0.84 | 4.58E−03 | 2 | 22 |
| LBY299 | 0.83 | 2.65E−03 | 3 | 1 | LBY299 | 0.84 | 2.36E−03 | 3 | 3 |
| LBY299 | 0.80 | 9.01E−03 | 8 | 43 | LBY299 | 0.73 | 2.55E−02 | 8 | 11 |
| LBY299 | 0.70 | 3.44E−02 | 8 | 42 | LBY299 | 0.71 | 3.24E−02 | 8 | 36 |
| LBY299 | 0.93 | 1.19E−04 | 1 | 48 | LBY299 | 0.83 | 2.89E−03 | 1 | 51 |
| LBY299 | 0.90 | 4.06E−04 | 1 | 50 | LBY299 | 0.89 | 5.84E−04 | 1 | 24 |
| LBY299 | 0.86 | 3.21E−03 | 1 | 22 | LBY299 | 0.90 | 3.73E−04 | 1 | 49 |
| LBY299 | 0.86 | 1.28E−03 | 1 | 52 | LBY299 | 0.73 | 6.52E−03 | 1 | 25 |
| LBY299 | 0.70 | 2.32E−02 | 9 | 14 | LBY299 | 0.77 | 1.57E−02 | 9 | 47 |
| LBY299 | 0.72 | 1.92E−02 | 9 | 48 | LBY299 | 0.80 | 5.22E−03 | 9 | 51 |
| LBY299 | 0.87 | 2.21E−03 | 9 | 45 | LBY299 | 0.81 | 8.58E−03 | 2 | 22 |
| LBY299 | 0.77 | 8.50E−03 | 2 | 32 | LBY300 | 0.92 | 1.97E−04 | 3 | 12 |
| LBY300 | 0.83 | 5.96E−03 | 3 | 44 | LBY300 | 0.87 | 2.27E−03 | 3 | 23 |
| LBY300 | 0.72 | 1.98E−02 | 3 | 14 | LBY300 | 0.78 | 1.33E−02 | 3 | 47 |
| LBY300 | 0.75 | 1.92E−02 | 3 | 45 | LBY300 | 0.81 | 8.15E−03 | 3 | 20 |
| LBY300 | 0.85 | 3.72E−03 | 3 | 21 | LBY300 | 0.87 | 1.12E−03 | 3 | 4 |
| LBY300 | 0.75 | 2.04E−02 | 8 | 43 | LBY300 | 0.72 | 2.83E−02 | 8 | 36 |
| LBY300 | 0.73 | 1.59E−02 | 9 | 14 | LBY300 | 0.73 | 2.41E−02 | 9 | 47 |
| LBY300 | 0.78 | 7.17E−03 | 9 | 16 | LBY300 | 0.82 | 6.90E−03 | 9 | 45 |
| LBY300 | 0.74 | 1.52E−02 | 9 | 17 | LBY300 | 0.72 | 1.91E−02 | 3 | 12 |
| LBY317 | 0.85 | 1.72E−03 | 3 | 1 | LBY317 | 0.89 | 5.75E−04 | 3 | 3 |
| LBY317 | 0.89 | 8.07E−03 | 8 | 22 | LBY317 | 0.80 | 5.50E−03 | 1 | 48 |
| LBY317 | 0.81 | 4.13E−03 | 1 | 50 | LBY317 | 0.84 | 2.41E−03 | 1 | 24 |
| LBY317 | 0.79 | 1.17E−02 | 1 | 45 | LBY317 | 0.75 | 1.91E−02 | 1 | 22 |
| LBY317 | 0.87 | 1.18E−03 | 1 | 49 | LBY317 | 0.76 | 1.02E−02 | 1 | 52 |
| LBY317 | 0.82 | 2.47E−02 | 1 | 25 | LBY317 | 0.71 | 4.75E−02 | 4 | 22 |
| LBY317 | 0.72 | 1.93E−02 | 9 | 14 | LBY317 | 0.73 | 2.47E−02 | 2 | 22 |
| LBY318 | 0.79 | 7.05E−03 | 1 | 48 | LBY318 | 0.76 | 1.04E−02 | 1 | 50 |
| LBY318 | 0.83 | 3.21E−03 | 1 | 24 | LBY318 | 0.80 | 1.04E−02 | 1 | 22 |
| LBY318 | 0.78 | 7.37E−03 | 1 | 49 | LBY318 | 0.70 | 2.41E−02 | 1 | 52 |
| LBY318 | 0.77 | 4.22E−02 | 1 | 25 | LBY318 | 0.79 | 6.34E−03 | 4 | 12 |
| LBY318 | 0.79 | 1.88E−02 | 4 | 44 | LBY318 | 0.74 | 3.75E−02 | 4 | 21 |
| LBY318 | 0.89 | 4.99E−04 | 9 | 48 | LBY318 | 0.86 | 1.46E−03 | 9 | 51 |
| LBY318 | 0.86 | 1.57E−03 | 9 | 50 | LBY318 | 0.80 | 5.22E−03 | 9 | 24 |
| LBY318 | 0.76 | 1.10E−02 | 9 | 49 | LBY318 | 0.78 | 7.45E−03 | 9 | 52 |
| LBY318 | 0.78 | 3.79E−02 | 9 | 25 | LBY318 | 0.71 | 2.06E−02 | 2 | 6 |
| LBY318 | 0.76 | 1.86E−02 | 2 | 22 | LBY319 | 0.85 | 3.45E−02 | 8 | 33 |
| LBY319 | 0.81 | 8.27E−03 | 8 | 37 | LBY319 | 0.71 | 3.25E−02 | 8 | 2 |
| LBY319 | 0.73 | 2.60E−02 | 8 | 36 | LBY319 | 0.82 | 6.32E−03 | 9 | 44 |
| LBY319 | 0.82 | 6.94E−03 | 9 | 23 | LBY319 | 0.77 | 9.16E−03 | 9 | 14 |
| LBY319 | 0.95 | 1.19E−04 | 9 | 47 | LBY319 | 0.76 | 1.05E−02 | 9 | 51 |
| LBY319 | 0.75 | 1.33E−02 | 9 | 24 | LBY319 | 0.93 | 2.95E−04 | 9 | 45 |
| LBY319 | 0.88 | 1.75E−03 | 9 | 20 | LBY319 | 0.74 | 2.21E−02 | 9 | 21 |
| LBY320 | 0.83 | 2.70E−03 | 3 | 12 | LBY320 | 0.70 | 2.32E−02 | 3 | 1 |
| LBY320 | 0.70 | 2.41E−02 | 4 | 7 | LBY320 | 0.75 | 1.30E−02 | 9 | 14 |
| LBY320 | 0.81 | 4.94E−03 | 9 | 16 | LBY320 | 0.79 | 1.07E−02 | 9 | 45 |

TABLE 212-continued

Correlation between the expression level of selected genes of some embodiments of the invention in various tissues and the phenotypic performance under low N conditions (set 1 parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY320 | 0.78 | 7.88E−03 | 9 | 17 | LBY321 | 0.70 | 2.30E−02 | 3 | 27 |
| LBY321 | 0.72 | 2.00E−02 | 3 | 31 | LBY321 | 0.75 | 1.90E−02 | 3 | 46 |
| LBY321 | 0.78 | 1.25E−02 | 8 | 32 | LBY321 | 0.79 | 6.55E−03 | 9 | 27 |
| LBY321 | 0.78 | 7.83E−03 | 9 | 31 | LBY321 | 0.77 | 9.05E−03 | 9 | 30 |
| LBY321 | 0.86 | 2.97E−03 | 2 | 44 | LBY321 | 0.85 | 3.52E−03 | 2 | 23 |
| LBY321 | 0.76 | 1.74E−02 | 2 | 47 | LBY321 | 0.82 | 3.54E−03 | 2 | 48 |
| LBY321 | 0.81 | 4.41E−03 | 2 | 51 | LBY321 | 0.80 | 4.98E−03 | 2 | 50 |
| LBY321 | 0.76 | 1.14E−02 | 2 | 24 | LBY321 | 0.79 | 6.67E−03 | 2 | 49 |
| LBY321 | 0.86 | 1.61E−03 | 2 | 52 | LBY321 | 0.81 | 8.29E−03 | 2 | 21 |
| LBY322 | 0.80 | 5.60E−03 | 3 | 16 | LBY322 | 0.72 | 2.77E−02 | 3 | 45 |
| LBY322 | 0.73 | 1.68E−02 | 3 | 17 | LBY322 | 0.88 | 8.51E−04 | 9 | 14 |
| LBY322 | 0.85 | 3.97E−03 | 9 | 47 | LBY322 | 0.76 | 1.07E−02 | 9 | 16 |
| LBY322 | 0.92 | 4.37E−04 | 9 | 45 | LBY322 | 0.76 | 1.14E−02 | 9 | 17 |
| LBY322 | 0.76 | 1.68E−02 | 9 | 20 | LBY322 | 0.70 | 2.33E−02 | 2 | 52 |
| LBY368 | 0.74 | 2.13E−02 | 3 | 46 | LBY368 | 0.85 | 4.11E−03 | 8 | 33 |
| LBY368 | 0.78 | 1.39E−02 | 8 | 37 | LBY368 | 0.72 | 2.82E−02 | 8 | 36 |
| LBY368 | 0.72 | 1.77E−02 | 1 | 8 | LBY368 | 0.71 | 3.09E−02 | 1 | 23 |
| LBY368 | 0.72 | 2.01E−02 | 1 | 50 | LBY368 | 0.72 | 1.84E−02 | 1 | 24 |
| LBY368 | 0.77 | 9.43E−03 | 1 | 36 | LBY368 | 0.76 | 1.69E−02 | 1 | 21 |
| LBY368 | 0.87 | 1.11E−02 | 1 | 25 | LBY368 | 0.80 | 1.04E−02 | 9 | 44 |
| LBY368 | 0.71 | 3.18E−02 | 9 | 23 | LBY368 | 0.87 | 2.16E−03 | 9 | 47 |
| LBY368 | 0.71 | 2.03E−02 | 9 | 28 | LBY368 | 0.81 | 8.72E−03 | 9 | 45 |
| LBY368 | 0.79 | 1.18E−02 | 9 | 20 | LBY368 | 0.72 | 2.82E−02 | 2 | 22 |
| LBY369 | 0.71 | 2.16E−02 | 3 | 37 | LBY369 | 0.71 | 3.14E−02 | 8 | 4 |
| LBY369 | 0.74 | 2.27E−02 | 1 | 46 | LBY369 | 0.93 | 7.32E−05 | 9 | 43 |
| LBY369 | 0.93 | 9.50E−05 | 9 | 9 | LBY369 | 0.87 | 9.48E−04 | 9 | 42 |
| LBY369 | 0.76 | 1.10E−02 | 9 | 36 | LBY369 | 0.78 | 8.27E−03 | 2 | 43 |
| LBY369 | 0.81 | 4.65E−03 | 2 | 9 | LBY369 | 0.73 | 1.66E−02 | 2 | 35 |
| LBY369 | 0.70 | 2.32E−02 | 2 | 42 | LBY369 | 0.82 | 3.84E−03 | 2 | 36 |
| LBY371 | 0.73 | 1.72E−02 | 4 | 14 | LBY371 | 0.73 | 1.62E−02 | 4 | 8 |
| LBY371 | 0.80 | 5.02E−03 | 2 | 4 | LBY371 | 0.75 | 3.24E−02 | 4 | 22 |
| LBY371 | 0.85 | 3.99E−03 | 2 | 44 | LBY371 | 0.78 | 7.79E−03 | 9 | 9 |
| LBY371 | 0.82 | 6.75E−03 | 2 | 47 | LBY371 | 0.90 | 9.51E−04 | 2 | 23 |
| LBY371 | 0.78 | 8.04E−03 | 2 | 51 | LBY371 | 0.80 | 5.43E−03 | 2 | 48 |
| LBY371 | 0.83 | 2.83E−03 | 2 | 24 | LBY371 | 0.79 | 7.04E−03 | 2 | 50 |
| LBY371 | 0.76 | 1.02E−02 | 2 | 49 | LBY371 | 0.83 | 5.47E−03 | 2 | 20 |
| LBY371 | 0.86 | 3.03E−03 | 2 | 21 | LBY371 | 0.83 | 2.66E−03 | 2 | 52 |
| LBY414 | 0.74 | 1.34E−02 | 3 | 13 | LBY414 | 0.84 | 2.11E−03 | 3 | 6 |
| LBY414 | 0.73 | 2.67E−02 | 3 | 22 | LBY414 | 0.72 | 1.98E−02 | 3 | 10 |
| LBY414 | 0.75 | 1.95E−02 | 2 | 44 | LBY414 | 0.72 | 1.95E−02 | 3 | 5 |
| LBY414 | 0.76 | 1.75E−02 | 2 | 47 | LBY414 | 0.84 | 4.26E−03 | 2 | 23 |
| LBY414 | 0.83 | 5.69E−03 | 2 | 21 | LBY414 | 0.86 | 3.07E−03 | 2 | 20 |
| LBY417 | 0.73 | 2.49E−02 | 3 | 45 | LBY417 | 0.81 | 7.67E−03 | 8 | 48 |
| LBY417 | 0.84 | 4.76E−03 | 8 | 50 | LBY417 | 0.75 | 5.25E−02 | 8 | 22 |
| LBY417 | 0.90 | 8.81E−04 | 8 | 49 | LBY417 | 0.84 | 4.59E−03 | 8 | 52 |
| LBY417 | 0.75 | 8.59E−02 | 8 | 25 | LBY417 | 0.76 | 1.02E−02 | 1 | 8 |
| LBY417 | 0.70 | 3.53E−02 | 1 | 44 | LBY417 | 0.77 | 1.50E−02 | 1 | 23 |
| LBY417 | 0.77 | 9.26E−03 | 1 | 48 | LBY417 | 0.72 | 1.84E−02 | 1 | 51 |
| LBY417 | 0.79 | 6.43E−03 | 1 | 50 | LBY417 | 0.79 | 7.01E−03 | 1 | 24 |
| LBY417 | 0.72 | 2.80E−02 | 1 | 20 | LBY417 | 0.75 | 1.34E−02 | 1 | 49 |
| LBY417 | 0.82 | 3.66E−03 | 1 | 52 | LBY417 | 0.74 | 2.14E−02 | 1 | 21 |
| LBY417 | 0.73 | 6.09E−02 | 1 | 25 | LBY417 | 0.80 | 5.71E−03 | 4 | 14 |
| LBY417 | 0.77 | 8.96E−03 | 4 | 48 | LBY417 | 0.83 | 3.15E−03 | 4 | 51 |
| LBY417 | 0.78 | 7.47E−03 | 4 | 50 | LBY417 | 0.75 | 1.21E−02 | 4 | 24 |
| LBY417 | 0.80 | 1.79E−02 | 4 | 20 | LBY417 | 0.71 | 2.02E−02 | 4 | 49 |
| LBY417 | 0.80 | 5.21E−03 | 4 | 52 | LBY417 | 0.89 | 1.45E−03 | 9 | 44 |
| LBY417 | 0.82 | 6.35E−03 | 9 | 23 | LBY417 | 0.74 | 1.51E−02 | 9 | 14 |
| LBY417 | 0.91 | 5.67E−04 | 9 | 47 | LBY417 | 0.78 | 8.46E−03 | 9 | 48 |
| LBY417 | 0.82 | 3.90E−03 | 9 | 51 | LBY417 | 0.72 | 2.01E−02 | 9 | 50 |
| LBY417 | 0.77 | 8.84E−03 | 9 | 24 | LBY417 | 0.87 | 2.38E−03 | 9 | 45 |
| LBY417 | 0.85 | 3.62E−03 | 9 | 20 | LBY417 | 0.71 | 2.19E−02 | 9 | 49 |
| LBY417 | 0.75 | 1.29E−02 | 9 | 52 | LBY417 | 0.82 | 6.46E−03 | 9 | 21 |
| LBY417 | 0.75 | 2.08E−02 | 2 | 23 | LBY417 | 0.76 | 1.02E−02 | 2 | 48 |
| LBY417 | 0.81 | 4.28E−03 | 2 | 50 | LBY417 | 0.79 | 6.07E−03 | 2 | 24 |
| LBY417 | 0.83 | 2.87E−03 | 2 | 49 | LBY417 | 0.89 | 5.81E−04 | 2 | 52 |
| LBY417 | 0.78 | 1.32E−02 | 2 | 21 | LBY417 | 0.72 | 6.70E−02 | 2 | 25 |
| LBY418 | 0.82 | 2.42E−02 | 3 | 25 | LBY418 | 0.75 | 5.00E−02 | 8 | 22 |
| LBY418 | 0.84 | 5.01E−03 | 1 | 46 | LBY418 | 0.84 | 2.38E−03 | 4 | 39 |
| LBY418 | 0.73 | 1.73E−02 | 4 | 27 | LBY418 | 0.75 | 1.27E−02 | 4 | 16 |
| LBY418 | 0.84 | 2.43E−03 | 4 | 38 | LBY418 | 0.71 | 2.05E−02 | 4 | 31 |
| LBY418 | 0.80 | 5.57E−03 | 4 | 17 | LBY418 | 0.92 | 1.30E−04 | 9 | 48 |
| LBY418 | 0.87 | 1.03E−03 | 9 | 51 | LBY418 | 0.87 | 9.83E−04 | 9 | 50 |
| LBY418 | 0.82 | 3.46E−03 | 9 | 24 | LBY418 | 0.79 | 6.70E−03 | 9 | 49 |

TABLE 212-continued

Correlation between the expression level of selected genes of some embodiments of the invention in various tissues and the phenotypic performance under low N conditions (set 1 parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY418 | 0.82 | 3.48E−03 | 9 | 52 | LBY419 | 0.73 | 2.62E−02 | 1 | 23 |
| LBY421 | 0.71 | 3.09E−02 | 8 | 52 | LBY421 | 0.73 | 9.64E−02 | 8 | 25 |
| LBY421 | 0.84 | 1.72E−02 | 1 | 25 | LBY421 | 0.70 | 2.30E−02 | 2 | 48 |
| LBY421 | 0.76 | 1.04E−02 | 2 | 50 | LBY421 | 0.71 | 2.14E−02 | 2 | 24 |
| LBY421 | 0.86 | 1.24E−03 | 2 | 49 | LBY421 | 0.85 | 1.85E−03 | 2 | 52 |
| MGP48 | 0.81 | 4.63E−03 | 3 | 12 | MGP48 | 0.80 | 5.13E−03 | 3 | 4 |
| MGP48 | 0.71 | 3.05E−02 | 9 | 23 | MGP48 | 0.72 | 2.97E−02 | 9 | 21 |
| MGP48 | 0.86 | 3.23E−03 | 2 | 44 | MGP48 | 0.86 | 3.00E−03 | 2 | 23 |
| MGP48 | 0.79 | 6.84E−03 | 2 | 48 | MGP48 | 0.77 | 8.62E−03 | 2 | 51 |
| MGP48 | 0.78 | 7.58E−03 | 2 | 50 | MGP48 | 0.89 | 4.85E−04 | 2 | 24 |
| MGP48 | 0.78 | 7.23E−03 | 2 | 49 | MGP48 | 0.79 | 6.69E−03 | 2 | 52 |
| MGP48 | 0.88 | 1.75E−03 | 2 | 21 | MGP48 | 0.99 | 4.44E−05 | 2 | 25 |
| MGP66 | 0.73 | 6.15E−02 | 8 | 45 | MGP66 | 0.70 | 3.49E−02 | 8 | 17 |
| MGP66 | 0.74 | 1.50E−02 | 9 | 43 | MGP66 | 0.72 | 1.78E−02 | 9 | 9 |
| MGP66 | 0.72 | 1.99E−02 | 9 | 42 | MGP67 | 0.80 | 5.98E−03 | 1 | 39 |
| MGP67 | 0.75 | 1.31E−02 | 1 | 27 | MGP67 | 0.80 | 5.63E−03 | 1 | 38 |
| MGP67 | 0.73 | 1.58E−02 | 1 | 31 | MGP67 | 0.80 | 5.16E−03 | 1 | 30 |
| MGP67 | 0.75 | 1.32E−02 | 9 | 43 | MGP67 | 0.78 | 8.35E−03 | 9 | 42 |

Table 212. Provided are the correlations (R) between the genes expression levels in various tissues and the phenotypic performance.
"Corr. ID"—correlation vector ID according to the correlated parameters specified in Table 200.
"Exp. Set"—Expression set specified in Table 199.
"R" = Pearson correlation coefficient;
"P" = p value

TABLE 213

Correlation between the expression level of selected genes of some embodiments of the invention in various tissues and the phenotypic performance under low N conditions (set 2 parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY243 | 0.74 | 3.57E−02 | 8 | 4 | LBY243 | 0.78 | 2.19E−02 | 8 | 7 |
| LBY243 | 0.74 | 2.29E−02 | 1 | 4 | LBY243 | 0.92 | 5.33E−04 | 1 | 13 |
| LBY243 | 0.73 | 2.50E−02 | 1 | 7 | LBY243 | 0.73 | 1.71E−02 | 4 | 13 |
| LBY266 | 0.74 | 2.22E−02 | 3 | 9 | LBY266 | 0.71 | 4.79E−02 | 8 | 12 |
| LBY266 | 0.72 | 2.87E−02 | 1 | 10 | LBY290 | 0.74 | 3.49E−02 | 8 | 12 |
| LBY290 | 0.80 | 9.16E−03 | 1 | 11 | LBY290 | 0.74 | 2.30E−02 | 2 | 10 |
| LBY292 | 0.79 | 1.94E−02 | 8 | 10 | LBY292 | 0.82 | 7.11E−03 | 9 | 2 |
| LBY292 | 0.78 | 8.06E−03 | 4 | 5 | LBY292 | 0.72 | 2.01E−02 | 4 | 3 |
| LBY293 | 0.74 | 2.23E−02 | 9 | 2 | LBY293 | 0.93 | 2.17E−04 | 1 | 2 |
| LBY293 | 0.74 | 2.22E−02 | 1 | 13 | LBY293 | 0.72 | 2.75E−02 | 1 | 9 |
| LBY293 | 0.87 | 2.53E−03 | 2 | 2 | LBY293 | 0.83 | 5.48E−03 | 2 | 13 |
| LBY294 | 0.71 | 4.72E−02 | 8 | 10 | LBY296 | 0.79 | 1.16E−02 | 9 | 12 |
| LBY296 | 0.71 | 3.15E−02 | 1 | 10 | LBY296 | 0.78 | 1.37E−02 | 2 | 10 |
| LBY297 | 0.75 | 1.95E−02 | 3 | 3 | LBY297 | 0.78 | 1.23E−02 | 2 | 13 |
| LBY298 | 0.82 | 1.26E−02 | 8 | 9 | LBY298 | 0.72 | 2.84E−02 | 9 | 2 |
| LBY298 | 0.71 | 2.12E−02 | 4 | 9 | LBY298 | 0.84 | 4.66E−03 | 2 | 4 |
| LBY298 | 0.72 | 1.89E−02 | 2 | 1 | LBY298 | 0.72 | 2.98E−02 | 2 | 13 |
| LBY298 | 0.85 | 4.07E−03 | 2 | 7 | LBY299 | 0.83 | 5.71E−03 | 9 | 2 |
| LBY299 | 0.81 | 8.25E−03 | 1 | 2 | LBY299 | 0.85 | 3.86E−03 | 1 | 13 |
| LBY299 | 0.85 | 3.56E−03 | 1 | 11 | LBY299 | 0.73 | 2.50E−02 | 1 | 9 |
| LBY299 | 0.71 | 2.15E−02 | 4 | 12 | LBY299 | 0.82 | 7.36E−03 | 2 | 4 |
| LBY299 | 0.84 | 4.79E−03 | 2 | 7 | LBY317 | 0.76 | 2.78E−02 | 8 | 4 |
| LBY317 | 0.73 | 3.93E−02 | 8 | 7 | LBY317 | 0.75 | 2.02E−02 | 1 | 4 |
| LBY317 | 0.97 | 1.74E−05 | 1 | 13 | LBY317 | 0.73 | 2.45E−02 | 1 | 7 |
| LBY317 | 0.76 | 1.74E−02 | 2 | 4 | LBY317 | 0.80 | 9.57E−03 | 2 | 7 |
| LBY318 | 0.74 | 2.30E−02 | 3 | 6 | LBY318 | 0.76 | 2.87E−02 | 8 | 13 |
| LBY318 | 0.90 | 8.55E−04 | 9 | 2 | LBY318 | 0.90 | 8.46E−04 | 9 | 9 |
| LBY318 | 0.75 | 1.94E−02 | 1 | 4 | LBY318 | 0.91 | 7.10E−04 | 1 | 13 |
| LBY318 | 0.72 | 2.89E−02 | 1 | 7 | LBY318 | 0.83 | 5.33E−03 | 2 | 4 |
| LBY318 | 0.71 | 2.06E−02 | 2 | 1 | LBY318 | 0.85 | 3.65E−03 | 2 | 7 |
| LBY319 | 0.82 | 6.57E−03 | 9 | 2 | LBY320 | 0.72 | 1.83E−02 | 4 | 2 |
| LBY321 | 0.75 | 1.30E−02 | 4 | 13 | LBY321 | 0.90 | 1.00E−03 | 2 | 2 |
| LBY321 | 0.75 | 2.01E−02 | 2 | 9 | LBY322 | 0.75 | 2.05E−02 | 9 | 2 |
| LBY322 | 0.71 | 3.33E−02 | 9 | 9 | LBY322 | 0.74 | 2.20E−02 | 1 | 8 |
| LBY368 | 0.77 | 2.44E−02 | 8 | 12 | LBY368 | 0.77 | 1.43E−02 | 1 | 4 |
| LBY368 | 0.74 | 2.28E−02 | 1 | 7 | LBY368 | 0.76 | 1.73E−02 | 2 | 4 |
| LBY368 | 0.80 | 1.01E−02 | 2 | 7 | LBY369 | 0.80 | 1.74E−02 | 8 | 10 |

TABLE 213-continued

Correlation between the expression level of selected genes of some embodiments of the invention in various tissues and the phenotypic performance under low N conditions (set 2 parameters) across Foxtail millet varieties

| Gene Name | R | P value | Exp. set | Corr. ID | Gene Name | R | P value | Exp. set | Corr. ID |
|---|---|---|---|---|---|---|---|---|---|
| LBY369 | 0.85 | 4.03E−03 | 9 | 10 | LBY369 | 0.71 | 3.24E−02 | 1 | 10 |
| LBY369 | 0.79 | 6.55E−03 | 4 | 12 | LBY369 | 0.82 | 7.13E−03 | 2 | 10 |
| LBY371 | 0.87 | 2.09E−03 | 2 | 2 | LBY414 | 0.73 | 2.66E−02 | 3 | 4 |
| LBY414 | 0.84 | 2.11E−03 | 3 | 1 | LBY414 | 0.72 | 2.96E−02 | 3 | 7 |
| LBY414 | 0.72 | 2.73E−02 | 1 | 4 | LBY417 | 0.80 | 1.64E−02 | 8 | 2 |
| LBY417 | 0.78 | 2.11E−02 | 8 | 9 | LBY417 | 0.87 | 2.29E−03 | 9 | 2 |
| LBY417 | 0.72 | 2.99E−02 | 9 | 13 | LBY417 | 0.87 | 2.46E−03 | 1 | 2 |
| LBY417 | 0.71 | 3.08E−02 | 1 | 9 | LBY417 | 0.92 | 1.68E−04 | 4 | 2 |
| LBY417 | 0.76 | 1.03E−02 | 4 | 9 | LBY417 | 0.89 | 1.13E−03 | 2 | 2 |
| LBY418 | 0.74 | 2.39E−02 | 3 | 12 | LBY418 | 0.85 | 3.70E−03 | 9 | 2 |
| LBY418 | 0.86 | 2.98E−03 | 9 | 9 | LBY419 | 0.70 | 5.27E−02 | 8 | 12 |
| LBY419 | 0.71 | 5.08E−02 | 8 | 7 | LBY421 | 0.80 | 9.03E−03 | 3 | 3 |
| LBY421 | 0.74 | 2.40E−02 | 9 | 8 | LBY421 | 0.74 | 2.13E−02 | 2 | 2 |
| LBY421 | 0.76 | 1.73E−02 | 2 | 13 | MGP67 | 0.73 | 2.62E−02 | 2 | 2 |
| MGP48 | 0.79 | 1.07E−02 | 9 | 2 | MGP48 | 0.71 | 3.37E−02 | 1 | 8 |
| MGP48 | 0.70 | 3.51E−02 | 2 | 2 | MGP48 | 0.93 | 2.33E−04 | 2 | 13 |
| MGP66 | 0.70 | 5.17E−02 | 8 | 2 | MGP66 | 0.77 | 1.62E−02 | 2 | 13 |
| MGP67 | 0.74 | 2.40E−02 | 1 | 10 | | | | | |

Table 213. Provided are the correlations (R) between the genes expression levels in various tissues and the phenotypic performance.
"Corr. ID"—correlation vector ID according to the correlated parameters specified in Table 201.
"Exp. Set"—Expression set specified in Table 199.
"R" = Pearson correlation coefficient;
"P" = p value.

Example 18

Production of Foxtail Millet Transcriptome and High Throughput Correlation Analysis with Yield Related Parameters Measured in Fields Using 65K Foxtail Millet Oligonucleotide Micro-Arrays In order to produce a high throughput correlation analysis between plant phenotype and gene expression level, the present inventors utilized a Foxtail millet oligonucleotide micro-array, produced by Agilent Technologies [chem. (dot) agilent (dot) com/Scripts/PDS (dot) asp?lPage=50879]. The array oligonucleotide represents about 65,000 Foxtail millet genes and transcripts. In order to define correlations between the levels of RNA expression with yield components or vigor related parameters, various plant characteristics of 51 different Foxtail millet inbreds were analyzed. Among them, 49 inbreds encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

51 Foxtail millet varieties were grown in 4 repetitive plots, in field. Briefly, the growing protocol was as follows:

Regular growth conditions: foxtail millet plants were grown in the field using commercial fertilization and irrigation protocols, which include 202 m³ water per dunam (1000 square meters) per entire growth period and fertilization of 12 units of URAN® 32% (Nitrogen Fertilizer Solution; PCS Sales, Northbrook, Ill., USA) (normal growth conditions).

Analyzed Foxtail millet tissues—49 selected Foxtail millet inbreds were sampled. Tissues [leaf, panicle and peduncle] representing different plant characteristics, from plants growing under normal conditions were sampled and RNA was extracted as described above. Each micro-array expression information tissue type has received a Set ID as summarized in Table 214 below.

TABLE 214

Foxtail millet transcriptome expression sets in field experiment

| Expression Set | Set ID |
|---|---|
| Panicle grown under normal conditions, flowering stage | 1 |
| Leaf grown under normal conditions, seedling stage | 2 |
| Peduncle grown under normal conditions, flowering stage | 3 |

Table 214: Provided are the foxtail transcriptome expression sets.
Peduncle = stem below the panicle.

Foxtail millet yield components and vigor related parameters assessment—Plants were phenotyped as shown in Table 215 below. Some of the following parameters were collected using a digital imaging system:

1000 grain (seed) weight (gr.)—was calculated using Formula 14 above.

1000 grain weight filling rate (gr./day)—was calculated based on Formula 36 above.

Average heads dry weight per plant at heading (gr.)—At the process of the growing period heads of 3 plants per plot were collected (heading stage). Heads were weighted after oven dry (dry weight), and the weight was divided by the number of plants.

Average internode length (cm)—Plant heights of 4 plants per plot were measured at harvest and divided by plant number. The average plant height was divided by the average number of nodes.

Average main tiller leaves dry weight per plant at heading (gr.)—At heading stage, main tiller leaves were collected from 3 plants per plot and dried in an oven to obtain the leaves dry weight. The obtained leaves dry weight was divided by the number of plants.

Average seedling dry weight (gr.)—At seedling stage, shoot material of 4 plants per plot (without roots) was collected and dried in an oven to obtain the dry weight. The obtained values were divided by the number of plants.

Average shoot dry weight (gr.)—During the vegetative growing period, shoot material of 3 plants per plot (without roots) was collected and dried in an oven to obtain the dry weight. The obtained values were divided by the number of plants.

Average total dry matter per plant at harvest (kg)—Average total dry matter per plant was calculated as follows: average head weight per plant at harvest+average vegetative dry weight per plant at harvest.

Average total dry matter per plant at heading (gr.)—Average total dry matter per plant was calculated as follows: average head weight per plant at heading+average vegetative dry weight per plant at heading.

Average vegetative dry weight per plant at harvest (kg)—At the end of the growing period all vegetative material (excluding roots and heads) were collected and weighted after oven dry (dry weight). The biomass was then divided by the total number of square meters. To obtain the biomass per plant the biomass per square meter was divided by the number of plants per square meter.

Average vegetative dry weight per plant at heading (gr.)—At the heading stage, all vegetative material (excluding roots) were collected and weighted after (dry weight) oven dry. The biomass per plant was calculated by dividing total biomass by the number of plants.

Calculated grains per dunam (number)—Calculated by dividing grains yield per dunam by average grain weight.

Dry matter partitioning (ratio)—Dry matter partitioning was calculated based on Formula 35.

Grain area ($cm^2$)—At the end of the growing period the grains were separated from the head. A sample of ~200 grains were weighted, photographed and images were processed using the below described image processing system. The grain area was measured from those images and was divided by the number of grains.

Grain fill duration (num)—Duration of grain filling period was calculated by subtracting the number of days to flowering from the number of days to maturity.

Grain length (cm)—At the end of the growing period the grains were separated from the ear. A sample of ~200 grains were weighted, photographed and images were processed using the below described image processing system. The sum of grain lengths (longest axis) was measured from those images and was divided by the number of grains.

Grain width (cm)—At the end of the growing period the grains were separated from the ear. A sample of ~200 grains were weighted, photographed and images were processed using the below described image processing system. The sum of grain width (longest axis) was measured from those images and was divided by the number of grains.

Grains yield per dunam (kg)—At the end of the growing period heads were collected (harvest stage). Heads were separately threshed and grains were weighted (grain yield). Grains yield per dunam was calculated by multiplying grain yield per $m^2$ by 1000 (dunam is 1000 $m^2$).

Grains yield per head (gr.)—At the end of the experiment all heads were collected. 6 main heads from 6 plants per plot were separately threshed and grains were weighted. The average grain weight per head was calculated by dividing the total grain weight of the 6 heads by the number of heads.

Grains yield per plant (gr.)—At the end of the experiment all plants were collected. All heads from 6 plants per plot were separately threshed and grains were weighted. The average grain weight per plant was calculated by dividing the total grain weight of the 6 plants by the number of plants.

Harvest index (number)—was calculated based on Formula 15 above.

Head area ($cm^2$)—At the end of the growing period 6 main heads from 6 plants per plot were photographed and images were processed using the below described image processing system. The head area was measured from those images and was divided by the number of heads.

Head length (cm)—At the end of the growing period 6 heads from 6 plants per plot were photographed and images were processed using the below described image processing system. The head length (longest axis) was measured from those images and was divided by the number of heads.

Head width (cm)—At the end of the growing period 6 main heads of 6 plants per plot were photographed and images were processed using the below described image processing system. The head width (longest axis) was measured from those images and was divided by the number of heads.

Heads per plant (number)—At the end of the growing period total number of 6 plants heads per plot was counted and divided by the number of plants.

Leaves area per plant at heading ($cm^2$)—Total green leaves area per plant at heading. Leaf area of 3 plants was measured separately using a leaf area-meter. The obtained leaf area was divided by 3 to obtain leaf area per plant.

Leaves dry weight at heading (gr.)—Leaves dry weight was measured at heading stage by collecting all leaves material of 3 plants per plot and weighting it after oven dry (dry weight).

Leaves num at heading (number)—Plants were characterized for leaf number during the heading stage. Plants were measured for their leaf number by separately counting all green leaves of 3 plants per plot.

Leaves temperature 1 (° Celsius)—Leaf temperature was measured using Fluke IR thermometer 568 device. Measurements were done on opened flag leaf.

Lower stem width at heading (mm)—At heading stage lower stem internodes from 3 plants were separated from the plant and their diameter was measured using a caliber.

Main heads dry weight at harvest (gr.)—At the end of the growing period (harvest stage) main heads of 6 plants per plot were collected and weighted after oven dry (dry weight).

Main heads grains number (number)—At the end of the growing period (harvest stage) all plants were collected. Main heads from 6 plants per plot were threshed and grains were counted.

Main heads grains yield (gr.)—At the end of the growing period (harvest stage) all plants were collected. Main heads from 6 plants per plot were threshed and grains were weighted.

Main stem dry weight at harvest (gr.)—At the end of the experiment all plants were collected. Main stems from 6 plants per plot were separated from the rest of the plants, oven dried and weighted to obtain their dry weight.

Nodes number (number)—Nodes number was counted in main culm (stem) in 6 plants at heading stage.

Number days to flag leaf senescence (number)—the number of days from sowing till 50% of the plot arrives to flag leaf senescence (above half of the leaves are yellow).

Number days to heading (number)—the number of days from sowing till 50% of the plot arrives to heading.

Number days to tan (number)—the number of days from sowing till 50% of the plot arrives to tan.

Peduncle thickness per plant at heading (mm)—Peduncle thickness was obtained at heading stage by measuring the diameter of main culm just above auricles of flag leaf.

Plant height (cm)—Plants were measured for their height at harvest stage using a measuring tape. Height was measured from ground level to the point below the head.

Plant weight growth (gr./day)—Plant weight growth was calculated based on Formula 7 above.

SPAD at grain filling (SPAD unit)—Chlorophyll content was determined using a Minolta SPAD 502 chlorophyll meter and measurement was performed at grain filling stage. SPAD meter readings were done on fully developed leaves of 4 plants per plot by performing three measurements per leaf per plant.

SPAD at vegetative stage (SPAD unit)—Chlorophyll content was determined using a Minolta SPAD 502 chlorophyll meter and measurement was performed at vegetative stage. SPAD meter readings were done on fully developed leaves of 4 plants per plot by performing three measurements per leaf per plant.

Specific leaf area at heading (cm$^2$/gr.)—was calculated according to Formula 37 above.

Tillering per plant at heading (number)—Tillers of 3 plants per plot were counted at heading stage and divided by the number of plants.

Vegetative dry weight at flowering/water until flowering (gr./lit)—was calculated according to Formula 38 above.

Vegetative dry weight (kg)—At the end of the growing period all vegetative material (excluding roots and heads) were collected and weighted after oven dry. The weight of plants is per one meter.

Yield filling rate (gr./day)—was calculated according to Formula 39 above.

Yield per dunam/water until tan (kg/ml)—was calculated according to Formula 40 above.

Yield per plant/water until tan (gr./ml)—was calculated according to Formula 41 above.

Data parameters collected are summarized in Table 215, herein below.

TABLE 215

| Foxtail millet correlated parameters under normal conditions (vectors) | |
|---|---|
| Correlated parameter with | Correlation ID |
| Yield filling rate [gr./day] | 1 |
| 1000 grain weight [gr.] | 2 |
| 1000 grain weight filling rate [gr./day] | 3 |
| CV (Grain area) [%] | 4 |
| Grain area [cm$^2$] | 5 |
| CV (Grain length) [%] | 6 |
| Grain length [cm] | 7 |
| Plant height [cm] | 8 |
| Average internode length [cm] | 9 |
| Main Stem DW (H) [gr.] | 10 |
| Average main Stem DW (H) [gr.] | 11 |
| Nodes num [number] | 12 |
| Average Total dry matter per plant (H) [kg] | 13 |
| Average Total dry matter per plant (HD) [gr.] | 14 |
| Grains Yield per dunam [kg] | 15 |
| Main heads Grains yield [gr.] | 16 |
| Grains Yield per plant [gr.] | 17 |
| Grains yield per Head [gr.] | 18 |
| Main Heads DW (H) [gr.] | 19 |

TABLE 215-continued

| Foxtail millet correlated parameters under normal conditions (vectors) | |
|---|---|
| Correlated parameter with | Correlation ID |
| Average Heads DW per plant (HD) [gr.] | 20 |
| Yield per dunam/water until tan [kg/ml] | 21 |
| Yield per plant/water until tan [gr./ml] | 22 |
| VDW (F)/water until heading [gr./lit] | 23 |
| Calculated Grains per dunam [number] | 24 |
| Main heads Grains num [number] | 25 |
| Num days Flag leaf senescence [number] | 26 |
| Grain fill duration [days] | 27 |
| Num days to Tan [number] | 28 |
| CV (Grain width) [%] | 29 |
| Grain width [cm] | 30 |
| Leaves temperature [Celsius] | 31 |
| Specific leaf area (HD) [cm$^2$/gr.] | 32 |
| Lower Stem width (HD) [mm] | 33 |
| Peduncle thickness per plant (HD) [mm] | 34 |
| Tillering per plant (HD) [num] | 35 |
| Heads per plant [number] | 36 |
| Head Area [cm$^2$] | 37 |
| Field Head Width [cm] | 38 |
| Head Width [cm] | 39 |
| Harvest index [number] | 40 |
| Dry matter partitioning [ratio] | 41 |
| Average main tiller Leaves DW per plant (HD) [gr.] | 42 |
| Leaves DW (HD) [gr.] | 43 |
| Leaves num (HD) [number] | 44 |
| Leaves area per plant (HD) [cm$^2$] | 45 |
| Average Seedling DW [gr.] | 46 |
| Average Shoot DW_[gr.] | 47 |
| Average Vegetative DW per plant (HD) [gr.] | 48 |
| Average Vegetative DW per plant (H) [kg] | 49 |
| Vegetative DW [kg] | 50 |
| Plant weight growth [gr./day] | 51 |
| Num days to Heading [number] | 52 |
| SPAD_(veg) [SPAD unit] | 53 |
| SPAD (GF) [SPAD unit] | 54 |

Table 215. Provided are the Foxtail millet correlated parameters (vectors).
"gr." = grams;
"kg" = kilograms;
"SPAD" = chlorophyll levels;
"DW" = Plant Dry weight;
"GF" = grain filling growth stage;
"F" = flowering stage;
"H" = harvest stage;
"hd" = heading growth stage;
"Avr"—average;
"num"—number;
"cm"—centimeter;
"veg" = vegetative stage.
VDW" = vegetative dry weight;
"TDM" = Total dry matter;
"lit"—liter;
"CV" = coefficient of variation (%).

Experimental Results 51 different Foxtail millet inbreds were grown and characterized for different parameters (Table 215). 49 lines were selected for expression analysis. The average for each of the measured parameter was calculated using the JMP software (Tables 216-220) and a subsequent correlation analysis was performed (Table 221). Results were then integrated to the database.

TABLE 216

| Measured parameters in Foxtail millet accessions under normal conditions | | | | | | | | | |
|---|---|---|---|---|---|---|---|---|---|
| Corr. ID/L | 1 | 2 | 3 | 4 | 5 | 6 | 7 | 8 | 9 |
| Line-1 | 21.40 | 3.21 | 0.13 | 6.10 | 0.038 | 5.50 | 0.25 | 129.00 | 12.70 |
| Line-2 | 12.40 | 2.15 | 0.06 | 7.38 | 0.022 | 5.31 | 0.21 | 109.30 | 10.10 |

TABLE 216-continued

Measured parameters in Foxtail millet accessions under normal conditions

| Corr. ID/L | 1 | 2 | 3 | 4 | 5 | 6 | 7 | 8 | 9 |
|---|---|---|---|---|---|---|---|---|---|
| Line-3 | 20.00 | 2.68 | 0.10 | 7.29 | 0.025 | 6.03 | 0.23 | 125.60 | 14.30 |
| Line-4 | 13.70 | 3.93 | 0.11 | 11.82 | 0.031 | 7.69 | 0.24 | 147.60 | 12.00 |
| Line-5 | 9.30 | 3.58 | 0.11 | 12.92 | 0.030 | 8.47 | 0.24 | 126.20 | 11.00 |
| Line-6 | 14.60 | 3.09 | 0.09 | 8.16 | 0.028 | 5.20 | 0.23 | 127.20 | 12.10 |
| Line-7 | 8.00 | 3.10 | 0.07 | 10.46 | 0.027 | 7.25 | 0.24 | 86.50 | 12.50 |
| Line-8 | 10.70 | 3.30 | 0.09 | 7.15 | 0.027 | 4.67 | 0.25 | 138.60 | 12.80 |
| Line-9 | 14.40 | 2.74 | 0.10 | 7.35 | 0.027 | 5.69 | 0.25 | 112.90 | 11.80 |
| Line-10 | 15.70 | 2.78 | 0.10 | 6.25 | 0.027 | 4.72 | 0.25 | 116.80 | 12.80 |
| Line-11 | 9.20 | 3.12 | 0.07 | 11.09 | 0.026 | 6.95 | 0.23 | 88.70 | 14.40 |
| Line-12 | 6.80 | 3.44 | 0.07 | 8.55 | 0.030 | 7.23 | 0.27 | 78.70 | 16.00 |
| Line-13 | 5.70 | 2.91 | 0.05 | 8.53 | 0.027 | 7.11 | 0.24 | 81.90 | 14.50 |
| Line-14 | 10.70 | 3.10 | 0.11 | 6.74 | 0.026 | 4.61 | 0.24 | 134.50 | 10.80 |
| Line-15 | 10.60 | 3.53 | 0.09 | 7.87 | 0.032 | 6.02 | 0.27 | 91.30 | 11.40 |
| Line-16 | 8.50 | 3.58 | 0.07 | 10.38 | 0.029 | 8.30 | 0.25 | 82.80 | 12.10 |
| Line-17 | 16.50 | 2.84 | 0.09 | 11.66 | 0.027 | 8.38 | 0.24 | 82.80 | 11.90 |
| Line-18 | 7.40 | 3.14 | 0.06 | 10.74 | 0.027 | 6.47 | 0.25 | 91.00 | 17.90 |
| Line-19 | 11.40 | 3.26 | 0.13 | 12.83 | 0.026 | 7.12 | 0.22 | 129.40 | 12.50 |
| Line-20 | 17.60 | 2.75 | 0.10 | 6.63 | 0.026 | 4.51 | 0.23 | 159.50 | 18.30 |
| Line-21 | 11.90 | 2.75 | 0.09 | 9.46 | 0.027 | 7.23 | 0.26 | 105.80 | 16.10 |
| Line-22 | 16.80 | 2.91 | 0.11 | 8.85 | 0.031 | 6.04 | 0.24 | 107.10 | 14.40 |
| Line-23 | 4.50 | 2.36 | 0.08 | 10.12 | 0.019 | 6.61 | 0.18 | 97.80 | 12.40 |
| Line-24 | 15.50 | 2.72 | 0.10 | 10.36 | 0.031 | 8.79 | 0.25 | 102.50 | 16.20 |
| Line-25 | 12.70 | 4.37 | 0.17 | 11.38 | 0.031 | 10.25 | 0.26 | 104.20 | 13.10 |
| Line-26 | 15.20 | 3.46 | 0.12 | 11.09 | 0.028 | 7.90 | 0.22 | 123.20 | 11.40 |
| Line-27 | 14.50 | 2.19 | 0.08 | 8.30 | 0.021 | 5.86 | 0.20 | 164.20 | 10.10 |
| Line-28 | 22.50 | 3.08 | 0.13 | 9.48 | 0.031 | 7.13 | 0.23 | 120.90 | 10.00 |
| Line-29 | 18.50 | 2.25 | 0.09 | 9.79 | 0.026 | 8.69 | 0.22 | 152.40 | 11.90 |
| Line-30 | 12.10 | 2.21 | 0.11 | 10.77 | 0.022 | 10.66 | 0.22 | 153.10 | 13.80 |
| Line-31 | 9.20 | 4.03 | 0.13 | 10.86 | 0.032 | 6.95 | 0.24 | 118.40 | 11.50 |
| Line-32 | 7.10 | 3.14 | 0.08 | 9.70 | 0.027 | 6.65 | 0.24 | 72.50 | 10.20 |
| Line-33 | 14.10 | 3.01 | 0.12 | 6.85 | 0.025 | 4.15 | 0.22 | 144.90 | 12.30 |
| Line-34 | 15.20 | 3.63 | 0.14 | 6.50 | 0.029 | 4.08 | 0.25 | 157.90 | 13.20 |
| Line-35 | 8.90 | NA | NA | 11.01 | 0.027 | 7.23 | 0.25 | 160.00 | 13.40 |
| Line-36 | 16.90 | 3.40 | 0.14 | 5.63 | 0.028 | 3.87 | 0.25 | 138.80 | 12.10 |
| Line-37 | 10.60 | 2.58 | 0.10 | 8.13 | 0.025 | 5.96 | 0.23 | 137.30 | 11.30 |
| Line-38 | 6.90 | 2.76 | 0.09 | 6.64 | 0.025 | 4.36 | 0.23 | 136.30 | 13.00 |
| Line-39 | 14.70 | 3.66 | 0.11 | 6.84 | 0.031 | 4.24 | 0.26 | 148.50 | 14.40 |
| Line-40 | 9.50 | 2.87 | 0.10 | 7.24 | 0.025 | 4.47 | 0.24 | 148.00 | 13.90 |
| Line-41 | 9.70 | 3.20 | 0.12 | 6.35 | 0.027 | 4.34 | 0.24 | 157.50 | 16.50 |
| Line-42 | 13.50 | 2.77 | 0.09 | 8.68 | 0.027 | 6.59 | 0.23 | 154.20 | 12.50 |
| Line-43 | 8.30 | 3.64 | 0.07 | 10.38 | 0.030 | 8.01 | 0.25 | 91.00 | 14.00 |
| Line-44 | 8.00 | 3.18 | 0.06 | 9.82 | 0.032 | 7.67 | 0.26 | 88.80 | 13.30 |
| Line-45 | 11.40 | 2.81 | 0.10 | 10.05 | 0.022 | 6.38 | 0.20 | 110.60 | 12.20 |
| Line-46 | 12.80 | 2.73 | 0.10 | 6.99 | 0.036 | 6.28 | 0.26 | 106.10 | 13.70 |
| Line-47 | 9.90 | 3.07 | 0.09 | 11.09 | 0.030 | 8.33 | 0.25 | 90.90 | 12.60 |
| Line-48 | 8.30 | 2.94 | 0.11 | 7.31 | 0.024 | 5.59 | 0.22 | 157.10 | 16.00 |
| Line-49 | 10.60 | 3.18 | 0.09 | 11.21 | 0.027 | 8.51 | 0.24 | 85.80 | 13.90 |

Table 216: Provided are the values of each of the parameters (as described above) measured in Foxtail millet accessions ("L" = Line) under normal conditions. Growth conditions are specified in the experimental procedure section.

TABLE 217

Additional measured parameters in Foxtail millet accessions under normal growth conditions

| Corr. ID/L | 10 | 11 | 12 | 13 | 14 | 15 | 16 | 17 | 18 | 19 | 20 |
|---|---|---|---|---|---|---|---|---|---|---|---|
| Line-1 | 10.30 | 61.90 | 10.21 | 0.13 | 51.800 | 523.40 | 69.90 | 52.30 | 6.42 | 89.80 | 10.15 |
| Line-2 | 6.50 | 38.80 | 11.28 | 0.09 | 99.800 | 436.90 | 50.20 | 35.10 | 3.47 | 60.30 | 33.47 |
| Line-3 | 12.30 | 73.60 | 8.92 | 0.15 | 56.300 | 560.80 | 83.30 | 61.50 | 7.08 | 97.20 | 7.59 |
| Line-4 | 22.10 | 132.40 | 12.38 | 0.14 | 49.600 | 491.70 | 108.40 | 51.90 | 10.84 | 142.30 | 5.85 |
| Line-5 | 26.40 | 158.70 | 11.50 | 0.07 | 37.000 | 296.60 | 111.90 | 24.00 | 15.03 | 132.10 | 4.28 |
| Line-6 | 11.00 | 66.30 | 10.67 | 0.13 | 57.000 | 478.10 | 80.70 | 59.30 | 8.79 | 100.30 | 10.19 |
| Line-7 | 2.00 | 11.80 | 7.00 | 0.12 | 69.400 | 357.60 | 10.40 | 31.10 | 0.71 | 15.70 | 7.78 |
| Line-8 | 7.10 | 42.30 | 10.88 | 0.09 | 55.000 | 373.50 | 23.40 | 24.80 | 2.32 | 28.80 | 2.45 |
| Line-9 | 4.50 | 27.20 | 9.62 | 0.09 | 41.800 | 403.20 | 25.10 | 35.20 | 1.80 | 29.70 | 6.03 |
| Line-10 | 5.50 | 32.70 | 9.17 | 0.08 | 50.300 | 440.70 | 28.70 | 31.80 | 2.09 | 33.60 | 6.75 |
| Line-11 | 3.30 | 19.50 | 6.25 | 0.11 | 48.000 | 423.00 | 21.30 | 50.60 | 1.55 | 29.70 | 8.87 |
| Line-12 | 2.70 | 16.20 | 5.00 | 0.16 | 52.500 | 318.80 | 9.60 | 57.40 | 0.56 | 12.50 | 6.31 |
| Line-13 | 2.80 | 17.00 | 5.75 | 0.08 | 22.500 | 330.00 | 13.60 | 29.00 | 1.26 | 16.50 | 2.82 |
| Line-14 | 7.40 | 44.60 | 12.38 | 0.09 | 94.900 | 306.90 | 20.40 | 21.20 | 2.03 | 27.00 | 8.45 |
| Line-15 | 2.60 | 15.80 | 8.08 | 0.08 | 35.300 | 412.80 | 16.90 | 29.40 | 0.91 | 21.50 | 3.94 |
| Line-16 | 2.60 | 14.80 | 6.91 | 0.09 | 26.600 | 444.20 | 14.30 | 35.40 | 0.87 | 17.90 | 3.20 |

TABLE 217-continued

Additional measured parameters in Foxtail millet accessions under normal growth conditions

| Corr. ID/L | 10 | 11 | 12 | 13 | 14 | 15 | 16 | 17 | 18 | 19 | 20 |
|---|---|---|---|---|---|---|---|---|---|---|---|
| Line-17 | 2.50 | 14.20 | 7.48 | 0.07 | 39.600 | 510.20 | 20.90 | 37.20 | 1.33 | 29.30 | 7.73 |
| Line-18 | 2.10 | 12.80 | 5.21 | 0.12 | 25.100 | 389.70 | 14.10 | 41.50 | 0.71 | 17.70 | 2.68 |
| Line-19 | 29.30 | 176.10 | 10.54 | 0.10 | 33.100 | 286.20 | 126.30 | 35.10 | 13.32 | 164.40 | 6.55 |
| Line-20 | 9.50 | 56.80 | 8.83 | 0.12 | 34.100 | 494.00 | 30.40 | 42.10 | 2.72 | 36.90 | 4.97 |
| Line-21 | 2.90 | 17.30 | 6.67 | 0.10 | 29.300 | 369.80 | 12.30 | 36.30 | 0.59 | 15.50 | 6.10 |
| Line-22 | 5.90 | 35.20 | 7.54 | 0.09 | 31.300 | 449.30 | 35.60 | 37.20 | 1.28 | 44.00 | 4.84 |
| Line-23 | 8.50 | 51.10 | 8.08 | 0.05 | 9.600 | 181.90 | 61.50 | 17.90 | 1.24 | 74.30 | 1.66 |
| Line-24 | 3.50 | 21.20 | 6.50 | 0.08 | 25.800 | 433.90 | 26.90 | 34.00 | 0.93 | 32.30 | 4.71 |
| Line-25 | 13.30 | 79.50 | 8.08 | 0.08 | 30.000 | 324.90 | 97.00 | 37.00 | 11.49 | 118.60 | 7.42 |
| Line-26 | 23.10 | 138.50 | 10.92 | 0.08 | 37.600 | 421.40 | 153.40 | 38.60 | 17.58 | 184.00 | 9.50 |
| Line-27 | 53.20 | 319.10 | 16.25 | 0.11 | 50.400 | 381.30 | 148.70 | 30.70 | 13.92 | 205.30 | 3.48 |
| Line-28 | 36.00 | 215.80 | 12.12 | 0.10 | 53.200 | 516.90 | 240.70 | 40.20 | 21.57 | 297.60 | 6.49 |
| Line-29 | 24.30 | 145.90 | 12.83 | 0.11 | 63.300 | 458.40 | 89.60 | 40.50 | 9.84 | 111.20 | 7.00 |
| Line-30 | 27.70 | 166.20 | 11.17 | 0.07 | 31.900 | 229.60 | 65.00 | 16.30 | 7.56 | 84.20 | 4.70 |
| Line-31 | 19.90 | 119.60 | 10.46 | 0.05 | 15.300 | 286.40 | 172.60 | 26.50 | 19.15 | 212.70 | 2.82 |
| Line-32 | 2.80 | 17.00 | 7.21 | 0.09 | 59.800 | 277.10 | 6.00 | 24.80 | 0.27 | 7.30 | 6.29 |
| Line-33 | 9.20 | 55.00 | 11.83 | 0.09 | 72.300 | 351.20 | 22.50 | 24.20 | 2.84 | 27.70 | 5.78 |
| Line-34 | 18.30 | 109.80 | 12.00 | 0.12 | 50.800 | 399.40 | 54.50 | 35.30 | 6.14 | 67.40 | 6.71 |
| Line-35 | 12.90 | 77.20 | 12.00 | 0.10 | 58.200 | 217.40 | 28.60 | 19.10 | 3.02 | 37.40 | 4.13 |
| Line-36 | 7.60 | 45.70 | 11.50 | 0.09 | 83.300 | 408.00 | 24.00 | 28.70 | 2.28 | 30.80 | 6.72 |
| Line-37 | 11.80 | 70.60 | 12.25 | 0.07 | 70.300 | 275.80 | 29.40 | 17.50 | 2.13 | 36.00 | 4.71 |
| Line-38 | 9.70 | 58.40 | 10.88 | 0.08 | 101.70 | 219.80 | 22.90 | 15.80 | 1.54 | 30.60 | 6.51 |
| Line-39 | 11.10 | 66.50 | 10.33 | 0.10 | 73.600 | 442.40 | 49.80 | 37.00 | 5.07 | 59.60 | 8.97 |
| Line-40 | 7.40 | 44.20 | 10.67 | 0.07 | 66.600 | 279.10 | 19.80 | 16.20 | 2.14 | 25.70 | 7.04 |
| Line-41 | 8.50 | 50.80 | 9.62 | 0.07 | 104.10 | 254.60 | 22.10 | 18.10 | 1.93 | 28.20 | 10.42 |
| Line-42 | 13.70 | 82.50 | 12.33 | 0.12 | 90.600 | 432.90 | 50.00 | 37.00 | 2.23 | 67.50 | 6.42 |
| Line-43 | 1.40 | 8.20 | 6.67 | 0.18 | 50.200 | 408.00 | 5.60 | 59.00 | 0.36 | 7.40 | 3.96 |
| Line-44 | 2.50 | 14.70 | 6.88 | 0.08 | 74.400 | 407.30 | 13.60 | 27.90 | 0.71 | 17.70 | 4.47 |
| Line-45 | 14.20 | 85.40 | 9.25 | 0.08 | 22.500 | 308.30 | 81.20 | 35.40 | 8.50 | 99.50 | 1.67 |
| Line-46 | 4.60 | 27.70 | 7.79 | 0.07 | 20.30 | 359.70 | 24.40 | 25.50 | 0.72 | 29.70 | 3.37 |
| Line-47 | 2.40 | 14.40 | 7.38 | 0.09 | 16.10 | 345.20 | 8.80 | 30.80 | 0.48 | 11.60 | 1.19 |
| Line-48 | 21.50 | 129.20 | 9.88 | 0.06 | 33.80 | 223.70 | 82.60 | 20.00 | 4.67 | 96.30 | 7.15 |
| Line-49 | 1.90 | 11.60 | 6.29 | 0.10 | 34.30 | 386.30 | 14.60 | 35.50 | 0.67 | 17.90 | 1.59 |

Table 217: Provided are the values of each of the parameters (as described above) measured in Foxtail millet accessions ("L" = Line) under normal conditions. Growth conditions are specified in the experimental procedure section.

TABLE 218

Additional measured parameters in Foxtail millet accessions under normal growth conditions

| Corr. ID/L | 21 | 22 | 23 | 24 | 25 | 26 | 27 | 28 | 29 | 30 | 31 |
|---|---|---|---|---|---|---|---|---|---|---|---|
| Line-1 | 2.41 | 0.241 | 0.491 | 1676.9 | 21808 | 87 | 24 | 61 | 4 | 0.194 | 35.3 |
| Line-2 | 1.84 | 0.148 | 0.567 | 944 | 23393 | 87.8 | 35.2 | 79 | 5.24 | 0.149 | 34.2 |
| Line-3 | 2.37 | 0.259 | 0.487 | 1495.9 | 31814.8 | 83.7 | 28 | 68 | 5.84 | 0.158 | 34.8 |
| Line-4 | 2.07 | 0.219 | 0.319 | 1952.9 | 27992.5 | 86.7 | 36 | 83 | 7.17 | 0.184 | 34.1 |
| Line-5 | 1.25 | 0.101 | 0.239 | 1051.3 | 31003.2 | 81.3 | 32 | 79 | 8.13 | 0.18 | 34 |
| Line-6 | 2.02 | 0.25 | 0.357 | 1471.2 | 25378.8 | 89.3 | 32.8 | 79 | 6.36 | 0.172 | 35.9 |
| Line-7 | 1.51 | 0.131 | 0.588 | 1132.8 | 3050.5 | 87 | 45 | 86 | 7.68 | 0.162 | 33.9 |
| Line-8 | 1.58 | 0.105 | 0.335 | 1232.5 | 7161 | 83.5 | 35.5 | 86 | 5.25 | 0.161 | 33.5 |
| Line-9 | 1.7 | 0.149 | 0.357 | 1097 | 9195 | 76 | 28 | 68 | 5.33 | 0.154 | 33.6 |
| Line-10 | 1.86 | 0.134 | 0.436 | 1224.3 | 10390 | 70 | 28 | 68 | 5.46 | 0.155 | 34.3 |
| Line-11 | 1.79 | 0.213 | 0.543 | 1342 | 6830.2 | 85 | 46 | 79 | 6.69 | 0.164 | 33.3 |
| Line-12 | 1.35 | 0.242 | 0.51 | 1095.1 | 2858.3 | 94.3 | 47 | 86 | 6.78 | 0.165 | 34.9 |
| Line-13 | 1.39 | 0.122 | 0.273 | 963.1 | 4766.5 | 91 | 58 | 91 | 5.82 | 0.16 | 33.2 |
| Line-14 | 1.3 | 0.089 | 0.476 | 954.9 | 6622.2 | 79 | 29 | 83 | 5.1 | 0.16 | 33.4 |
| Line-15 | 1.74 | 0.124 | 0.313 | 1459.9 | 4828.5 | 79.2 | 39 | 79 | 5.22 | 0.174 | 34.8 |
| Line-16 | 1.87 | 0.149 | 0.297 | 1586.6 | 4061.8 | 88.3 | 52 | 86 | 6.39 | 0.169 | 33.6 |
| Line-17 | 2.15 | 0.157 | 0.442 | 1501.1 | 7385.7 | 81.7 | 31 | 64 | 7.66 | 0.159 | 34.5 |
| Line-18 | 1.64 | 0.175 | 0.312 | 1220.2 | 4644.2 | 91 | 53 | 86 | 7.05 | 0.158 | 33.4 |
| Line-19 | 1.21 | 0.148 | 0.296 | 928.7 | 39491.2 | 70 | 25.5 | 64 | 7.36 | 0.171 | 35.7 |
| Line-20 | 2.08 | 0.178 | 0.291 | 1363.7 | 11175.2 | 74.7 | 28 | 68 | 5.55 | 0.161 | 36.1 |
| Line-21 | 1.56 | 0.153 | 0.322 | 1013.7 | 4550 | 85.3 | 31 | 64 | 6.49 | 0.151 | 36.3 |
| Line-22 | 2.07 | 0.171 | 0.384 | 1308.4 | 11883.5 | 70 | 28 | 61 | 6.31 | 0.167 | 34.1 |
| Line-23 | 0.77 | 0.075 | 0.129 | 427.6 | 25745 | 78 | 31 | 64 | 6.87 | 0.144 | 37.8 |
| Line-24 | 2 | 0.157 | 0.293 | 1178.7 | 10116.2 | 82.3 | 28 | 61 | 6.07 | 0.164 | 33.7 |
| Line-25 | 1.37 | 0.156 | 0.257 | 1557.6 | 22554 | 70 | 25.5 | 64 | 6.7 | 0.179 | 35.4 |
| Line-26 | 1.78 | 0.163 | 0.291 | 1437.5 | 45768 | 78.3 | 28 | 68 | 6.73 | 0.178 | 33.5 |
| Line-27 | 1.61 | 0.129 | 0.282 | 829.7 | 72810.5 | 86.7 | 26.8 | 79 | 5.57 | 0.15 | 34.3 |
| Line-28 | 2.18 | 0.17 | 0.252 | 1738 | 79336.3 | 96 | 23.5 | 79 | 6.09 | 0.183 | 35.6 |
| Line-29 | 1.93 | 0.171 | 0.334 | 1031.5 | 39953 | 80 | 25 | 79 | 6.04 | 0.166 | 34.6 |

TABLE 218-continued

Additional measured parameters in Foxtail millet accessions under normal growth conditions

| Corr. ID/L | 21 | 22 | 23 | 24 | 25 | 26 | 27 | 28 | 29 | 30 | 31 |
|---|---|---|---|---|---|---|---|---|---|---|---|
| Line-30 | 0.97 | 0.069 | 0.166 | 512.5 | 30460.8 | 81.3 | 19.5 | 72 | 6.23 | 0.16 | 38 |
| Line-31 | 1.21 | 0.112 | 0.152 | 1152.6 | 42851.8 | 78 | 31 | 68 | 7.33 | 0.188 | 35.6 |
| Line-32 | 1.17 | 0.105 | 0.391 | 869.5 | 1916 | 96 | 39 | 86 | 7.08 | 0.164 | 35.5 |
| Line-33 | 1.48 | 0.102 | 0.384 | 1056.1 | 7487 | 81.3 | 25 | 79 | 5.38 | 0.159 | 32.8 |
| Line-34 | 1.69 | 0.149 | 0.269 | 1446.5 | 15024 | 81.3 | 26.5 | 79 | 5.03 | 0.168 | 35 |
| Line-35 | 0.92 | 0.081 | 0.313 | NA | 15482.3 | 83.7 | 25 | 79 | 7.83 | 0.158 | 34 |
| Line-36 | 1.72 | 0.121 | 0.447 | 1388.6 | 7111.5 | 79 | 25 | 79 | 5.48 | 0.165 | 33.7 |
| Line-37 | 1.16 | 0.074 | 0.393 | 728.2 | 11390 | 75.8 | 26.5 | 79 | 5.24 | 0.159 | 35.7 |
| Line-38 | 0.93 | 0.067 | 0.538 | 606.9 | 8317.5 | 85.8 | 32 | 86 | 5.28 | 0.157 | 34.6 |
| Line-39 | 1.87 | 0.156 | 0.489 | 1634.5 | 13586.2 | 79 | 32 | 79 | 5.35 | 0.172 | 34.4 |
| Line-40 | 1.18 | 0.069 | 0.437 | 800.2 | 6967.2 | 83.5 | 30 | 79 | 5.79 | 0.153 | 33.8 |
| Line-41 | 1.07 | 0.076 | 0.567 | 821 | 6919.8 | 82.7 | 26.5 | 79 | 5.22 | 0.162 | 34.3 |
| Line-42 | 1.83 | 0.156 | 0.615 | 1207.6 | 20024 | 81.3 | 32 | 79 | 6.13 | 0.165 | 34.6 |
| Line-43 | 1.72 | 0.249 | 0.564 | 1487.7 | 1588.8 | 92.7 | 49 | 86 | 6.78 | 0.173 | 34.4 |
| Line-44 | 1.72 | 0.118 | 0.668 | 1281.2 | 4359.5 | 91 | 50 | 91 | 6.31 | 0.169 | 33.5 |
| Line-45 | 1.3 | 0.149 | 0.254 | 863.5 | 28950.2 | 75.8 | 27 | 64 | 6.54 | 0.156 | 37.5 |
| Line-46 | 1.66 | 0.117 | 0.236 | 981.7 | 8930 | 73.5 | 28 | 61 | 5.64 | 0.177 | 35.3 |
| Line-47 | 1.46 | 0.13 | 0.207 | 1059.8 | 2976.8 | 92.7 | 35 | 68 | 6.28 | 0.162 | 34.9 |
| Line-48 | 0.94 | 0.084 | 0.325 | 655 | 28133 | 70 | 27 | 64 | 4.88 | 0.161 | 35.4 |
| Line-49 | 1.63 | 0.15 | 0.457 | 1229 | 4689.5 | 82.3 | 35 | 68 | 6.27 | 0.163 | 32.8 |

Table 218: Provided are the values of each of the parameters (as described above) measured in Foxtail millet accessions ("L" = Line) under normal conditions. Growth conditions are specified in the experimental procedure section.

TABLE 219

Additional measured parameters in Foxtail millet accessions under normal growth conditions

| Corr. ID/L | 32 | 33 | 34 | 35 | 36 | 37 | 38 | 39 | 40 | 41 | 42 |
|---|---|---|---|---|---|---|---|---|---|---|---|
| Line-1 | 178.10 | 6.21 | 2.97 | 7.60 | 7.900 | 45.90 | 19.00 | 1.90 | 0.41 | 60.60 | 2.61 |
| Line-2 | 132.60 | 5.27 | 2.08 | 10.30 | 10.300 | 40.30 | 19.30 | 2.17 | 0.37 | 64.30 | 1.46 |
| Line-3 | 186.30 | 6.40 | 2.59 | 9.20 | 8.700 | 35.80 | 20.60 | 2.62 | 0.42 | 102.80 | 2.91 |
| Line-4 | 147.90 | 7.17 | 3.97 | 3.80 | 4.800 | 55.90 | 29.10 | 2.73 | 0.36 | 79.20 | 4.93 |
| Line-5 | 121.10 | 7.16 | 4.91 | 2.20 | 1.700 | 39.60 | 29.00 | 2.89 | 0.32 | 52.80 | 6.15 |
| Line-6 | 179.10 | 5.59 | 3.92 | 6.60 | 6.900 | 57.10 | 26.80 | 2.73 | 0.44 | 97.60 | 2.93 |
| Line-7 | 167.30 | 2.34 | 1.52 | 20.70 | 45.800 | 11.50 | 12.00 | 1.26 | 0.27 | 41.70 | 0.50 |
| Line-8 | 144.50 | 5.30 | 2.31 | 13.70 | 11.100 | 24.00 | 11.80 | 1.29 | 0.28 | 29.40 | 2.23 |
| Line-9 | 189.30 | 3.98 | 2.23 | 15.80 | 19.500 | 19.00 | 10.40 | 1.30 | 0.39 | 60.90 | 1.18 |
| Line-10 | 225.00 | 4.30 | 2.94 | 16.20 | 15.400 | 22.90 | 12.50 | 1.37 | 0.39 | 54.10 | 1.49 |
| Line-11 | 246.90 | 3.83 | 3.06 | 21.80 | 44.200 | 14.50 | 17.10 | 1.95 | 0.44 | 113.70 | 0.72 |
| Line-12 | 215.90 | 2.42 | 1.70 | 35.20 | 100.10 | 12.20 | 11.80 | 1.32 | 0.35 | 129.90 | 0.49 |
| Line-13 | 270.60 | 3.49 | 2.69 | 16.50 | 33.200 | 13.40 | 10.30 | 1.19 | 0.39 | 70.40 | 0.60 |
| Line-14 | 162.90 | 5.55 | 1.86 | 13.80 | 10.600 | 24.50 | 11.80 | 1.43 | 0.24 | 24.40 | 2.68 |
| Line-15 | 204.20 | 3.56 | 1.91 | 16.70 | 32.900 | 15.10 | 11.30 | 1.36 | 0.37 | 55.60 | 0.88 |
| Line-16 | 279.20 | 3.46 | 2.87 | 15.00 | 40.900 | 15.30 | 11.40 | 1.28 | 0.38 | 58.60 | 0.68 |
| Line-17 | 277.40 | 3.80 | 2.98 | 18.20 | 27.800 | 14.30 | 14.80 | 1.50 | 0.53 | 120.70 | 0.73 |
| Line-18 | 246.90 | 3.11 | 2.53 | 16.60 | 46.600 | 13.60 | 11.10 | 1.33 | 0.34 | 63.70 | 0.56 |
| Line-19 | 125.30 | 8.49 | 4.22 | 1.20 | 3.300 | 65.80 | 36.40 | 3.11 | 0.37 | 95.50 | 5.76 |
| Line-20 | 166.80 | 5.11 | 2.26 | 9.00 | 15.500 | 25.20 | 14.30 | 1.64 | 0.36 | 53.20 | 1.45 |
| Line-21 | 211.20 | 3.38 | 2.25 | 15.10 | 72.000 | 10.10 | 10.30 | 1.31 | 0.37 | 69.60 | 0.71 |
| Line-22 | 227.90 | 4.14 | 2.51 | 13.90 | 30.300 | 18.30 | 14.00 | 1.63 | 0.40 | 71.30 | 1.26 |
| Line-23 | 204.00 | 5.14 | 2.29 | 5.20 | 17.200 | 42.60 | 23.50 | 2.12 | 0.37 | 84.90 | 1.94 |
| Line-24 | 251.60 | 4.04 | 2.91 | 11.00 | 36.900 | 15.00 | 12.60 | 1.44 | 0.43 | 82.00 | 1.14 |
| Line-25 | 130.60 | 6.40 | 3.41 | 2.00 | 3.200 | 49.80 | 18.70 | 2.06 | 0.46 | 139.90 | 3.07 |
| Line-26 | 119.70 | 6.35 | 4.38 | 3.20 | 2.200 | 60.30 | 29.60 | 2.54 | 0.48 | 107.80 | 3.79 |
| Line-27 | 111.60 | 9.56 | 4.74 | 1.40 | 2.300 | 80.50 | 35.50 | 2.63 | 0.25 | 32.80 | 10.50 |
| Line-28 | 124.70 | 9.08 | 3.96 | 1.60 | 2.100 | 91.90 | 41.60 | 4.61 | 0.41 | 70.80 | 11.39 |
| Line-29 | 128.70 | 7.85 | 3.21 | 3.70 | 4.100 | 57.00 | 33.30 | 2.89 | 0.32 | 55.30 | 6.00 |
| Line-30 | 102.10 | 7.54 | 2.46 | 1.40 | 2.100 | 54.70 | 24.10 | 2.48 | 0.23 | 26.20 | 4.96 |
| Line-31 | 165.80 | 5.91 | 5.00 | 1.30 | 1.400 | 84.50 | 37.50 | 3.18 | 0.50 | 131.20 | 3.58 |
| Line-32 | 207.10 | 2.69 | 1.53 | 26.70 | 90.600 | 6.50 | 9.80 | 1.37 | 0.27 | 47.60 | 0.33 |
| Line-33 | 152.30 | 5.48 | 2.28 | 9.80 | 8.600 | 20.90 | 10.70 | 1.31 | 0.26 | 28.00 | 2.56 |
| Line-34 | 141.70 | 6.53 | 2.88 | 4.10 | 5.800 | 46.70 | 21.20 | 2.21 | 0.30 | 45.40 | 4.16 |
| Line-35 | 131.10 | 5.90 | 2.22 | 6.40 | 6.500 | 34.10 | 18.50 | 1.72 | 0.20 | 23.60 | 3.53 |
| Line-36 | 158.80 | 5.44 | 2.00 | 11.60 | 12.700 | 24.00 | 12.70 | 1.32 | 0.31 | 36.80 | 2.62 |
| Line-37 | 143.90 | 4.87 | 2.52 | 11.40 | 8.100 | 36.20 | 14.50 | 1.85 | 0.27 | 26.10 | 3.04 |
| Line-38 | 169.90 | 5.76 | 2.69 | 14.60 | 10.800 | 31.30 | 13.50 | 1.68 | 0.21 | 22.30 | 2.75 |
| Line-39 | 161.40 | 6.43 | 2.72 | 8.20 | 7.300 | 37.70 | 15.70 | 1.69 | 0.37 | 60.60 | 3.34 |
| Line-40 | 127.30 | 5.66 | 2.09 | 9.20 | 7.700 | 29.30 | 11.30 | 1.52 | 0.25 | 21.30 | 2.50 |
| Line-41 | 125.30 | 6.29 | 2.38 | 13.80 | 9.400 | 29.50 | 15.20 | 1.56 | 0.27 | 29.60 | 2.74 |

TABLE 219-continued

Additional measured parameters in Foxtail millet accessions under normal growth conditions

| Corr. ID/L | 32 | 33 | 34 | 35 | 36 | 37 | 38 | 39 | 40 | 41 | 42 |
|---|---|---|---|---|---|---|---|---|---|---|---|
| Line-42 | 144.60 | 5.32 | 1.88 | 13.50 | 16.000 | 29.10 | 16.80 | 1.87 | 0.29 | 40.60 | 2.53 |
| Line-43 | 246.50 | 2.69 | 1.11 | 31.70 | 123.60 | 7.70 | 9.50 | 1.14 | 0.33 | 92.10 | 0.30 |
| Line-44 | 212.90 | 3.17 | 2.84 | 36.20 | 41.200 | 14.90 | 11.60 | 1.41 | 0.32 | 42.10 | 0.78 |
| Line-45 | 191.70 | 6.55 | 2.64 | 5.20 | 4.200 | 51.20 | 28.20 | 2.99 | 0.43 | 117.00 | 2.47 |
| Line-46 | 254.50 | 4.53 | 1.94 | 6.90 | 38.700 | 12.70 | 13.30 | 1.49 | 0.37 | 53.40 | 1.01 |
| Line-47 | 292.00 | 3.19 | 1.51 | 11.40 | 64.500 | 10.20 | 11.20 | 1.34 | 0.36 | 61.20 | 0.63 |
| Line-48 | 138.40 | 7.61 | 3.37 | 2.20 | 4.300 | 46.90 | 22.80 | 2.14 | 0.33 | 55.10 | 3.82 |
| Line-49 | 295.60 | 3.75 | 1.54 | 23.40 | 54.700 | 15.20 | 10.50 | 1.28 | 0.36 | 66.60 | 0.69 |

Table 219: Provided are the values of each of the parameters (as described above) measured in Foxtail millet accessions ("L" = Line) under normal conditions. Growth conditions are specified in the experimental procedure section.

TABLE 220

Additional measured parameters in Foxtail millet accessions under normal growth conditions

| Corr. ID/L | 43 | 44 | 45 | 46 | 47 | 48 | 49 | 50 | 51 | 52 | 53 | 54 |
|---|---|---|---|---|---|---|---|---|---|---|---|---|
| Line-1 | 7.83 | 10.17 | 465.70 | 0.51 | 7.660 | 41.60 | 0.06 | 0.62 | 1.57 | 37.80 | 48.30 | 61.90 |
| Line-2 | 4.38 | 8.33 | 193.40 | 0.25 | 6.330 | 66.30 | 0.04 | 0.54 | 1.68 | 43.80 | 43.80 | 53.20 |
| Line-3 | 8.73 | 9.50 | 543.00 | 0.55 | 7.710 | 48.70 | 0.07 | 0.60 | 1.85 | 40.00 | 45.80 | 59.60 |
| Line-4 | 14.80 | 11.42 | 726.20 | 0.73 | 6.710 | 43.70 | 0.07 | 0.65 | 1.32 | 47.00 | 51.20 | 62.10 |
| Line-5 | 18.45 | 10.08 | 742.80 | 0.49 | 5.840 | 32.80 | 0.03 | 0.45 | 0.98 | 47.00 | 51.10 | 60.30 |
| Line-6 | 8.78 | 11.50 | 522.80 | 0.46 | 7.750 | 46.80 | 0.06 | 0.47 | 1.40 | 46.20 | 48.80 | 65.70 |
| Line-7 | 1.50 | 6.92 | 82.80 | 0.48 | 9.360 | 61.60 | 0.07 | 0.76 | 1.84 | 41.00 | 47.80 | 57.40 |
| Line-8 | 6.68 | 11.00 | 321.50 | 0.55 | 5.720 | 52.60 | 0.06 | 0.85 | 1.61 | 50.50 | 49.90 | 46.60 |
| Line-9 | 3.54 | 9.08 | 221.60 | 0.46 | 6.470 | 35.70 | 0.05 | 0.58 | 1.35 | 40.00 | 41.70 | 46.40 |
| Line-10 | 4.48 | 8.67 | 301.90 | 0.36 | 8.380 | 43.60 | 0.04 | 0.60 | 1.65 | 40.00 | 42.90 | 42.70 |
| Line-11 | 2.16 | 5.67 | 177.50 | 0.55 | 10.590 | 39.10 | 0.05 | 0.47 | 1.93 | 33.00 | 48.60 | 57.30 |
| Line-12 | 1.47 | 5.11 | 105.00 | 0.47 | 5.720 | 46.10 | 0.08 | 0.43 | 1.76 | 39.00 | 45.10 | 61.10 |
| Line-13 | 1.80 | 5.08 | 163.20 | 0.56 | 11.420 | 19.60 | 0.04 | 0.44 | 0.95 | 33.00 | 44.90 | 54.30 |
| Line-14 | 8.04 | 11.42 | 431.60 | 0.34 | 6.840 | 86.40 | 0.06 | 0.87 | 1.74 | 54.80 | 46.20 | 45.10 |
| Line-15 | 2.64 | 8.50 | 177.70 | 0.53 | 7.590 | 31.30 | 0.04 | 0.53 | 1.16 | 40.00 | 49.70 | 53.50 |
| Line-16 | 2.04 | 6.75 | 190.00 | 0.60 | 12.150 | 23.40 | 0.05 | 0.63 | 1.14 | 33.00 | 47.00 | 57.00 |
| Line-17 | 2.19 | 6.00 | 202.30 | 0.67 | 8.240 | 31.80 | 0.03 | 0.36 | 1.56 | 33.00 | 44.40 | 48.40 |
| Line-18 | 1.68 | 5.58 | 136.70 | 0.52 | 7.300 | 22.40 | 0.06 | 0.66 | 1.10 | 33.00 | 49.00 | 61.00 |
| Line-19 | 17.29 | 10.89 | 648.00 | 0.35 | 6.680 | 26.60 | 0.05 | 0.37 | 0.98 | 38.50 | 49.50 | 63.70 |
| Line-20 | 4.34 | 8.92 | 240.50 | 0.35 | 8.870 | 29.10 | 0.07 | 0.78 | 1.08 | 40.00 | 48.50 | 64.10 |
| Line-21 | 2.12 | 6.50 | 147.90 | 0.56 | 9.560 | 23.20 | 0.05 | 0.51 | 1.13 | 33.00 | 49.10 | 57.60 |
| Line-22 | 3.79 | 7.00 | 286.90 | 0.43 | 8.090 | 26.50 | 0.04 | 0.53 | 1.30 | 33.00 | 45.60 | 53.50 |
| Line-23 | 5.83 | 9.33 | 357.00 | 0.27 | 5.850 | 11.20 | 0.03 | 0.25 | 0.64 | 33.00 | 51.00 | 58.10 |
| Line-24 | 3.42 | 7.42 | 287.10 | 0.45 | 6.210 | 21.10 | 0.03 | 0.43 | 1.03 | 33.00 | 45.20 | 53.40 |
| Line-25 | 9.22 | 8.42 | 396.50 | 0.36 | 5.400 | 22.60 | 0.03 | 0.27 | 0.84 | 38.50 | 51.30 | 64.70 |
| Line-26 | 11.38 | 10.33 | 459.20 | 0.44 | 3.920 | 28.10 | 0.03 | 0.35 | 1.07 | 39.20 | 50.10 | 61.90 |
| Line-27 | 31.50 | 13.33 | 1184.3 | 0.47 | 6.970 | 46.90 | 0.06 | 0.93 | 1.17 | 52.20 | 50.60 | 51.30 |
| Line-28 | 34.19 | 13.58 | 1417.5 | 0.46 | 4.590 | 46.70 | 0.05 | 0.58 | 1.17 | 55.50 | 47.50 | 59.10 |
| Line-29 | 18.00 | 12.42 | 771.60 | 0.32 | 4.890 | 56.30 | 0.06 | 0.76 | 1.43 | 53.20 | 48.00 | 45.50 |
| Line-30 | 14.89 | 9.25 | 505.80 | 0.25 | 3.630 | 27.20 | 0.05 | 0.64 | 0.68 | 52.50 | 49.40 | 45.20 |
| Line-31 | 8.07 | 10.67 | 593.50 | 0.37 | 5.730 | 12.50 | 0.02 | 0.20 | 0.60 | 37.00 | 51.90 | 67.90 |
| Line-32 | 1.00 | 6.50 | 68.40 | 0.59 | 6.380 | 53.50 | 0.05 | 0.54 | 1.63 | 47.00 | 43.40 | 60.70 |
| Line-33 | 7.69 | 10.67 | 434.50 | 0.50 | 7.690 | 66.50 | 0.06 | 0.87 | 1.68 | 53.20 | 47.80 | 44.10 |
| Line-34 | 12.48 | 11.17 | 589.50 | 0.50 | 6.850 | 44.10 | 0.07 | 0.80 | 1.10 | 52.50 | 45.50 | 55.50 |
| Line-35 | 10.60 | 12.92 | 463.40 | 0.31 | 4.770 | 54.10 | 0.07 | 0.82 | 1.38 | 53.20 | 45.30 | 46.30 |
| Line-36 | 7.86 | 11.08 | 415.10 | 0.59 | 7.300 | 76.50 | 0.06 | 0.79 | 1.94 | 53.20 | 46.10 | 46.80 |
| Line-37 | 9.13 | 12.83 | 442.10 | 0.52 | 6.680 | 65.50 | 0.04 | 0.65 | 2.01 | 52.50 | 45.20 | 40.90 |
| Line-38 | 8.24 | 10.67 | 460.70 | 0.52 | 9.270 | 95.20 | 0.06 | 0.75 | 2.06 | 54.00 | 44.00 | 43.40 |
| Line-39 | 10.01 | 9.83 | 529.80 | 0.40 | 8.890 | 64.70 | 0.05 | 0.63 | 1.97 | 47.00 | 44.40 | 37.80 |
| Line-40 | 7.50 | 10.33 | 320.80 | 0.44 | 8.170 | 59.60 | 0.04 | 0.76 | 1.49 | 49.00 | 45.00 | 42.50 |
| Line-41 | 8.23 | 10.25 | 349.80 | 0.51 | 7.110 | 93.70 | 0.04 | 0.61 | 2.40 | 52.50 | 47.00 | 46.80 |
| Line-42 | 7.59 | 9.83 | 366.10 | 0.47 | 7.330 | 84.20 | 0.08 | 0.90 | 2.15 | 47.00 | 44.70 | 44.70 |
| Line-43 | 0.90 | 5.25 | 73.70 | 0.52 | 9.260 | 46.30 | 0.09 | 0.66 | 1.74 | 37.00 | 44.90 | 57.30 |
| Line-44 | 2.08 | 5.67 | 160.90 | 0.57 | 6.960 | 69.90 | 0.05 | 0.73 | 2.48 | 41.00 | 50.20 | 60.10 |
| Line-45 | 7.41 | 8.75 | 470.80 | 0.44 | 5.720 | 20.90 | 0.04 | 0.31 | 1.16 | 37.00 | 52.30 | 65.70 |
| Line-46 | 3.02 | 7.50 | 255.10 | 0.52 | 9.980 | 17.00 | 0.03 | 0.48 | 0.76 | 33.00 | 44.00 | 56.90 |
| Line-47 | 1.90 | 6.75 | 169.80 | 0.55 | 7.090 | 14.90 | 0.05 | 0.51 | 0.83 | 33.00 | 47.40 | 55.50 |
| Line-48 | 11.45 | 10.17 | 525.30 | 0.45 | 5.180 | 26.60 | 0.03 | 0.40 | 1.00 | 37.00 | 48.60 | 61.70 |
| Line-49 | 2.08 | 6.00 | 204.60 | 0.44 | 7.720 | 32.70 | 0.06 | 0.58 | 1.82 | 33.00 | 47.40 | 54.10 |

Table 220: Provided are the values of each of the parameters (as described above) measured in Foxtail millet accessions ("L" = Line) under normal conditions. Growth conditions are specified in the experimental procedure section.

TABLE 221

Correlation between the expression level of selected genes of some embodiments of the invention in various tissues and the phenotypic performance under normal conditions across Foxtail millet accessions

| Gene Name | R | P value | Exp. set | Corr. ID | Gene Name | R | P value | Exp. set | Corr. ID |
|---|---|---|---|---|---|---|---|---|---|
| LBY299 | 0.72 | 7.18E−09 | 3 | 19 | LBY299 | 0.71 | 1.54E−08 | 3 | 16 |

Table 221. Provided are the correlations (R) between the genes expression levels in various tissues ("Exp. Set" = Expression set specified in Table 214) and the phenotypic performance measured (Tables 216-220) according to the correlation vectors ("Corr. ID") specified in Table 215.
"R" = Pearson correlation coefficient;
"P" = p value.

Example 19

Production of Wheat Transcriptome and High Throughput Correlation Analysis with Yield Related Parameters Using 62K Wheat Oligonucleotide Micro-Arrays In order to produce a high throughput correlation analysis between plant phenotype and gene expression level, the present inventors utilized a wheat oligonucleotide microarray, produced by Agilent Technologies [chem. (dot) agilent (dot) com/Scripts/PDS (dot) asp?lPage=50879]. The array oligonucleotide represents about 50,000 wheat genes and transcripts.

Correlation of Wheat Lines Grown Under Regular Growth Conditions

Experimental Procedures 185 spring wheat lines were grown in 5 replicate plots in the field. Wheat seeds were sown and plants were grown under commercial fertilization and irrigation protocols (normal growth conditions) which include 150 m$^3$ applied water and 400 m$^3$ by rainfall per dunam (1000 square meters) per entire growth period and fertilization of 15 units of URAN® 21% (Nitrogen Fertilizer Solution; PCS Sales, Northbrook, Ill., USA).

In order to define correlations between the levels of RNA expression with yield components or vigor related parameters, phenotypic performance of the 185 different wheat lines was characterized and analyzed at various developmental stages. Twenty six selected lines, encompassing a wide range of the observed variation were sampled for RNA expression analysis. The correlation between the RNA levels and the characterized parameters was analyzed using Pearson correlation test [davidmlane (dot) com/hyperstat/A34739 (dot) html].

Analyzed Wheat tissues—Three types of plant tissues [flag leaf, inflorescence and peduncle] from plants grown under Normal conditions were sampled and RNA was extracted as described above. Micro-array expression information from each tissue type has received a Set ID as summarized in Table 222 below.

TABLE 222

Wheat transcriptome expression sets under normal growth conditions

| Expression Set | Set ID |
|---|---|
| Flag leaf at heading stage under normal growth conditions | 1 |
| Inflorescence at heading stage under normal growth conditions | 2 |
| peduncle at heading stage under normal growth conditions | 3 |

Table 222: Provided are the wheat transcriptome expression sets.
Flag leaf = Full expanded upper leaf at heading;
inflorescence = spike before flowering at full head emergence;
peduncle = upper stem internode between the flag leaf and spike.

Wheat Yield Components and Vigor Related Parameters Assessment

The collected data parameters were as follows:

% Canopy coverage (F)—percent Canopy coverage at flowering stage. The % Canopy coverage is calculated using Formula 32 (above).

1000 seed weight [gr.]—was calculated based on Formula 14 (above).

1000 grain weight filling rate (gr./day)—was calculated based on Formula 36 above.

Average spike weight (H) [gr.]—The biomass and spikes of each plot was separated. Spikes dry weight at harvest was divided by the number of spikes or by the number of plants.

Dry weight=total weight of the vegetative portion above ground (excluding roots) after drying at 70° C. in oven for 48 hours.

Average tiller DW (H) [gr.]—Average Stem Dry Matter at harvest.

Average vegetative DW per plant (H) [gr.]—Vegetative dry weight per plant at harvest.

Fertile spikelets [number]—Number of fertile spikelets per spike. Count the bottom sterile spikelets in a sample from harvested spikes and deduce from number of spikelets per spike (with the unfertile spikes).

Fertile spikelets ratio [value]—Measure by imaging, the number of fertile and sterile spikelets per spike in 20 spikes randomly selected from the plot. Calculate the ratio between fertile spikelets to total number of spikelets×100 (sum of fertile and sterile spikelets).

Field Spike length (H) [cm]—Measure spike length per plant excluding the awns, at harvest.

Grain fill duration [number]—Defined by view. Calculate the number of days from anthesis in 50% of the plot to physiological maturity in 50% of the plot.

Grain fill duration (GDD)—Duration of grain filling period according to the growing degree units (GDD) method. The accumulated GDD during the grain filling period was calculated by subtracting the Num days to Anthesis (GDD) from Num days to Maturity (GDD).

Grains per spike [number]—The total number of grains from 20 spikes per plot that were manually threshed was counted. The average grains per spike was calculated by dividing the total grain number by the number of spikes.

Grains per spikelet [number]—Number of grains per spike divided by the number of fertile spikelets per spike. Measure by imaging the number of fertile spikelets in 20 randomly selected spikes and calculate an average per spike.

Grains yield per micro plots [Kg]—Grain weight per micro plots.

Grains yield per spike [gr.]—Total grain weight per spike from 20 spikes per plot. The total grain weight per spike was calculated by dividing the grain weight of 20 spikes by the number of spikes.

Harvest index [ratio]—was calculated based on Formula 18 (above).

Number days to anthesis [number]—Calculated as the number of days from sowing till 50% of the plots reach anthesis.

Number days to anthesis (GDD)—Number days to anthesis according to the growing degree units method. The accumulated GDD from sowing until anthesis stage.

Number days to maturity [number]—Calculated as the number of days from sowing till 50% of the plots reach maturity.

Number days to maturity (GDD)—Number days to maturity according to the growing degree units method. The accumulated GDD from sowing until maturity stage.

Number days to tan [number]—Calculated as the number of days from sowing till 50% of the plot arrive to grain maturation.

PAR_LAI (F)—Photosynthetically Active Radiation (PAR) at flowering.

Peduncle length (F) [cm]—Length of upper internode from the last node to the spike base at flowering. Calculate the average peduncle length per 10-15 plants randomly distributed within a pre-defined 0.5 m² of a plot.

Peduncle width (F) [mm]—Upper node width at flowering. Calculate the average upper nodes width, measured just above the flag leaf auricles per 10-15 plants randomly distributed within a pre-defined 0.5 m² of a plot.

Peduncle volume (F)[Float value]=Peduncle length*(peduncle thickness/2)²*π.

Spikelets per spike [number]—Number of spikelets per spike (with the unfertile spikes). Measured by imaging, the number of spikelets per spike in 20 spikes randomly selected from the plot.

Spikes per plant (H) [number]—Number of spikes per plant at harvest. Calculate Number of spikes per unit area/Number of plants per plot.

Spikes weight per plant (FC) [gr.]—Spikes weight per plant at flowering complete. Spikes weight from 10 plants/number of plants.

Stem length (F) [cm]—Main Stem length at flowering. Measures the length of Main Stem from ground to end of elongation (without the spike).

Stem width (F) [mm]—Stem width at flowering. Measures on the stem beneath the peduncle.

Test weight (mechanical harvest) [Kg/hectoliter]—Volume weight of seeds.

Tillering (F) [number]—Count the number of tillers per plant from 6-10 plants randomly distributed in a plot, at flowering stage.

Tillering (H) [number]—Number of tillers at harvest.

Total dry matter (F) [gr.]—was calculated based on Formula 21.

Total Plant Biomass (H) [gr.]—Vegetative dry weight+Spikes dry weight.

Vegetative DW per plant (F) [gr.]—Plant weight after drying (excluding the spikes) at flowering stage.

Total N content of grain per plant [gr.]—N content of grain*Grains yield per plant.

NDRE 1 [Float value]—Normalized difference Red-Edge TP-1 (time point). Calculated as (NIR−Red edge)/(NIR+Red edge). ("NIR"—Near InfraRed)

NDRE 2[Float value]—Normalized difference Red-Edge TP-2. Calculated as (Nir−Red edge)/(Nir+Red edge).

NDVI1 [Float value]—Normalized Difference Vegetation Index TP-1. Calculated as (Nir−Red edge)/(Nir+Red edge).

NDVI 2 [Float value]—Normalized Difference Vegetation Index TP-2. Calculated as (Nir−Red edge)/(Nir+Red edge).

RUE [ratio]—total dry matter produced per intercepted PAR. Spikes weight per plant+Vegetative DW per plant at flowering/% Canopy coverage.

The following parameters were collected using digital imaging system:

Grain Area [cm²]—A sample of ~200 grains were weight, photographed and images were processed using the below described image processing system. The grain area was measured from those images and was divided by the number of grains.

Grain Length and Grain width [cm]—A sample of ~200 grains was weighted, photographed and images were processed using the below described image processing system. The sum of grain lengths and width (longest axis) was measured from those images and was divided by the number of grains.

Grain Perimeter [cm]—A sample of ~200 grains were weight, photographed and images were processed using the below described image processing system. The sum of grain perimeter was measured from those images and was divided by the number of grains.

Spike area [cm²]—At the end of the growing period 5 'spikes' were photographed and images were processed using the below described image processing system. The 'spike' area was measured from those images and was divided by the number of 'spikes'.

Spike length [cm]—Measure by imaging spikes length excluding awns, per 30 randomly selected spikes within a pre-defined 0.5 m² of a plot.

Spike max width [cm]—Measure by imaging the max width of 10-15 spikes randomly distributed within a pre-defined 0.5 m² of a plot. Measurements were carried out at the middle of the spike.

Spike width [cm]—Measure by imaging the width of 10-15 spikes randomly distributed within a pre-defined 0.5 m² of a plot. Measurements were carried out at the middle of the spike.

N use efficiency [ratio]—was calculated based on Formula 51 (above).

Yield per spike filling rate [gr./day]—was calculated based on Formula 60 (above).

Yield per micro plots filling rate [gr./day]—was calculated based on Formula 61 (above).

Grains yield per hectare [ton/ha]—was calculated based on Formula 62 (above).

Yield per plant filling rate (gr./day)—was calculated according to Formula 39 (using grain yield per plant).

Total NUtE [ratio]—was calculated based on Formula 53 (above).

The image processing system consisted of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Data parameters collected are summarized in Table 223, herein below

TABLE 223

| Wheat correlated parameters (vectors) | |
|---|---|
| Correlated parameter with | Correlation ID |
| Tillering (F) [number] | 1 |
| Tillering (H) [number] | 2 |
| Avr tiller DW (H) [gr.] | 3 |
| Avr Vegetative DW per plant (H) [gr.] | 4 |
| Total Plant Biomass (H) [gr.] | 5 |
| Vegetative DW per plant (F) [gr.] | 6 |
| Grains yield per hectare [ton/ha] | 7 |
| Grains yield per micro plots [kg] | 8 |
| PAR_LAI (F) [μmol$^{-2}$ S$^{-1}$] | 9 |
| % Canopy coverage (F) [%] | 10 |
| RUE [ratio] | 11 |
| Grains yield per spike [gr.] | 12 |
| Spikes dry weight per plant (F) [gr.] | 13 |
| NDRE_1 [Float value] | 14 |
| NDRE_2 [Float value] | 15 |
| NDVI_1 [Float value] | 16 |
| Avr Spikes DW per plant (H) [gr.] | 17 |
| Avr spike weight (H) [gr.] | 18 |
| NDVI_2 [Float value] | 19 |
| Num days to anthesis [number] | 20 |
| Num days to anthesis (GDD) [number] | 21 |
| Num days to tan [number] | 22 |
| Grains per spike [number] | 23 |
| Grains per spikelet [number] | 24 |
| Spikelets per spike [number] | 25 |
| Num days to maturity [number] | 26 |
| Num days to maturity (GDD) [number] | 27 |
| Peduncle length (F) [cm] | 28 |
| Fertile spikelets [number] | 29 |
| Fertile spikelets ratio [value] | 30 |
| Peduncle width (F) [mm] | 31 |
| Peduncle volume (F) [Float value] | 32 |
| Stem length (F) [cm] | 33 |
| Spikes per plant (H) [number] | 34 |
| Spike Area [cm$^2$] | 35 |
| Stem width (F) [mm] | 36 |
| N use efficiency [ratio] | 37 |
| Spike length [cm] | 38 |
| Field Spike length (H) [cm] | 39 |
| Spike width [cm] | 40 |
| Total N utilization efficiency [ratio] | 41 |
| Spike max width [cm] | 42 |

TABLE 223-continued

| Wheat correlated parameters (vectors) | |
|---|---|
| Correlated parameter with | Correlation ID |
| 1000 grain weight [gr.] | 43 |
| Grain area [cm$^2$] | 44 |
| Test weight (mechanical harvest) [kg/hectoliter] | 45 |
| Grain length [cm] | 46 |
| Grain Perimeter [cm] | 47 |
| Grain width [cm] | 48 |
| Grain fill duration [number] | 49 |
| Grain fill duration (GDD) [number] | 50 |
| Yield per micro plots filling rate [ratio] | 51 |
| Total N content of grain per plant [gr.] | 52 |
| N content of grain (harvest) [gr.] | 53 |
| Yield per plant filling rate [gr./day] | 54 |
| Yield per spike filling rate [gr./day] | 55 |
| 1000 grain weight filling rate [gr./day] | 56 |
| Harvest index [ratio] | 57 |
| Total dry matter (F) [gr.] | 58 |

Table 223. Provided are the wheat correlated parameters.
"TP" = time point;
"DW" = dry weight;
"FW" = fresh weight;
"Low N" = Low Nitrogen;
"Relative water content [percent];
"num" = number.
"gr." = grams;
"cm" = centimeter;
"Avr" = average;
"RGR' = relative growth rate;
"BPE" = biomass production efficiency;
"NHI" = Nitrogen harvest index;
"NupE" = nitrogen uptake efficiency;
"NutE" = nitrogen utilization efficiency;
"SPAD" = chlorophyll levels;
"F"= flowering stage;
"H" = harvest stage;
"N" = nitrogen;;
"gr." = gram(s);
"cm" = centimeter(s);
"kg" = kilogram;
"FC" = flowering completed;
"RUE = radiation use efficiency;
"NDVI" = normalized Difference Vegetation Index;
"NDRE" = normalized Difference Red-Edge index.

Experimental Results 185 different wheat lines were grown and characterized for different parameters. Tissues for expression analysis were sampled from a subset of 26 lines. The correlated parameters are described in Table 223 above. The average for each of the measured parameter was calculated using the JMP software (Tables 224-226) and a subsequent correlation analysis was performed (Table 227). Results were then integrated to the database.

TABLE 224

| Measured parameters in Wheat accessions under normal conditions | | | | | | | | | |
|---|---|---|---|---|---|---|---|---|---|
| Line/ Corr. ID | L-4 | L-8 | L-23 | L-27 | L-31 | L-36 | L-40 | L-60 | L-63 |
| 1 | 3.27 | 2.51 | 3.02 | 2.62 | 2.99 | 3.08 | 4.03 | 3.00 | 2.71 |
| 2 | 3.11 | 2.59 | 3.63 | 3.38 | 2.47 | 3.98 | 3.84 | 2.98 | 2.33 |
| 3 | 1.99 | 1.35 | 1.23 | 1.36 | 1.47 | 2.32 | 2.28 | 1.38 | 1.64 |
| 4 | 5.87 | 3.01 | 4.06 | 4.55 | 3.52 | 7.85 | 6.72 | 3.87 | 3.61 |
| 5 | 9.30 | 4.90 | 9.10 | 11.10 | 9.20 | 11.80 | 10.80 | 8.50 | 9.40 |
| 6 | 6.90 | 5.77 | 4.95 | 5.46 | 5.25 | 9.49 | 11.27 | 6.03 | 6.20 |
| 7 | 6.59 | 4.54 | 8.24 | 9.75 | 11.85 | 5.63 | 5.94 | 7.97 | 12.37 |
| 8 | 5.66 | 3.90 | 7.09 | 8.38 | 10.19 | 4.84 | 5.11 | 6.85 | 10.64 |
| 9 | 4.58 | 2.45 | 2.26 | 2.49 | 5.78 | 1.88 | 2.87 | 5.26 | 3.73 |
| 10 | 92.10 | 67.60 | 64.40 | 73.00 | 96.20 | 59.80 | 87.80 | 92.80 | 92.90 |
| 11 | 0.087 | 0.103 | 0.101 | 0.138 | 0.068 | 0.185 | 0.147 | 0.079 | 0.089 |

TABLE 224-continued

Measured parameters in Wheat accessions under normal conditions

| Line/ Corr. ID | L-4 | L-8 | L-23 | L-27 | L-31 | L-36 | L-40 | L-60 | L-63 |
|---|---|---|---|---|---|---|---|---|---|
| 12 | 1.12 | 0.89 | 1.32 | 1.52 | 1.95 | 0.93 | 1.31 | 1.69 | 2.03 |
| 13 | 1.09 | 1.02 | 0.96 | 3.74 | 1.27 | 1.18 | 1.60 | 1.28 | 2.13 |
| 14 | 0.134 | 0.139 | 0.128 | 0.119 | 0.121 | 0.144 | 0.147 | 0.125 | 0.129 |
| 15 | 0.230 | 0.229 | 0.204 | 0.233 | 0.184 | 0.236 | 0.203 | 0.211 | 0.194 |
| 16 | 0.33 | 0.33 | 0.30 | 0.30 | 0.29 | 0.36 | 0.36 | 0.30 | 0.30 |
| 17 | 3.48 | 2.07 | 5.00 | 6.60 | 5.64 | 3.93 | 4.47 | 4.68 | 5.78 |
| 18 | 1.61 | 1.12 | 1.80 | 2.14 | 2.64 | 1.30 | 2.08 | 2.23 | 2.77 |
| 19 | 0.61 | 0.60 | 0.54 | 0.62 | 0.46 | 0.65 | 0.53 | 0.56 | 0.51 |
| 20 | 128.00 | 120.80 | 128.00 | 127.80 | 116.60 | 137.60 | 129.30 | 117.20 | 128.00 |
| 21 | 951.80 | 856.90 | 951.80 | 943.10 | 813.70 | 1067.60 | 966.70 | 819.40 | 951.80 |
| 22 | 160.80 | 153.20 | 157.80 | 158.20 | 153.60 | 172.00 | 163.70 | 153.20 | 157.00 |
| 23 | 29.10 | 24.80 | 32.20 | 37.40 | 43.30 | 24.10 | 32.50 | 42.80 | 46.30 |
| 24 | 1.81 | 1.65 | 2.07 | 2.36 | 2.61 | 1.53 | 1.88 | 2.38 | 2.69 |
| 25 | 18.10 | 16.90 | 18.10 | 17.90 | 19.10 | 17.70 | 19.60 | 20.10 | 19.70 |
| 26 | 176.00 | 163.00 | 167.30 | 168.20 | 163.00 | 177.80 | 175.70 | 164.60 | 169.00 |
| 27 | 1575.70 | 1336.20 | 1412.60 | 1428.60 | 1336.20 | 1610.00 | 1571.90 | 1364.30 | 1441.60 |
| 28 | 38.90 | 36.40 | 38.00 | 39.50 | 34.50 | 38.30 | 49.00 | 38.30 | 35.90 |
| 29 | 16.10 | 14.90 | 15.60 | 15.90 | 16.60 | 15.90 | 17.30 | 18.00 | 17.20 |
| 30 | 88.50 | 88.10 | 86.30 | 89.00 | 87.00 | 90.10 | 88.20 | 89.50 | 87.10 |
| 31 | 2.44 | 3.12 | 2.68 | 2.68 | 3.05 | 2.20 | 2.66 | 3.09 | 2.73 |
| 32 | 18.90 | 28.20 | 21.60 | 22.50 | 25.30 | 14.70 | 27.90 | 28.90 | 21.00 |
| 33 | 122.20 | 98.00 | 92.50 | 94.10 | 74.80 | 126.10 | 135.60 | 97.00 | 85.70 |
| 34 | 2.28 | 1.91 | 3.26 | 3.18 | 2.29 | 3.19 | 2.63 | 2.27 | 2.20 |
| 35 | 8.47 | 5.67 | 7.72 | 9.83 | 11.67 | 6.81 | 7.30 | 9.53 | NA |
| 36 | 3.67 | 4.48 | 3.71 | 4.03 | 4.89 | 3.42 | 3.64 | 4.21 | 4.06 |
| 37 | 38.70 | 21.40 | 48.50 | 57.30 | 69.70 | 33.10 | 35.00 | 28.10 | 72.70 |
| 38 | 9.50 | 6.56 | 8.22 | 8.20 | 11.06 | 8.09 | 9.41 | 9.93 | NA |
| 39 | 8.90 | 6.70 | 8.55 | 7.92 | 10.46 | 8.83 | 10.12 | 9.49 | 9.70 |
| 40 | 1.03 | 1.01 | 1.09 | 1.42 | 1.26 | 0.97 | 0.90 | 1.16 | NA |
| 41 | 130.70 | 116.30 | 106.10 | 107.20 | 102.60 | 131.80 | 127.60 | 113.10 | 123.10 |
| 42 | 1.26 | 1.23 | 1.32 | 1.71 | 1.57 | 1.18 | 1.08 | 1.45 | NA |
| 43 | 39.80 | 38.30 | 42.10 | 41.70 | 48.40 | 39.50 | 41.20 | 41.30 | 44.60 |
| 44 | 0.183 | 0.178 | 0.186 | 0.189 | 0.211 | 0.173 | 0.178 | 0.190 | 0.202 |
| 45 | 69.00 | 84.60 | 81.00 | 85.60 | 84.30 | 75.20 | 81.60 | 85.30 | 79.70 |
| 46 | 0.660 | 0.653 | 0.689 | 0.671 | 0.708 | 0.662 | 0.650 | 0.696 | 0.702 |
| 47 | 1.70 | 1.68 | 1.74 | 1.73 | 1.84 | 1.68 | 1.68 | 1.76 | 1.79 |
| 48 | 0.37 | 0.36 | 0.36 | 0.37 | 0.39 | 0.35 | 0.36 | 0.37 | 0.38 |
| 49 | 33.80 | 32.40 | 29.00 | 30.50 | 37.00 | 34.40 | 34.10 | 36.00 | 29.00 |
| 50 | 365.60 | 388.60 | 304.80 | 337.80 | 437.30 | 432.70 | 383.70 | 426.10 | 304.80 |
| 51 | 0.19 | 0.14 | 0.29 | 0.36 | 0.32 | 0.17 | 0.17 | 0.23 | 0.42 |
| 52 | 63.40 | 42.50 | 79.30 | 78.90 | 73.20 | 58.50 | 70.10 | 76.40 | 57.70 |
| 53 | 2.49 | 1.86 | 1.89 | 1.99 | 1.75 | 2.24 | 2.12 | 1.81 | 1.54 |
| 54 | 0.078 | 0.053 | 0.139 | 0.197 | 0.120 | 0.088 | 0.108 | 0.106 | 0.153 |
| 55 | 0.033 | 0.027 | 0.045 | 0.059 | 0.053 | 0.028 | 0.039 | 0.047 | 0.068 |
| 56 | 1.16 | 1.19 | 1.45 | 1.54 | 1.31 | 1.18 | 1.20 | 1.15 | 1.54 |
| 57 | 0.28 | 0.33 | 0.48 | 0.44 | 0.49 | 0.25 | 0.29 | 0.45 | 0.48 |
| 58 | 7.99 | 6.79 | 5.91 | 9.20 | 6.53 | 10.77 | 12.87 | 7.32 | 8.33 |

Table 224. Provided are the values of each of the parameters (as described above) measured in wheat accessions ("L" = Line). Growth conditions are specified in the experimental procedure section.
"NA" = not available.
"Corr."—correlation.

TABLE 225

Measured parameters in additional Wheat accessions under normal growth conditions

| Line/ Corr. ID | L-68 | L-74 | L-75 | L-87 | L-100 | L-107 | L-118 | L-129 | L-134 |
|---|---|---|---|---|---|---|---|---|---|
| 1 | 2.60 | 1.93 | 3.33 | 2.50 | 3.03 | 4.15 | 2.45 | 2.43 | 1.87 |
| 2 | 2.23 | 2.13 | 3.16 | 2.72 | 3.67 | 4.25 | 3.30 | 3.70 | 3.37 |
| 3 | 2.75 | 1.67 | 1.83 | 2.40 | 3.05 | 2.27 | 2.09 | 2.31 | 1.94 |
| 4 | 5.65 | 3.33 | 5.38 | 6.08 | 9.56 | 8.83 | 6.00 | 6.74 | 4.47 |
| 5 | 10.70 | 8.70 | 9.20 | 9.10 | 14.70 | 12.60 | 12.10 | 10.70 | 10.80 |
| 6 | 7.87 | 4.24 | 6.82 | 6.54 | 10.43 | 10.67 | 5.09 | 6.64 | 4.07 |
| 7 | 9.56 | 11.60 | 6.98 | 5.83 | 5.71 | 5.47 | 8.46 | 6.10 | 9.67 |
| 8 | 8.22 | 9.98 | 6.00 | 5.01 | 4.91 | 4.71 | 7.28 | 5.25 | 8.31 |
| 9 | 2.94 | 4.30 | 2.15 | 1.82 | 3.27 | 2.91 | 2.43 | 1.77 | 4.20 |
| 10 | 75.70 | 93.00 | 61.60 | 64.40 | 72.70 | 84.80 | 63.30 | 55.20 | 83.90 |
| 11 | 0.157 | 0.063 | 0.184 | 0.133 | 0.181 | 0.154 | 0.113 | 0.152 | 0.082 |
| 12 | 1.97 | 2.39 | 1.29 | 1.28 | 1.36 | 0.80 | 1.63 | 1.03 | 2.13 |
| 13 | 3.53 | 1.52 | 1.17 | 1.18 | 2.27 | 1.97 | 1.91 | 1.08 | 1.48 |
| 14 | 0.135 | 0.119 | 0.127 | 0.131 | 0.149 | 0.138 | 0.093 | 0.129 | 0.135 |

TABLE 225-continued

Measured parameters in additional Wheat accessions under normal growth conditions

| Line/ Corr. ID | L-68 | L-74 | L-75 | L-87 | L-100 | L-107 | L-118 | L-129 | L-134 |
|---|---|---|---|---|---|---|---|---|---|
| 15 | 0.217 | 0.204 | 0.216 | 0.247 | 0.254 | 0.282 | 0.248 | 0.240 | 0.260 |
| 16 | 0.32 | 0.27 | 0.29 | 0.31 | 0.39 | 0.35 | 0.21 | 0.30 | 0.33 |
| 17 | 5.03 | 5.35 | 3.84 | 2.99 | 5.11 | 3.82 | 6.10 | 3.99 | 6.35 |
| 18 | 2.86 | 3.17 | 1.69 | 1.71 | 2.42 | 1.55 | 2.65 | 1.94 | 3.49 |
| 19 | 0.57 | 0.53 | 0.57 | 0.66 | 0.67 | 0.74 | 0.65 | 0.60 | 0.69 |
| 20 | 140.00 | 128.00 | 124.00 | 137.00 | 139.40 | 148.50 | 137.40 | 137.60 | 131.00 |
| 21 | 1088.00 | 951.80 | 897.60 | 1062.50 | 1085.10 | 1188.20 | 1062.50 | 1067.60 | 985.80 |
| 22 | 168.00 | 162.50 | 154.60 | 167.00 | 169.40 | 175.30 | 167.80 | 172.00 | 158.80 |
| 23 | 45.50 | 62.50 | 32.80 | 34.00 | 34.00 | 25.60 | 42.00 | 26.70 | 51.20 |
| 24 | 2.40 | 3.14 | 2.05 | 1.92 | 1.95 | 1.53 | 2.29 | 1.56 | 2.84 |
| 25 | 21.00 | 21.50 | 18.80 | 18.60 | 19.90 | 19.90 | 20.20 | 19.60 | 20.60 |
| 26 | 177.00 | 170.50 | 166.80 | 175.80 | 182.80 | 182.20 | 179.40 | 183.40 | 173.00 |
| 27 | 1595.50 | 1471.30 | 1405.80 | 1571.80 | 1705.00 | 1694.10 | 1640.80 | 1716.00 | 1519.90 |
| 28 | 41.00 | 30.90 | 38.70 | 41.80 | 42.20 | 39.80 | 31.50 | 36.10 | 33.00 |
| 29 | 19.00 | 20.10 | 16.10 | 17.60 | 17.50 | 18.70 | 18.40 | 17.10 | 18.00 |
| 30 | 90.50 | 93.40 | 85.90 | 94.90 | 88.20 | 94.70 | 91.20 | 88.60 | 87.20 |
| 31 | 2.93 | 3.05 | 2.46 | 2.62 | 2.74 | 2.59 | 2.59 | 2.60 | 2.45 |
| 32 | 27.90 | 22.60 | 18.80 | 22.30 | 25.00 | 21.20 | 16.80 | 19.30 | 17.90 |
| 33 | 104.50 | 77.30 | 119.40 | 133.30 | 136.30 | 124.30 | 106.90 | 123.80 | 83.30 |
| 34 | 2.05 | 1.83 | 2.71 | 1.69 | 2.57 | 3.18 | 2.57 | 2.46 | 2.30 |
| 35 | 8.41 | 11.66 | 7.54 | 7.32 | 7.94 | 8.70 | 11.24 | 6.24 | 12.12 |
| 36 | 4.38 | 4.88 | 3.69 | 4.13 | 4.02 | 3.70 | 4.13 | 3.98 | 3.22 |
| 37 | 56.20 | 68.20 | 32.80 | 34.30 | 33.60 | 31.60 | 49.80 | 35.90 | 56.90 |
| 38 | 9.11 | 12.10 | 8.49 | 9.13 | 8.85 | 9.91 | 9.88 | 7.66 | 10.19 |
| 39 | 9.99 | 9.64 | 7.43 | 9.17 | 9.41 | 10.70 | 10.89 | 9.54 | 10.59 |
| 40 | 1.09 | 1.13 | 1.08 | 0.91 | 1.04 | 1.00 | 1.33 | 0.94 | 1.45 |
| 41 | 98.30 | 147.70 | 116.00 | 164.80 | 155.00 | 163.80 | 399.10 | 138.20 | 127.30 |
| 42 | 1.34 | 1.45 | 1.29 | 1.12 | 1.20 | 1.19 | 1.61 | 1.12 | 1.71 |
| 43 | 43.70 | 39.70 | 40.90 | 38.60 | 40.90 | 31.20 | 40.40 | 39.10 | 42.30 |
| 44 | 0.185 | 0.189 | 0.179 | 0.172 | 0.173 | 0.149 | 0.174 | 0.165 | 0.194 |
| 45 | 76.20 | 77.80 | 84.10 | 75.80 | 75.40 | 78.40 | 75.40 | 77.40 | 77.10 |
| 46 | 0.660 | 0.701 | 0.658 | 0.677 | 0.685 | 0.664 | 0.640 | 0.658 | 0.734 |
| 47 | 1.70 | 1.76 | 1.68 | 1.69 | 1.71 | 1.62 | 1.65 | 1.66 | 1.82 |
| 48 | 0.38 | 0.36 | 0.36 | 0.34 | 0.34 | 0.30 | 0.37 | 0.34 | 0.36 |
| 49 | 28.00 | 34.50 | 30.00 | 30.00 | 30.00 | 26.30 | 30.40 | 34.40 | 27.00 |
| 50 | 336.80 | 377.80 | 358.90 | 344.20 | 366.90 | 371.80 | 358.40 | 432.70 | 282.90 |
| 51 | 0.35 | 0.34 | 0.22 | 0.20 | 0.20 | 0.21 | 0.28 | 0.18 | 0.38 |
| 52 | 98.50 | 52.60 | 63.00 | 42.70 | 70.50 | 61.50 | 82.40 | 57.60 | 65.40 |
| 53 | 2.21 | 1.31 | 2.04 | 2.13 | 2.44 | 2.21 | 1.89 | 2.43 | 1.84 |
| 54 | 0.144 | 0.128 | 0.121 | 0.073 | 0.123 | 0.110 | 0.137 | 0.078 | 0.120 |
| 55 | 0.070 | 0.071 | 0.043 | 0.043 | 0.048 | 0.036 | 0.054 | 0.031 | 0.064 |
| 56 | 1.61 | 1.15 | 1.33 | 1.29 | 1.41 | 1.24 | 1.33 | 1.16 | 1.36 |
| 57 | 0.38 | 0.50 | 0.38 | 0.26 | 0.24 | 0.20 | 0.34 | 0.24 | 0.44 |
| 58 | 11.40 | 5.76 | 8.00 | 7.72 | 12.70 | 12.64 | 6.99 | 7.72 | 5.55 |

Table 225. Provided are the values of each of the parameters (as described above) measured in wheat accessions ("L" = Line). Growth conditions are specified in the experimental procedure section.
"NA" = not available.
"Corr."—correlation.

TABLE 226

Measured parameters in additional Wheat accessions under normal growth conditions

| Line/ Corr. ID | L-142 | L-146 | L-159 | L-161 | L-171 | L-173 | L-175 | L-178 | L-179 | L-183 |
|---|---|---|---|---|---|---|---|---|---|---|
| 1 | 2.76 | 2.83 | 4.22 | 2.53 | 2.65 | 4.60 | 3.30 | NA | 2.32 | 2.12 |
| 2 | 3.13 | 3.33 | 4.67 | 2.68 | 2.52 | 3.34 | 2.87 | 2.72 | 2.51 | 2.41 |
| 3 | 2.09 | 1.93 | 2.05 | 2.68 | 1.60 | 2.12 | 1.80 | 1.84 | 2.31 | 2.09 |
| 4 | 6.27 | 5.36 | 7.86 | 6.62 | 3.72 | 5.07 | 4.98 | 4.93 | 5.26 | 4.41 |
| 5 | 9.40 | 7.80 | 14.30 | 10.30 | 9.60 | 7.90 | 12.00 | 11.10 | 10.30 | 10.00 |
| 6 | 8.14 | 6.30 | 8.22 | 8.22 | 5.45 | 11.56 | 9.43 | NA | 6.90 | 3.56 |
| 7 | 6.14 | 5.48 | 5.98 | 6.78 | 11.49 | 5.76 | 12.03 | 11.23 | 10.80 | 11.16 |
| 8 | 5.28 | 4.71 | 5.14 | 5.83 | 9.88 | 4.95 | 10.35 | 9.65 | 9.29 | 9.60 |
| 9 | 2.87 | 2.05 | 2.73 | 2.81 | 5.94 | 3.02 | 3.39 | 5.55 | 2.88 | 2.58 |
| 10 | 70.30 | 63.50 | 68.00 | 75.90 | 96.50 | 71.10 | 96.10 | 95.70 | 74.60 | 80.20 |
| 11 | 0.145 | 0.129 | 0.151 | 0.131 | 0.070 | 0.205 | 0.124 | NA | 0.167 | 0.078 |
| 12 | 1.22 | 1.06 | 1.38 | 1.16 | 2.03 | 0.93 | 2.05 | 1.98 | 2.33 | 2.13 |
| 13 | 2.66 | 1.51 | 1.73 | 1.31 | 1.39 | 2.58 | 2.48 | NA | 4.89 | 2.09 |
| 14 | 0.137 | 0.147 | 0.125 | 0.136 | 0.125 | 0.139 | 0.126 | 0.120 | 0.127 | 0.128 |
| 15 | 0.259 | 0.208 | 0.207 | 0.242 | 0.199 | 0.259 | 0.233 | 0.213 | 0.206 | 0.201 |
| 16 | 0.32 | 0.37 | 0.30 | 0.33 | 0.29 | 0.35 | 0.30 | 0.28 | 0.30 | 0.31 |
| 17 | 3.15 | 2.42 | 6.40 | 3.65 | 5.91 | 2.87 | 7.03 | 6.20 | 5.47 | 5.55 |

TABLE 226-continued

Measured parameters in additional Wheat accessions under normal growth conditions

| Line/ Corr. ID | L-142 | L-146 | L-159 | L-161 | L-171 | L-173 | L-175 | L-178 | L-179 | L-183 |
|---|---|---|---|---|---|---|---|---|---|---|
| 18 | 1.64 | 1.41 | 1.90 | 2.03 | 2.71 | 1.61 | 2.72 | 2.62 | 3.05 | 2.92 |
| 19 | 0.69 | 0.62 | 0.54 | 0.64 | 0.51 | 0.67 | 0.62 | 0.55 | 0.52 | 0.52 |
| 20 | 141.80 | 137.00 | 127.80 | 140.00 | 116.00 | 140.60 | 127.80 | 128.00 | 140.00 | 131.00 |
| 21 | 1109.90 | 1062.50 | 948.80 | 1088.00 | 808.00 | 1099.70 | 948.80 | 951.80 | 1088.00 | 987.60 |
| 22 | 169.20 | 168.60 | 154.20 | 171.60 | 154.00 | 166.60 | 161.30 | 160.20 | 159.70 | 163.40 |
| 23 | 27.10 | 25.30 | 31.70 | 30.50 | 44.60 | 25.50 | 44.90 | 47.70 | 49.20 | 45.90 |
| 24 | 1.66 | 1.47 | 1.94 | 1.67 | 2.55 | 1.29 | 2.46 | 2.69 | 2.54 | 2.40 |
| 25 | 18.00 | 18.70 | 18.00 | 22.40 | 20.00 | 20.70 | 20.50 | 19.50 | 21.00 | 22.00 |
| 26 | 179.80 | 178.60 | 170.20 | 177.00 | 163.00 | 178.60 | 168.30 | 170.00 | 171.70 | 174.60 |
| 27 | 1647.30 | 1625.40 | 1468.00 | 1595.50 | 1336.20 | 1624.50 | 1429.90 | 1462.00 | 1492.90 | 1548.00 |
| 28 | 37.40 | 42.70 | 39.00 | 45.10 | 39.30 | 40.00 | 40.10 | NA | 42.70 | 38.50 |
| 29 | 16.50 | 17.20 | 16.40 | 18.20 | 17.60 | 19.10 | 18.20 | 17.70 | 19.40 | 19.10 |
| 30 | 91.90 | 91.70 | 90.70 | 81.00 | 87.80 | 92.40 | 88.90 | 90.60 | 92.30 | 87.20 |
| 31 | 2.57 | 2.66 | 2.51 | 2.94 | 2.89 | 2.21 | 2.75 | NA | 3.26 | 3.07 |
| 32 | 19.40 | 23.80 | 19.30 | 31.00 | 26.00 | 15.80 | 23.90 | NA | 35.90 | 28.40 |
| 33 | 128.30 | 129.50 | 113.10 | 139.10 | 90.70 | 125.00 | 104.30 | NA | 110.40 | 99.80 |
| 34 | 1.96 | 2.01 | 4.12 | 2.27 | 2.37 | 2.32 | 2.73 | 2.49 | 2.17 | 2.04 |
| 35 | 6.77 | 7.26 | 8.23 | 6.68 | 10.68 | 8.09 | 12.48 | 11.40 | 11.78 | 12.75 |
| 36 | 3.90 | 4.05 | 3.82 | 4.27 | 4.50 | 3.40 | 4.14 | NA | 4.56 | 4.31 |
| 37 | 36.10 | 32.20 | 35.20 | 39.90 | 67.60 | 33.90 | 70.80 | 66.00 | 63.50 | 65.60 |
| 38 | 7.83 | 9.21 | 9.68 | 8.05 | 9.83 | 10.47 | 9.95 | 8.60 | 10.92 | 11.10 |
| 39 | 8.42 | 9.98 | 8.95 | 9.72 | 9.69 | 10.21 | 9.08 | 9.02 | 10.75 | 10.95 |
| 40 | 1.00 | 0.91 | 1.02 | 0.96 | 1.31 | 0.88 | 1.48 | 1.58 | 1.28 | 1.36 |
| 41 | 145.80 | 147.90 | 113.70 | 179.30 | 116.70 | 123.50 | 131.40 | 118.00 | 96.10 | 116.90 |
| 42 | 1.20 | 1.12 | 1.21 | 1.17 | 1.64 | 1.06 | 1.79 | 1.87 | 1.60 | 1.71 |
| 43 | 46.40 | 42.30 | 44.50 | 38.10 | 48.00 | 40.00 | 47.30 | 43.50 | 48.30 | 47.40 |
| 44 | 0.188 | 0.176 | 0.197 | 0.174 | 0.207 | 0.176 | 0.201 | 0.187 | 0.212 | 0.203 |
| 45 | 76.60 | 78.30 | 79.30 | 81.20 | 86.40 | 80.30 | 86.00 | 86.80 | 85.30 | 87.00 |
| 46 | 0.698 | 0.692 | 0.736 | 0.674 | 0.705 | 0.694 | 0.700 | 0.659 | 0.757 | 0.710 |
| 47 | 1.76 | 1.72 | 1.83 | 1.69 | 1.81 | 1.72 | 1.80 | 1.71 | 1.89 | 1.81 |
| 48 | 0.36 | 0.34 | 0.35 | 0.34 | 0.39 | 0.34 | 0.38 | 0.38 | 0.37 | 0.38 |
| 49 | 27.80 | 31.60 | 26.40 | 31.60 | 38.00 | 26.00 | 33.70 | 32.20 | 19.20 | 32.40 |
| 50 | 343.40 | 372.60 | 302.20 | 405.10 | 448.50 | 300.40 | 363.40 | 343.80 | 197.70 | 356.40 |
| 51 | 0.23 | 0.17 | 0.23 | 0.22 | 0.30 | 0.23 | 0.36 | 0.35 | 0.57 | 0.35 |
| 52 | 40.30 | 37.00 | 120.90 | 46.00 | 84.40 | 77.50 | 68.60 | 84.20 | 101.50 | 74.20 |
| 53 | 1.81 | 2.12 | 1.93 | 2.21 | 1.64 | 2.31 | 1.51 | 1.71 | 2.01 | 1.73 |
| 54 | 0.086 | 0.067 | 0.220 | 0.089 | 0.127 | 0.088 | 0.153 | 0.154 | 0.269 | 0.136 |
| 55 | 0.044 | 0.033 | 0.053 | 0.039 | 0.054 | 0.036 | 0.059 | 0.062 | 0.123 | 0.066 |
| 56 | 1.73 | 1.34 | 1.70 | 1.22 | 1.26 | 1.56 | 1.41 | 1.36 | 2.62 | 1.48 |
| 57 | 0.26 | 0.27 | 0.40 | 0.26 | 0.50 | 0.27 | 0.47 | 0.45 | 0.44 | 0.44 |
| 58 | 10.81 | 7.81 | 9.95 | 9.53 | 6.71 | 14.15 | 11.90 | NA | 11.79 | 5.65 |

Table 226. Provided are the values of each of the parameters (as described above) measured in wheat accessions ("L" = Line). Growth conditions are specified in the experimental procedure section.
"NA" = not available.
"Corr."—correlation.

TABLE 227

Correlation between the expression level of selected genes of some embodiments of the invention in various tissues and the phenotypic performance under normal across wheat accessions

| Gene Name | R | P value | Exp. set | Corr. ID | Gene Name | R | P value | Exp. set | Corr. ID |
|---|---|---|---|---|---|---|---|---|---|
| LBY461 | 0.71 | 9.23E−05 | 2 | 44 | LBY461 | 0.70 | 1.73E−04 | 2 | 42 |
| LBY461 | 0.74 | 3.39E−05 | 2 | 57 | | | | | |

Table 227. Provided are the correlations (R) between the genes expression levels in various tissues ("Exp. Set"—Expression set specified in Table 222) and the phenotypic performance measured (Tables 224-226) according to the correlation vectors ("Corr. ID"—correlation vector ID) specified in Table 223.
"R" = Pearson correlation coefficient;
"P" = p value.

Example 20

Production of Wheat Transcriptome and High Throughput Correlation Analysis Using 60K Wheat Oligonucleotide Micro-Array In order to produce a high throughput correlation analysis comparing between plant phenotype and gene expression level, the present inventors utilized a Wheat oligonucleotide micro-array, produced by Agilent Technologies [chem. (dot) agilent (dot) com/Scripts/PDS (dot) asp?lPage=50879]. The array oligonucleotide represents about 60K Wheat genes and transcripts. In order to define correlations between the levels of RNA expression and yield or vigor related parameters, various plant characteristics of 14 different Wheat accessions were analyzed. Among them, 10 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

14 Wheat accessions in 5 repetitive blocks, each containing 8 plants per pot were grown at net house. Three different treatments were applied: plants were regularly fertilized and watered during plant growth until harvesting under normal conditions [as recommended for commercial growth, plants were irrigated 2-3 times a week, and fertilization was given in the first 1.5 months of the growth period], under low Nitrogen (70% percent less Nitrogen) or under drought stress (cycles of drought and re-irrigating were conducted throughout the whole experiment, overall 40% less water were given in the drought treatment).

Analyzed Wheat tissues—Six tissues at different developmental stages [leaf, lemma, spike, stem, root tip and adventitious root] representing different plant characteristics, were sampled and RNA was extracted as described above. Each micro-array expression information tissue type has received a Set ID as summarized in Table 228 below.

TABLE 228

Wheat transcriptome expression sets under normal conditions

| Expression Set | Set ID |
|---|---|
| Adv root, grown under Normal conditions, first tillering stage | 1 + 10 |
| Basal lemma, grown under Normal conditions, grain filling stage | 2 + 11 |
| Basal spike, grown under Normal conditions, flowering stage | 3 + 12 |
| Basal spike, grown under Normal conditions, grain filling stage | 4 + 13 |
| Leaf, grown under Normal conditions, flowering stage | 5 + 14 |
| Leaf, grown under Normal conditions, grain filling stage | 6 + 15 |
| Root tip, grown under Normal conditions, first tillering stage | 7 + 16 |
| Stem grown under Normal conditions, flowering stage | 8 + 17 |
| Stem, grown under Normal conditions, grain filling stage | 9 + 18 |

Table 228. Provided are the wheat transcriptome expression sets under normal conditions.

TABLE 229

Wheat transcriptome expression sets under low N conditions

| Expression Set | Set ID |
|---|---|
| Adv root, grown under Low N conditions, first tillering stage | 1 + 10 |
| Basal spike, grown under Low N conditions, flowering stage | 2 + 11 |
| Basal spike, grown under Low N conditions, grain filling stage | 3 + 12 |
| Leaf, grown under Low N conditions, flowering stage | 4 + 13 |
| Leaf, grown under Low N conditions, grain filling stage | 5 + 14 |
| Root tip, grown under Low N conditions, first tillering stage | 6 + 15 |
| Stem, grown under Low N conditions, flowering stage | 7 + 16 |
| Stem grown under Low N conditions, grain filling stage | 8 + 17 |

Table 229. Provided are the wheat transcriptome expression sets under low N conditions.

TABLE 230

Wheat transcriptome expression sets low N vs. normal conditions

| Expression Set | Set ID |
|---|---|
| Adv root; grown under Low N vs. normal conditions, first tillering stage | 1 + 10 |
| Basal spike; grown under Low N vs. normal conditions, flowering stage | 2 + 11 |
| Basal spike; grown under Low N vs. normal conditions, grain filling stage | 3 + 12 |
| Leaf; grown under Low N vs. normal conditions, flowering stage | 4 + 13 |
| Leaf; grown under Low N vs. normal conditions, grain filling stage | 5 + 14 |
| Root tip; grown under Low N vs. normal conditions, first tillering stage | 6 + 15 |
| Stem; grown under Low N vs. normal conditions, flowering stage | 7 + 16 |
| Stem; grown under Low N vs. normal conditions, grain filling stage | 8 + 17 |

Table 230. Provided are the wheat transcriptome expression sets at low N versus (vs.) normal conditions.

Wheat yield components and vigor related parameters assessment—Plants were phenotyped on a daily basis following the parameters listed in Tables 231-232 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight—total weight of the vegetative portion above ground (excluding roots) after drying at 70° C. in oven for 48 hours at two time points at the Vegetative growth (30 days after sowing) and at harvest.

Spikelet per spike—number of spikelets per spike was counted.

Root/Shoot Ratio—The Root/Shoot Ratio is calculated using Formula 22 described above.

Total No. of tillers—all tillers were counted per plot at two time points at the Vegetative growth (30 days after sowing) and at harvest.

Node number—number of nodes in the main stem.

Percent of reproductive tillers—was calculated based on Formula 26 (above).

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area ($cm^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains.

Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—Relative water content (RWC) is calculated according to Formula 1.

Tiller abortion rate (HD to F)—difference between tiller number at heading and tiller number at flowering divided by tiller number at heading.

Tiller abortion rate—difference between tiller number at harvest and tiller number at flowering divided by tiller number at flowering.

Grain N (H)—% N content of dry matter in the grain at harvest.

Head N (GF)—% N content of dry matter in the head at grain filling.

Total shoot N—calculated as the % N content multiplied by the weight of plant shoot.

Total grain N—calculated as the % N content multiplied by the weight of plant grain yield.

NUE [kg/kg] (N use efficiency)—was calculated based on Formula 51.

NUpE [kg/kg] (N uptake efficiency)—was calculated based on Formula 52.

Grain NUtE (N utilization efficiency)—was calculated based on Formula 55.

Total NUtE—was calculated based on Formula 53.

Stem Volume—was calculated based on Formula 50.

Stem density—was calculated based on Formula 54.

NHI (N harvest index)—was calculated based on Formula 56.

BPE (Biomass production efficiency)—was calculated based on Formula 57.

Grain fill duration—the difference between number of days to maturity and number of days to flowering.

Harvest Index (for Wheat)—The harvest index was calculated using Formula 58 described above.

Growth rate: the growth rate (GR) of Plant Height (Formula 3 described above), SPAD (Formula 4 described above) and number of tillers (Formula 5 described above) were calculated with the indicated Formulas.

Specific N absorption—N absorbed per root biomass.

Specific root length—root biomass per root length.

Ratio low N/Normal: Represents ratio for the specified parameter of Low N condition results divided by Normal conditions results (maintenance of phenotype under Low N in comparison to normal conditions).

Data parameters collected are summarized in Tables 231-232, herein below.

TABLE 231

Wheat correlated parameters under normal conditions (vectors)

| Correlation set | Correlation ID |
|---|---|
| Root/Shoot [ratio] | 1 |
| SPAD early-mid grain filling [SPAD units] | 2 |
| SPAD flowering [SPAD units] | 3 |
| SPAD mid-late grain filling [SPAD] | 4 |
| specific N absorption [mg/gr.] | 5 |
| specific root length [gr./cm] | 6 |
| Spike Area [$cm^2$] | 7 |
| Spike length [cm] | 8 |
| Spike Perimeter [cm] | 9 |
| Spike width [cm] | 10 |
| Spikelets per spike [number] | 11 |
| Tiller abortion rate [ratio] | 12 |
| tiller abortion rate (HD to F) | 13 |
| Tillering (Flowering) [number] | 14 |
| Tillering (Heading) [number] | 15 |
| Tillering (Tillering) [number] | 16 |
| Total dry matter [gr.] | 17 |
| total grain N [mg] | 18 |
| total NUtE [ratio] | 19 |
| total shoot N [mg] | 20 |
| Total Leaf Area [$cm^2$] | 21 |
| Vegetative DW (Harvest) [gr.] | 22 |
| Avr spike DW (flowering) [gr.] | 23 |
| Avr spike DW (SS) [gr.] | 24 |
| Avr spike weight (harvest) [gr.] | 25 |
| BPE [ratio] | 26 |
| Fertile spikelets ratio [ratio] | 27 |
| field awns length [cm] | 28 |
| Grain area [$mm^2$] | 29 |
| Grain C/N [ratio] | 30 |
| Grain fill duration [days] | 31 |
| grain NUtE [ratio] | 32 |
| grain protein [%] | 33 |
| 1000 grain weight [gr.] | 34 |
| Grains per plant [number] | 35 |
| Grains per spike [number] | 36 |
| Grains per spikelet [number] | 37 |
| Grains weight per plant [gr.] | 38 |
| Grains weight per spike [gr.] | 39 |
| Harvest index | 40 |
| Leaf Area [$cm^2$] | 41 |
| Leaf Average Width [cm] | 42 |
| Leaf Length [cm] | 43 |
| Leaf Perimeter [cm] | 44 |
| Leaves num at tillering [number] | 45 |
| Leaves num flowering [number] | 46 |

TABLE 231-continued

Wheat correlated parameters under normal conditions (vectors)

| Correlation set | Correlation ID |
| --- | --- |
| N use efficiency [ratio] | 47 |
| NHI [ratio] | 48 |
| Node Num [number] | 49 |
| Num days Heading [days] | 50 |
| Num days to anthesis [days] | 51 |
| NupE [ratio] | 52 |
| Peduncle length [cm] | 53 |
| Peduncle thickness [mm] | 54 |
| peduncle volume [cm$^3$] | 55 |
| Plant height [cm] | 56 |
| Root length [cm] | 57 |
| Roots DW [gr.] | 58 |
| RWC [%] | 59 |
| Seminal roots [number] | 60 |
| Shoot C/N [ratio] | 61 |
| Shoot DW [gr] | 62 |

Table 231. Provided are the wheat correlated parameters.
"TP" = time point;
"DW" = dry weight;
"FW" = fresh weight;
"Low N" = Low Nitrogen;
"Relative water content [percent];
"num" = number.
"gr." = grams;
"cm" = centimeter;
"Avr" = average;
"RGR' = relative growth rate;
"BPE" = biomass production efficiency;
"NHI" = Nitrogen harvest index;
"NupE" = nitrogen uptake efficiency;
"NutE" = nitrogen utilization efficiency;
"SPAD" = chlorophyll levels;
"F" = flowering stage;
"H" = heading stage;
"N" = nitrogen.

TABLE 232

Wheat correlated parameters under low N conditions (vectors)

| Correlation set | Correlation ID |
| --- | --- |
| Grains weight per plant [gr.] | 1 |
| Grains weight per spike [gr.] | 2 |
| Avr spike weight (harvest) [gr.] | 3 |
| Avr spike DW (SS) [gr.] | 4 |
| Avr spike DW (flowering) [gr.] | 5 |
| Spikelets per spike [number] | 6 |
| Grains per plant [number] | 7 |
| Grains per spike [number] | 8 |
| Grains per spikelet [number] | 9 |
| Fertile spikelets ratio [ratio] | 10 |
| Grain area [mm$^2$] | 11 |
| Harvest index | 12 |
| Spike Area [cm$^2$] | 13 |
| Spike length [cm] | 14 |
| Spike Perimeter [cm] | 15 |
| Spike width [cm] | 16 |
| Grain fill duration [days] | 17 |
| Total dry matter [gr.] | 18 |
| Tillering (Tillering) [number] | 19 |
| Tillering (Heading) [number] | 20 |
| Tillering (Flowering) [number] | 21 |
| tiller abortion rate (HD to F) | 22 |
| Tiller abortion rate [ratio] | 23 |
| Root length [cm] | 24 |
| Seminal roots [number] | 25 |
| Roots DW [gr] | 26 |
| specific root length [gr./cm] | 27 |
| Shoot DW [gr] | 28 |
| Vegetative DW (Harvest) [gr.] | 29 |
| Root/Shoot [ratio] | 30 |
| Total Leaf Area [cm$^2$] | 31 |

TABLE 232-continued

Wheat correlated parameters under low N conditions (vectors)

| Correlation set | Correlation ID |
| --- | --- |
| Leaf Area [cm$^2$] | 32 |
| Leaf Average Width [cm] | 33 |
| Leaf Length [cm] | 34 |
| Leaf Perimeter [cm] | 35 |
| Leaves num at tillering [number] | 36 |
| Leaves num flowering [number] | 37 |
| SPAD early-mid grain filling [SPAD units] | 38 |
| SPAD flowering [SPAD units] | 39 |
| SPAD mid-late grain filling [SPAD] | 40 |
| RWC [%] | 41 |
| Peduncle length [cm] | 42 |
| Peduncle thickness [mm] | 43 |
| peduncle volume [cm$^3$] | 44 |
| Plant height [cm] | 45 |
| Node Num [number] | 46 |
| N use efficiency [ratio] | 47 |
| total NUtE [ratio] | 48 |
| grain NUtE [ratio] | 49 |
| NupE [ratio] | 50 |
| NHI [ratio] | 51 |
| BPE [ratio] | 52 |
| specific N absorption [mg/gr.] | 53 |
| total grain N [mg] | 54 |
| total shoot N [mg] | 55 |
| Shoot C/N [ratio] | 56 |
| Grain C/N [ratio] | 57 |
| grain protein [%] | 58 |
| 1000 grain weight [gr.] | 59 |
| field awns length [cm] | 60 |
| Num days Heading [days] | 61 |
| Num days to anthesis [days] | 62 |

Table 232. Provided are the wheat correlated parameters.
"TP" = time point;
"DW" = dry weight;
"FW" = fresh weight;
"Low N" = Low Nitrogen;
"Relative water content [percent];
"num" = number.
"gr." = grams;
"cm" = centimeter;
"Avr" = average;
"RGR' = relative growth rate;
"BPE" = biomass production efficiency;
"NHI" = Nitrogen harvest index;
"NupE" = nitrogen uptake efficiency;
"NutE" = nitrogen utilization efficiency;
"SPAD" = chlorophyll levels;
"F" = flowering stage;
"H" = heading stage;
"N" = nitrogen.

TABLE 233

Wheat correlated parameters under low N conditions vs. normal (vectors)

| Correlated parameter with | Correlation ID |
| --- | --- |
| 1000 grain weight [gr.] | 1 |
| BPE [ratio] | 2 |
| Fertile spikelets ratio [ratio] | 3 |
| Grain area [mm$^2$] | 4 |
| Grain fill duration [days] | 5 |
| Grains per spike [number] | 6 |
| Grains per spikelet [number] | 7 |
| Grains weight per spike [gr.] | 8 |
| N use efficiency [ratio] | 9 |
| NHI [ratio] | 10 |
| NupE [ratio] | 11 |
| Peduncle thickness [mm] | 12 |
| Root length [cm] | 13 |
| SPAD early-mid grain filling [SPAD unit] | 14 |
| SPAD flowering [SPAD unit] | 15 |

TABLE 233-continued

Wheat correlated parameters under low N conditions vs. normal (vectors)

| Correlated parameter with | Correlation ID |
|---|---|
| Seminal roots [number] | 16 |
| Shoot C/N [ratio] | 17 |
| Spikelets per spike [number] | 18 |
| Tiller abortion rate [ratio] | 19 |
| Grain C/N ratio | 20 |
| Grain NUtE [ratio] | 21 |
| Grain protein [%] | 22 |
| Peduncle volume [cm³] | 23 |
| Specific N absorption [mg/gr.] | 24 |
| Specific root length [gr./cm] | 25 |
| Tiller abortion rate (hd to F) [ratio] | 26 |
| Total NUtE [ratio] | 27 |
| Total grain N [mg] | 28 |
| Total shoot N [mg] | 29 |

Table 233. Provided are the wheat correlated parameters.
"TP" = time point;
"DW" = dry weight;
"FW" = fresh weight;
"Low N" = Low Nitrogen;
"Relative water content [percent];
"num" = number.
"gr." = grams;
"cm" = centimeter;
"Avr" = average;
"RGR" = relative growth rate;
"BPE" = biomass production efficiency;
"NHI" = Nitrogen harvest index;
"NupE" = nitrogen uptake efficiency;
"NutE" = nitrogen utilization efficiency;
"SPAD" = chlorophyll levels;
"F" = flowering stage;
"h" = heading stage;
"N" = nitrogen.

Experimental Results

Fourteen different Wheat accessions were grown and characterized for different parameters as described above. Tables 231-233 describe the wheat correlated parameters. The average for each of the measured parameters was calculated using the JMP software and values are summarized in Tables 234-239 below. Subsequent correlation analysis between the various transcriptome sets and the average parameters was conducted (Tables 240-241). Follow, results were integrated to the database.

TABLE 234

Measured parameters of correlation IDs in wheat accessions under normal conditions

| Line/Corr. ID | Line-1 | Line-2 | Line-3 | Line-4 | Line-5 | Line-6 | Line-7 |
|---|---|---|---|---|---|---|---|
| 1 | 0.72 | 3.47 | 2.30 | 0.55 | 1.18 | 0.74 | 0.92 |
| 2 | 37.30 | 28.30 | NA | 38.70 | NA | 46.50 | NA |
| 3 | 38.80 | 31.10 | 43.30 | 40.30 | 45.50 | 44.90 | NA |
| 4 | 36.00 | NA | NA | 37.20 | NA | NA | NA |
| 5 | 146.30 | 2391.40 | 1626.20 | 201.90 | 956.20 | 367.60 | NA |
| 6 | 0.03 | 0.00 | 0.01 | 0.03 | 0.01 | 0.02 | 0.02 |
| 7 | 9.52 | 6.27 | 8.42 | 11.73 | 7.03 | 6.51 | 8.96 |
| 8 | 8.48 | 6.51 | 9.54 | 8.14 | 10.29 | 8.51 | 13.41 |
| 9 | 22.30 | 15.80 | 22.50 | 20.90 | 26.70 | 20.40 | 30.40 |
| 10 | 1.39 | 1.18 | 1.12 | 1.68 | 0.83 | 1.02 | 0.89 |
| 11 | 16.20 | 17.20 | 19.40 | 16.90 | NA | 17.40 | NA |
| 12 | 19.60 | −10.00 | 32.60 | −2.30 | 46.10 | 41.30 | NA |
| 13 | −50.00 | 19.42 | −10.71 | 23.31 | −16.67 | −42.19 | NA |
| 14 | 6.00 | 4.75 | 7.75 | 3.25 | 13.12 | 9.75 | NA |
| 15 | 4.00 | 5.89 | 7.00 | 4.24 | 11.25 | 6.86 | 2.80 |
| 16 | 2.60 | 1.80 | 3.40 | 2.00 | 3.40 | 2.40 | 2.80 |
| 17 | 75.30 | 62.90 | 109.10 | 94.90 | 128.50 | 112.20 | 72.40 |
| 18 | 120.30 | 76.20 | 102.80 | 155.50 | 122.10 | 149.10 | 0.00 |
| 19 | 0.30 | 0.25 | 0.26 | 0.26 | 0.27 | 0.34 | NA |
| 20 | 129.60 | 172.80 | 322.80 | 203.40 | 347.40 | 183.50 | 0.00 |
| 21 | 227.50 | 111.50 | NA | 176.20 | NA | 549.00 | NA |
| 22 | 23.40 | 28.70 | 57.50 | 30.60 | 71.00 | 52.20 | 61.70 |
| 23 | 5.67 | 0.28 | 0.31 | 4.28 | 0.36 | 0.24 | NA |
| 24 | 1.52 | 0.84 | 1.49 | 2.64 | 1.23 | 1.45 | 0.66 |
| 25 | 1.36 | 0.89 | 1.41 | 2.51 | 1.01 | 1.57 | 0.51 |
| 26 | 0.58 | 0.36 | 0.34 | 0.47 | 0.37 | 0.61 | NA |
| 27 | 74.10 | 73.30 | 81.70 | 88.70 | NA | 75.70 | NA |
| 28 | 6.46 | 8.45 | 6.33 | 6.56 | NA | 1.20 | NA |
| 29 | 0.20 | 0.17 | 0.15 | 0.18 | 0.17 | 0.19 | 0.14 |
| 30 | 15.40 | 14.70 | 14.90 | 15.40 | 14.50 | 13.30 | NA |
| 31 | 27.90 | 31.40 | NA | 30.00 | NA | 27.80 | NA |
| 32 | 0.04 | 0.02 | 0.01 | 0.03 | 0.01 | 0.03 | NA |
| 33 | 15.10 | 15.80 | 15.60 | 14.90 | 16.10 | 17.50 | NA |
| 34 | 24.80 | 19.30 | 11.60 | 29.70 | 9.20 | 21.00 | 22.10 |
| 35 | 94.20 | 68.70 | 122.40 | 123.90 | 151.20 | 105.10 | 16.30 |
| 36 | 19.70 | 13.30 | 22.80 | 37.20 | 21.50 | 19.40 | 6.00 |
| 37 | 2.17 | 1.26 | 2.19 | 2.93 | NA | 1.64 | NA |
| 38 | 4.54 | 2.75 | 3.76 | 5.93 | 4.32 | 4.86 | 0.48 |
| 39 | 0.95 | 0.53 | 0.70 | 1.74 | 0.59 | 0.90 | 0.13 |
| 40 | 0.48 | 0.32 | 0.28 | 0.49 | 0.26 | 0.35 | 0.05 |
| 41 | 13.80 | 19.50 | NA | 22.50 | NA | 21.60 | NA |
| 42 | 0.86 | 0.92 | NA | 1.26 | NA | 1.05 | NA |
| 43 | 19.60 | 26.80 | NA | 22.00 | NA | 25.50 | NA |
| 44 | 41.50 | 53.80 | NA | 48.90 | NA | 53.10 | NA |
| 45 | 18.00 | 13.00 | 22.50 | 11.50 | 20.80 | 18.50 | NA |
| 46 | 6.60 | 5.60 | 6.20 | 6.60 | 5.80 | 5.60 | 6.40 |
| 47 | 0.05 | 0.03 | 0.04 | 0.06 | 0.04 | 0.05 | 0.00 |
| 48 | 0.48 | 0.31 | 0.24 | 0.43 | 0.26 | 0.45 | NA |
| 49 | 4.00 | 4.43 | 4.50 | 4.94 | 4.27 | 4.56 | NA |
| 50 | 60.20 | 69.90 | 85.20 | 61.80 | 83.00 | 65.80 | 105.00 |
| 51 | 69.10 | 73.00 | 85.20 | 69.60 | 86.40 | 71.20 | 105.00 |
| 52 | 2.50 | 2.49 | 4.26 | 3.59 | 4.70 | 3.33 | NA |
| 53 | 27.30 | 30.40 | 21.20 | 30.70 | 26.10 | 34.10 | NA |
| 54 | 2.61 | 2.71 | 3.53 | 3.31 | 3.22 | 3.07 | NA |
| 55 | 1.46 | 1.76 | 2.08 | 2.64 | 2.13 | 2.51 | NA |
| 56 | 45.60 | 63.40 | 69.30 | 62.90 | 68.00 | 79.40 | NA |
| 57 | 31.10 | 16.20 | 28.10 | 34.10 | 37.80 | 26.90 | 32.00 |
| 58 | 0.89 | 0.07 | 0.20 | 1.01 | 0.36 | 0.50 | 0.63 |
| 59 | 76.30 | NA | 82.00 | 76.10 | NA | 67.30 | NA |
| 60 | 11.20 | 6.00 | 8.00 | 11.00 | 7.80 | 7.80 | 10.20 |
| 61 | 72.00 | 68.40 | 74.90 | 61.30 | 86.60 | 121.50 | NA |
| 62 | 0.64 | 0.25 | 0.46 | 0.56 | 0.43 | 0.37 | 0.58 |

Table 234. Provided are the values of each of the parameters (as described above) measured in wheat accessions (Lines). Growth conditions are specified in the experimental procedure section.
"NA" = not available.
"Corr."—correlation.

TABLE 235

Measured parameters of correlation IDs in additional wheat accessions under normal conditions

| Line/Corr. ID | Line-8 | Line-9 | Line-10 | Line-11 | Line-12 | Line-13 | Line-14 |
|---|---|---|---|---|---|---|---|
| 1 | 3.12 | 2.76 | 0.89 | 0.50 | 0.78 | 1.24 | 1.53 |
| 2 | 38.60 | 35.80 | 45.60 | 46.90 | 35.30 | NA | NA |
| 3 | 39.00 | 36.10 | 46.40 | 42.90 | 34.20 | NA | NA |
| 4 | NA | NA | NA | 46.30 | 35.80 | NA | NA |
| 5 | 1596.10 | 2273.00 | 405.00 | 133.50 | 154.30 | NA | NA |
| 6 | 0.00 | 0.00 | 0.01 | 0.03 | 0.02 | NA | NA |
| 7 | 9.88 | 9.43 | 10.33 | 12.38 | 9.53 | 7.33 | 8.14 |
| 8 | 8.11 | 8.25 | 8.57 | 9.13 | 7.46 | 9.69 | 11.24 |
| 9 | 20.80 | 20.90 | 21.30 | 22.80 | 18.70 | 22.70 | 27.00 |

TABLE 235-continued

Measured parameters of correlation IDs in additional wheat accessions under normal conditions

| Line/Corr. ID | Line-8 | Line-9 | Line-10 | Line-11 | Line-12 | Line-13 | Line-14 |
|---|---|---|---|---|---|---|---|
| 10 | 1.50 | 1.43 | 1.55 | 1.64 | 1.52 | 1.03 | 0.92 |
| 11 | 16.20 | 17.20 | 18.80 | 19.60 | 16.90 | NA | NA |
| 12 | −25.90 | 34.30 | 27.40 | 1.20 | 25.60 | NA | NA |
| 13 | 20.05 | −16.08 | −47.66 | −33.21 | −82.29 | NA | NA |
| 14 | 4.25 | 6.75 | 6.75 | 4.25 | 6.25 | NA | NA |
| 15 | 5.32 | 5.81 | 4.57 | 3.19 | 3.43 | 1.80 | 2.80 |
| 16 | 2.20 | 1.60 | 1.80 | 1.60 | 2.00 | 1.80 | 2.80 |
| 17 | 100.80 | 100.00 | 116.60 | 115.90 | 63.70 | 71.40 | 109.80 |
| 18 | 154.80 | 109.20 | 141.40 | 164.80 | 97.20 | NA | NA |
| 19 | 0.31 | 0.21 | 0.33 | 0.38 | 0.35 | NA | NA |
| 20 | 173.50 | 368.60 | 209.50 | 139.50 | 84.00 | NA | NA |
| 21 | 431.80 | 231.70 | 188.30 | 186.20 | 269.30 | NA | NA |
| 22 | 40.00 | 47.90 | 44.80 | 37.50 | 20.90 | 63.50 | 102.20 |
| 23 | 0.27 | 0.28 | 0.47 | 9.11 | 5.11 | NA | NA |
| 24 | 1.59 | 1.67 | 1.96 | 2.89 | 1.64 | 0.62 | 0.42 |
| 25 | 1.42 | 1.48 | 2.06 | 2.46 | 1.16 | 0.44 | 0.36 |
| 26 | 0.58 | 0.27 | 0.56 | 0.83 | 0.76 | NA | NA |
| 27 | 83.70 | 87.00 | 79.00 | 86.80 | 75.80 | NA | NA |
| 28 | 8.57 | 7.47 | 7.41 | 6.17 | 5.30 | NA | NA |
| 29 | 0.20 | 0.17 | 0.18 | 0.20 | 0.17 | 0.12 | 0.11 |
| 30 | 14.00 | 15.30 | 17.30 | 17.10 | 15.00 | NA | NA |
| 31 | 32.80 | NA | 29.20 | 27.10 | 26.50 | NA | NA |
| 32 | 0.03 | 0.01 | 0.03 | 0.05 | 0.04 | NA | NA |
| 33 | 16.70 | 15.10 | 13.40 | 13.60 | 15.40 | NA | NA |
| 34 | 15.10 | 13.60 | 20.70 | 33.50 | 16.70 | 12.70 | 13.40 |
| 35 | 106.80 | 103.10 | 141.60 | 139.20 | 85.40 | 13.10 | 18.60 |
| 36 | 20.00 | 23.40 | 30.00 | 34.00 | 18.50 | 5.10 | 6.60 |
| 37 | 1.83 | 1.93 | 2.30 | 2.80 | 2.28 | NA | NA |
| 38 | 5.29 | 4.11 | 6.01 | 6.91 | 3.59 | 0.40 | 2.53 |
| 39 | 0.96 | 0.93 | 1.26 | 1.69 | 0.78 | 0.09 | 0.77 |
| 40 | 0.41 | 0.33 | 0.42 | 0.48 | 0.45 | 0.03 | 0.18 |
| 41 | 25.40 | 23.30 | 20.80 | 16.30 | 13.50 | NA | NA |
| 42 | 1.17 | 1.12 | 1.19 | 1.01 | 0.83 | NA | NA |
| 43 | 27.80 | 25.90 | 21.70 | 20.00 | 19.80 | NA | NA |
| 44 | 59.00 | 54.30 | 46.10 | 42.20 | 40.90 | NA | NA |
| 45 | 11.00 | 23.80 | 19.00 | 12.50 | 18.80 | NA | NA |
| 46 | 5.40 | 5.40 | 5.20 | 6.00 | 6.20 | 5.00 | 5.00 |
| 47 | 0.05 | 0.04 | 0.06 | 0.07 | 0.04 | NA | NA |
| 48 | 0.47 | 0.23 | 0.40 | 0.54 | 0.54 | NA | NA |
| 49 | 4.21 | 4.57 | 4.94 | 4.69 | 3.94 | NA | NA |
| 50 | 68.80 | 74.30 | 68.80 | 58.90 | 57.10 | 106.20 | 77.00 |
| 51 | 71.90 | 78.00 | 72.40 | 67.30 | 68.70 | 105.00 | NA |
| 52 | 3.28 | 4.78 | 3.51 | 3.04 | 1.81 | NA | NA |
| 53 | 29.80 | 25.40 | 27.40 | 28.10 | 21.50 | NA | NA |
| 54 | 3.06 | 3.25 | 3.51 | 3.02 | 1.92 | NA | NA |
| 55 | 2.19 | 2.11 | 2.65 | 2.02 | 0.62 | NA | NA |
| 56 | 61.90 | 62.30 | 59.20 | 55.20 | 44.70 | NA | NA |
| 57 | 23.40 | 36.00 | 38.90 | 37.20 | 33.00 | 22.40 | 34.60 |
| 58 | 0.11 | 0.16 | 0.52 | 1.04 | 0.54 | 0.27 | 0.25 |
| 59 | 73.30 | NA | 70.90 | 80.70 | 74.90 | NA | NA |
| 60 | 6.00 | 6.20 | 8.20 | 10.80 | 7.60 | 6.60 | 7.80 |
| 61 | 95.70 | 54.20 | 88.40 | 110.30 | 103.10 | NA | NA |
| 62 | 0.34 | 0.45 | 0.46 | 0.52 | 0.43 | 0.33 | 0.39 |

Table 235. Provided are the values of each of the parameters (as described above) measured in wheat accessions (Lines). Growth conditions are specified in the experimental procedure section.
"NA" = not available.
"Corr."—correlation.

TABLE 236

Measured parameters of correlation IDs in wheat accessions under low N conditions

| Line/Corr. ID | Line-1 | Line-2 | Line-3 | Line-4 | Line-5 | Line-6 | Line-7 |
|---|---|---|---|---|---|---|---|
| 1 | 3.43 | 2.50 | 2.98 | 3.29 | 2.54 | 2.93 | 1.26 |
| 2 | 1.06 | 0.75 | 1.22 | 2.02 | 0.64 | 0.97 | 0.40 |
| 3 | 1.36 | 0.99 | 1.76 | 2.66 | 1.12 | 1.45 | 0.79 |
| 4 | 3.13 | 2.01 | 3.00 | 5.55 | 1.32 | 3.31 | 0.83 |
| 5 | 0.29 | 0.33 | 0.30 | 0.50 | 0.23 | 0.32 | NA |
| 6 | 16.20 | 16.30 | 17.50 | 16.40 | 18.00 | 16.50 | 20.60 |
| 7 | 78.70 | 67.40 | 95.70 | 71.50 | 81.50 | 70.10 | 23.70 |
| 8 | 25.30 | 20.10 | 39.40 | 43.80 | 21.10 | 24.50 | 8.40 |
| 9 | 2.69 | 1.73 | 2.94 | 3.57 | 1.93 | 2.45 | 0.69 |
| 10 | 71.80 | 67.60 | 90.50 | 86.80 | 85.60 | 86.30 | 90.20 |
| 11 | 0.18 | 0.16 | 0.14 | 0.18 | 0.15 | 0.18 | 0.12 |
| 12 | 0.51 | 0.41 | 0.38 | 0.50 | 0.27 | 0.38 | 0.09 |
| 13 | 8.05 | 5.90 | 7.31 | 11.08 | 8.29 | 7.38 | 9.73 |
| 14 | 7.32 | 6.31 | 8.17 | 7.87 | 10.05 | 8.70 | 14.36 |
| 15 | 18.50 | 15.50 | 19.60 | 19.80 | 23.90 | 20.10 | 32.40 |
| 16 | 1.29 | 1.10 | 1.13 | 1.51 | 1.03 | 1.07 | 0.92 |
| 17 | 27.50 | 31.60 | 27.10 | 33.10 | 22.40 | 33.80 | NA |
| 18 | 52.70 | 46.60 | 67.20 | 52.40 | 92.30 | 58.80 | 90.00 |
| 19 | 1.80 | 2.60 | 4.20 | 1.60 | 3.20 | 2.80 | 2.40 |
| 20 | 4.14 | 4.22 | 4.29 | 3.00 | 6.05 | 5.29 | 2.40 |
| 21 | 3.75 | 5.50 | 4.50 | 2.50 | 7.75 | 6.25 | NA |
| 22 | 9.48 | −30.26 | −5.00 | 16.67 | −28.15 | −18.24 | NA |
| 23 | 17.30 | 36.40 | 46.10 | 33.00 | 51.90 | 53.20 | NA |
| 24 | 34.60 | 33.40 | 33.10 | 32.00 | 38.60 | 41.90 | 36.90 |
| 25 | 11.20 | 8.00 | 10.00 | 9.60 | 7.00 | 8.80 | 8.20 |
| 26 | 0.78 | 0.63 | 0.28 | 1.10 | 0.48 | 0.68 | 0.61 |
| 27 | 0.02 | 0.02 | 0.01 | 0.03 | 0.01 | 0.02 | NA |
| 28 | 0.45 | 0.48 | 0.64 | 0.51 | 0.39 | 0.55 | 0.48 |
| 29 | 19.10 | 19.50 | 40.00 | 17.70 | 59.00 | 28.30 | 75.00 |
| 30 | 0.58 | 0.77 | 2.24 | 0.47 | 0.81 | 0.81 | 0.79 |
| 31 | 201.40 | 190.90 | NA | 183.00 | NA | 148.40 | NA |
| 32 | 15.28 | 20.23 | NA | 11.13 | NA | 15.37 | NA |
| 33 | 0.94 | 1.01 | NA | 0.80 | NA | 0.90 | NA |
| 34 | 20.00 | 24.80 | NA | 16.80 | NA | 21.20 | NA |
| 35 | 44.00 | 53.50 | NA | 35.90 | NA | 43.80 | NA |
| 36 | 6.40 | 6.40 | 6.80 | 6.00 | 6.00 | 6.20 | 5.00 |
| 37 | NA | NA | NA | NA | 6.25 | NA | NA |
| 38 | 40.40 | 32.20 | 38.20 | 42.40 | 37.50 | 42.30 | NA |
| 39 | 41.10 | 26.00 | NA | 38.90 | NA | 38.10 | NA |
| 40 | 33.10 | NA | NA | 32.57 | NA | NA | NA |
| 41 | 78.10 | 75.00 | 84.40 | 84.10 | NA | 82.70 | NA |
| 42 | 25.90 | 39.60 | 44.70 | 32.30 | 20.80 | 43.80 | NA |
| 43 | 2.45 | 2.85 | 3.54 | 3.59 | 2.88 | 3.42 | NA |
| 44 | 1.22 | 2.52 | 4.39 | 3.26 | 1.36 | 4.02 | 0.00 |
| 45 | 47.50 | 81.10 | 85.40 | 61.30 | 62.30 | 94.40 | NA |
| 46 | 4.12 | 4.08 | 4.44 | 4.75 | 3.94 | 3.81 | NA |
| 47 | 0.14 | 0.10 | 0.12 | 0.13 | 0.10 | 0.12 | 0.05 |
| 48 | 0.42 | 0.48 | 0.43 | 0.35 | 0.49 | 0.39 | NA |
| 49 | 0.06 | 0.05 | 0.03 | 0.06 | 0.02 | 0.04 | NA |
| 50 | 5.03 | 3.92 | 6.22 | 6.07 | 7.61 | 5.99 | 0.00 |
| 51 | 0.54 | 0.49 | 0.42 | 0.66 | 0.28 | 0.56 | NA |
| 52 | 0.92 | 0.93 | 0.74 | 1.01 | 0.68 | 0.89 | NA |
| 53 | 162.00 | 155.90 | 547.20 | 138.10 | 399.40 | 219.80 | NA |
| 54 | 68.40 | 48.00 | 64.70 | 99.70 | 53.70 | 83.60 | NA |
| 55 | 57.40 | 50.00 | 90.80 | 52.10 | 136.70 | 66.30 | NA |
| 56 | 137.80 | 165.90 | 187.00 | 144.70 | 183.80 | 182.50 | NA |
| 57 | 26.60 | 22.90 | 23.40 | 24.00 | 32.60 | 23.50 | NA |
| 58 | 8.60 | 9.96 | 9.81 | 9.58 | 7.09 | 9.80 | NA |
| 59 | 14.20 | 25.20 | 14.40 | 31.90 | 16.50 | 17.70 | 18.60 |
| 60 | 5.77 | 7.70 | 6.64 | 6.17 | NA | NA | NA |
| 61 | 57.60 | 67.10 | 76.20 | 61.30 | 80.60 | 65.10 | 109.00 |
| 62 | 68.90 | 73.00 | 77.90 | 68.00 | 82.60 | 71.20 | 105.00 |

Table 236. Provided are the values of each of the parameters (as described above) measured in wheat accessions (Lines). Growth conditions are specified in the experimental procedure section.
"NA" = not available.
"Corr."—correlation.

TABLE 237

Measured parameters of correlation IDs in additional wheat accessions under low N conditions

| Line/Corr. ID | Line-8 | Line-9 | Line-10 | Line-11 | Line-12 | Line-13 | Line-14 |
|---|---|---|---|---|---|---|---|
| 1 | 2.77 | 2.63 | 3.27 | 3.41 | 2.75 | 1.50 | 0.92 |
| 2 | 0.93 | 0.88 | 1.82 | 1.67 | 0.83 | 0.51 | 0.20 |
| 3 | 1.46 | 1.52 | 2.60 | 2.50 | 1.26 | 1.09 | 0.71 |
| 4 | 2.96 | 3.21 | 5.22 | 5.01 | 2.98 | 1.14 | 0.84 |
| 5 | 0.37 | 0.34 | 0.70 | 0.58 | 0.27 | NA | NA |
| 6 | 15.20 | 17.20 | 18.50 | 18.00 | 17.10 | 18.40 | 19.00 |
| 7 | 57.70 | 74.80 | 83.60 | 81.60 | 73.10 | 67.70 | 24.50 |
| 8 | 19.90 | 24.80 | 46.50 | 40.90 | 22.10 | 23.00 | 7.80 |
| 9 | 1.85 | 2.29 | 3.58 | 3.62 | 2.26 | 2.02 | 0.63 |
| 10 | 78.70 | 79.10 | 80.70 | 80.60 | 75.70 | 83.30 | 81.50 |
| 11 | 0.19 | 0.16 | 0.17 | 0.17 | 0.16 | 0.13 | 0.12 |
| 12 | 0.39 | 0.33 | 0.42 | 0.46 | 0.45 | 0.17 | 0.14 |
| 13 | 8.21 | 7.77 | 10.74 | 10.17 | 7.26 | 7.27 | 9.72 |
| 14 | 7.00 | 6.99 | 8.08 | 7.44 | 6.43 | 9.01 | 13.43 |
| 15 | 18.70 | 18.70 | 20.30 | 19.00 | 16.30 | 21.80 | 30.30 |
| 16 | 1.40 | 1.40 | 1.51 | 1.57 | 1.33 | 1.12 | 1.05 |
| 17 | 31.40 | 31.90 | 31.10 | 30.40 | 28.00 | NA | NA |
| 18 | 55.20 | 64.50 | 62.20 | 56.60 | 51.10 | 84.80 | 91.80 |
| 19 | 3.20 | 2.40 | 2.80 | 2.00 | 2.00 | 3.20 | 2.40 |
| 20 | 4.76 | 3.90 | 3.65 | 3.19 | 4.10 | 3.20 | 2.40 |
| 21 | 4.50 | 6.25 | 3.25 | 3.00 | 4.00 | NA | NA |
| 22 | 5.50 | −60.06 | 10.96 | 5.97 | 2.33 | NA | NA |
| 23 | 35.00 | 52.00 | 44.60 | 31.70 | 16.90 | NA | NA |
| 24 | 32.20 | 32.90 | 37.30 | 36.40 | 27.40 | 32.20 | 33.00 |
| 25 | 9.20 | 8.80 | 11.40 | 10.40 | 10.80 | 7.00 | 7.40 |
| 26 | 0.65 | 0.75 | 1.51 | 1.05 | 0.72 | 0.40 | 0.60 |
| 27 | 0.02 | 0.02 | 0.04 | 0.03 | 0.03 | NA | NA |
| 28 | 0.66 | 0.60 | 0.61 | 0.60 | 0.63 | 0.43 | 0.43 |
| 29 | 22.30 | 28.20 | 24.70 | 19.80 | 19.50 | 63.20 | 75.90 |
| 30 | 1.01 | 0.80 | 0.41 | 0.57 | 0.87 | 1.06 | 0.72 |
| 31 | 100.50 | 237.30 | 109.90 | 273.80 | 230.90 | NA | NA |
| 32 | 13.37 | 18.07 | 14.65 | 16.78 | 12.92 | NA | NA |
| 33 | 0.81 | 0.98 | 0.95 | 0.93 | 0.92 | NA | NA |
| 34 | 19.80 | 22.10 | 19.60 | 22.30 | 18.00 | NA | NA |
| 35 | 41.90 | 46.50 | 45.20 | 46.60 | 38.40 | NA | NA |
| 36 | 5.60 | 5.40 | 6.00 | 6.00 | 6.00 | 5.80 | 5.40 |
| 37 | NA | NA | NA | NA | NA | NA | NA |
| 38 | 38.80 | 36.30 | NA | 45.10 | 34.60 | NA | NA |
| 39 | 32.10 | 31.50 | 41.40 | 45.30 | 35.20 | NA | NA |
| 40 | NA | NA | NA | 37.87 | 29.01 | NA | NA |
| 41 | 72.50 | 53.60 | 84.00 | 79.50 | 86.20 | NA | NA |
| 42 | 42.70 | 37.80 | 32.50 | 27.70 | 24.60 | NA | NA |
| 43 | 3.16 | 3.23 | 3.69 | 3.51 | 2.44 | NA | NA |
| 44 | 3.34 | 3.09 | 3.46 | 2.68 | 1.14 | NA | NA |
| 45 | 74.40 | 80.20 | 64.60 | 61.80 | 54.10 | NA | NA |
| 46 | 3.31 | 4.25 | 3.53 | 4.56 | 4.56 | NA | NA |
| 47 | 0.11 | 0.11 | 0.13 | 0.14 | 0.11 | NA | NA |
| 48 | 0.35 | 0.43 | 0.30 | 0.30 | 0.38 | NA | NA |
| 49 | 0.04 | 0.03 | 0.03 | 0.05 | 0.04 | NA | NA |
| 50 | 6.24 | 6.00 | 8.40 | 7.49 | 5.44 | NA | NA |
| 51 | 0.56 | 0.47 | 0.45 | 0.66 | 0.51 | NA | NA |
| 52 | 0.81 | 0.81 | 0.54 | 0.89 | 0.76 | NA | NA |
| 53 | 238.90 | 201.20 | 139.30 | 178.10 | 188.90 | NA | NA |
| 54 | 87.80 | 69.90 | 95.10 | 123.60 | 68.90 | NA | NA |
| 55 | 68.20 | 80.10 | 114.90 | 63.70 | 67.10 | NA | NA |
| 56 | 134.10 | 149.80 | 92.60 | 132.20 | 122.60 | NA | NA |
| 57 | 24.40 | 23.80 | 25.40 | 22.60 | 21.00 | NA | NA |
| 58 | 9.46 | 9.69 | 9.02 | 10.20 | 10.94 | NA | NA |
| 59 | 15.40 | 9.50 | 24.20 | 25.40 | 13.50 | 21.50 | 15.70 |
| 60 | 9.31 | 7.49 | 5.62 | 5.46 | 4.75 | NA | NA |
| 61 | 65.60 | 70.00 | 66.40 | 58.40 | 53.10 | 103.60 | 109.00 |
| 62 | 71.00 | 72.60 | 73.00 | 67.80 | 68.40 | 101.10 | 105.00 |

Table 237. Provided are the values of each of the parameters (as described above) measured in wheat accessions (Lines). Growth conditions are specified in the experimental procedure section.
"NA" = not available.
"Corr."—correlation.

TABLE 238

Additional measured parameters of correlation IDs in wheat accessions under low N vs. normal conditions (ratio)

| Line/Corr. ID | Line-1 | Line-2 | Line-3 | Line-4 | Line-5 | Line-6 | Line-7 |
|---|---|---|---|---|---|---|---|
| 1 | 0.57 | 1.30 | 1.24 | 1.07 | 1.78 | 0.84 | 0.84 |
| 2 | 1.58 | 2.55 | 2.19 | 2.16 | 1.83 | 1.45 | NA |
| 3 | 0.97 | 0.92 | 1.11 | 0.98 | NA | 1.14 | NA |
| 4 | 0.89 | 0.99 | 0.90 | 0.95 | 0.91 | 0.95 | 0.88 |
| 5 | 0.99 | 1.01 | NA | 1.10 | NA | 1.22 | NA |
| 6 | 1.28 | 1.51 | 1.73 | 1.18 | 0.98 | 1.26 | 1.40 |
| 7 | 1.24 | 1.37 | 1.34 | 1.22 | NA | 1.50 | NA |
| 8 | 1.12 | 1.41 | 1.75 | 1.16 | 1.09 | 1.08 | 3.03 |
| 9 | 3.03 | 3.63 | 3.17 | 2.22 | 2.35 | 2.41 | 10.62 |
| 10 | 1.13 | 1.60 | 1.72 | 1.52 | 1.08 | 1.24 | NA |
| 11 | 2.01 | 1.58 | 1.46 | 1.69 | 1.62 | 1.80 | NA |
| 12 | 0.94 | 1.05 | 1.00 | 1.08 | 0.90 | 1.11 | NA |
| 13 | 1.11 | 2.06 | 1.18 | 0.94 | 1.02 | 1.56 | 1.15 |
| 14 | 1.10 | 0.92 | NA | 1.01 | NA | 0.82 | NA |
| 15 | 1.04 | 1.04 | 0.88 | 1.05 | 0.82 | 0.94 | NA |
| 16 | 1.00 | 1.33 | 1.25 | 0.87 | 0.90 | 1.13 | 0.80 |
| 17 | 1.91 | 2.43 | 2.50 | 2.36 | 2.12 | 1.50 | NA |
| 18 | 1.00 | 0.95 | 0.90 | 0.97 | NA | 0.95 | NA |
| 19 | 0.89 | −3.64 | 1.42 | −14.30 | 1.13 | 1.29 | NA |
| 20 | 1.73 | 1.56 | 1.57 | 1.56 | 2.25 | 1.76 | NA |
| 21 | 1.71 | 3.14 | 2.82 | 2.16 | 1.50 | 1.67 | NA |
| 22 | 0.57 | 0.63 | 0.63 | 0.64 | 0.44 | 0.56 | NA |
| 23 | 0.84 | 1.43 | 2.11 | 1.24 | 0.64 | 1.60 | NA |
| 24 | 1.11 | 0.07 | 0.34 | 0.68 | 0.42 | 0.60 | NA |
| 25 | 0.79 | 4.23 | 1.21 | 1.16 | 1.29 | 0.88 | NA |
| 26 | −0.19 | −1.56 | 0.47 | 0.72 | 1.69 | 0.43 | NA |
| 27 | 1.39 | 1.88 | 1.69 | 1.31 | 1.77 | 1.16 | NA |
| 28 | 0.57 | 0.63 | 0.63 | 0.64 | 0.44 | 0.56 | NA |
| 29 | 0.44 | 0.29 | 0.28 | 0.26 | 0.39 | 0.36 | NA |

Table 238. Provided are the values of each of the parameters (as described above) measured in wheat accessions (Lines). Growth conditions are specified in the experimental procedure section.
"NA" = not available.
"Corr."—correlation.

TABLE 239

Additional measured parameters of correlation IDs in wheat accessions under low N vs. normal conditions (ratio)

| Line/Corr. ID | Line-8 | Line-9 | Line-10 | Line-11 | Line-12 | Line-13 | Line-14 |
|---|---|---|---|---|---|---|---|
| 1 | 1.02 | 0.70 | 1.17 | 0.76 | 0.81 | 1.68 | 1.17 |
| 2 | 1.39 | 2.97 | 0.97 | 1.07 | 1.00 | NA | NA |
| 3 | 0.94 | 0.91 | 1.02 | 0.93 | 1.00 | NA | NA |
| 4 | 0.94 | 0.92 | 0.90 | 0.87 | 0.92 | 1.17 | 1.08 |
| 5 | 0.96 | NA | 1.07 | 1.12 | 1.06 | NA | NA |
| 6 | 1.00 | 1.06 | 1.55 | 1.20 | 1.20 | 4.52 | 1.18 |
| 7 | 1.01 | 1.19 | 1.55 | 1.29 | 0.99 | NA | NA |
| 8 | 0.97 | 0.95 | 1.44 | 0.99 | 1.07 | 5.54 | 0.26 |
| 9 | 2.10 | 2.56 | 2.18 | 1.98 | 3.07 | NA | NA |
| 10 | 1.19 | 2.04 | 1.12 | 1.22 | 0.94 | NA | NA |
| 11 | 1.90 | 1.26 | 2.39 | 2.46 | 3.00 | NA | NA |
| 12 | 1.03 | 0.99 | 1.05 | 1.16 | 1.27 | NA | NA |
| 13 | 1.37 | 0.91 | 0.96 | 0.98 | 0.83 | 1.44 | 0.95 |
| 14 | 0.83 | 0.88 | 0.91 | 0.97 | 1.00 | NA | NA |
| 15 | 1.00 | 1.01 | NA | 1.05 | 1.01 | NA | NA |
| 16 | 1.53 | 1.42 | 1.39 | 0.96 | 1.42 | 1.06 | 0.95 |
| 17 | 1.40 | 2.76 | 1.05 | 1.20 | 1.19 | NA | NA |
| 18 | 0.93 | 1.00 | 0.98 | 0.92 | 1.01 | NA | NA |

TABLE 239-continued

Additional measured parameters of correlation IDs in wheat accessions under low N vs. normal conditions (ratio)

| Line/Corr. ID | Line-8 | Line-9 | Line-10 | Line-11 | Line-12 | Line-13 | Line-14 |
|---|---|---|---|---|---|---|---|
| 19 | −1.35 | 1.52 | 1.63 | 26.92 | 0.66 | NA | NA |
| 20 | 1.74 | 1.55 | 1.47 | 1.32 | 1.39 | NA | NA |
| 21 | 1.33 | 2.94 | 0.99 | 1.08 | 0.96 | NA | NA |
| 22 | 0.57 | 0.64 | 0.67 | 0.75 | 0.71 | NA | NA |
| 23 | 1.53 | 1.46 | 1.31 | 1.33 | 1.84 | NA | NA |
| 24 | 0.15 | 0.09 | 0.34 | 1.33 | 1.22 | NA | NA |
| 25 | 4.38 | 5.03 | 3.04 | 1.03 | 1.59 | NA | NA |
| 26 | 0.27 | 3.73 | −0.23 | −0.18 | −0.03 | NA | NA |
| 27 | 1.15 | 2.05 | 0.89 | 0.79 | 1.07 | NA | NA |
| 28 | 0.57 | 0.64 | 0.67 | 0.75 | 0.71 | NA | NA |
| 29 | 0.39 | 0.22 | 0.55 | 0.46 | 0.80 | NA | NA |

Table 239. Provided are the values of each of the parameters (as described above) measured in wheat accessions (Lines). Growth conditions are specified in the experimental procedure section.
"NA" = not available.
"Corr."—correlation

TABLE 240

Correlation between the expression level of selected genes of some embodiments of the invention in various tissues and the phenotypic performance under normal conditions across wheat accessions

| Gene Name | R | P value | Exp. set | Corr. ID | Gene Name | R | P value | Exp. set | Corr. ID |
|---|---|---|---|---|---|---|---|---|---|
| LBY287 | 0.75 | 3.10E−02 | 3 | 31 | LBY287 | 0.82 | 3.48E−03 | 4 | 1 |
| LBY287 | 0.75 | 1.27E−02 | 4 | 20 | LBY287 | 0.88 | 7.71E−04 | 4 | 5 |
| LBY287 | 0.71 | 1.48E−02 | 8 | 52 | LBY287 | 0.76 | 6.21E−03 | 8 | 20 |
| LBY287 | 0.75 | 3.10E−02 | 12 | 31 | LBY287 | 0.82 | 3.48E−03 | 13 | 1 |
| LBY287 | 0.75 | 1.27E−02 | 13 | 20 | LBY287 | 0.88 | 7.71E−04 | 13 | 5 |
| LBY287 | 0.71 | 1.48E−02 | 17 | 52 | LBY287 | 0.76 | 6.21E−03 | 17 | 20 |
| LBY288 | 0.77 | 8.87E−03 | 2 | 14 | LBY288 | 0.84 | 2.40E−03 | 2 | 15 |
| LBY288 | 0.73 | 1.15E−02 | 3 | 14 | LBY288 | 0.73 | 1.67E−02 | 4 | 15 |
| LBY288 | 0.73 | 1.65E−02 | 4 | 22 | LBY288 | 0.76 | 1.03E−02 | 9 | 58 |
| LBY288 | 0.73 | 2.58E−02 | 8 | 43 | LBY288 | 0.77 | 8.87E−03 | 11 | 14 |
| LBY288 | 0.73 | 1.71E−02 | 9 | 37 | LBY288 | 0.71 | 2.11E−02 | 9 | 46 |
| LBY288 | 0.77 | 9.42E−03 | 9 | 6 | LBY288 | 0.71 | 4.85E−02 | 8 | 31 |
| LBY288 | 0.84 | 2.40E−03 | 11 | 15 | LBY288 | 0.73 | 1.15E−02 | 12 | 14 |
| LBY288 | 0.73 | 1.67E−02 | 13 | 15 | LBY288 | 0.73 | 1.65E−02 | 13 | 22 |
| LBY288 | 0.71 | 4.85E−02 | 17 | 31 | LBY288 | 0.73 | 2.58E−02 | 17 | 43 |
| LBY288 | 0.76 | 1.03E−02 | 18 | 58 | LBY288 | 0.73 | 1.71E−02 | 18 | 37 |
| LBY288 | 0.71 | 2.11E−02 | 18 | 46 | LBY288 | 0.77 | 9.42E−03 | 18 | 6 |
| LBY355 | 0.92 | 1.01E−02 | 5 | 34 | LBY355 | 0.97 | 1.37E−03 | 5 | 58 |
| LBY355 | 0.85 | 3.36E−02 | 5 | 38 | LBY355 | 0.85 | 3.36E−02 | 5 | 27 |
| LBY355 | 0.91 | 1.26E−02 | 5 | 18 | LBY355 | 0.89 | 1.87E−02 | 5 | 23 |
| LBY355 | 0.71 | 1.17E−01 | 5 | 48 | LBY355 | 0.85 | 3.36E−02 | 5 | 47 |
| LBY355 | 0.81 | 4.92E−02 | 5 | 10 | LBY355 | 0.92 | 8.93E−03 | 5 | 7 |
| LBY355 | 0.78 | 6.98E−02 | 5 | 62 | LBY355 | 0.70 | 1.20E−01 | 5 | 35 |
| LBY355 | 0.92 | 9.44E−03 | 5 | 24 | LBY355 | 0.75 | 8.87E−02 | 5 | 32 |
| LBY355 | 0.92 | 9.36E−03 | 5 | 60 | LBY355 | 0.84 | 3.85E−02 | 5 | 9 |
| LBY355 | 0.83 | 4.02E−02 | 5 | 8 | LBY355 | 0.91 | 1.28E−02 | 5 | 37 |
| LBY355 | 0.91 | 1.09E−02 | 5 | 39 | LBY355 | 0.84 | 3.73E−02 | 5 | 29 |
| LBY355 | 0.86 | 2.95E−02 | 5 | 25 | LBY355 | 0.85 | 3.05E−02 | 5 | 40 |
| LBY355 | 0.93 | 7.75E−03 | 5 | 6 | LBY355 | 0.84 | 3.67E−02 | 5 | 36 |
| LBY355 | 0.77 | 9.93E−03 | 6 | 30 | LBY355 | 0.78 | 1.29E−02 | 6 | 11 |
| LBY355 | 0.79 | 6.48E−03 | 7 | 14 | LBY355 | 0.75 | 3.22E−02 | 7 | 41 |
| LBY355 | 0.88 | 7.80E−04 | 7 | 15 | LBY355 | 0.72 | 6.58E−02 | 7 | 31 |
| LBY355 | 0.77 | 2.63E−02 | 7 | 44 | LBY355 | 0.72 | 4.34E−02 | 7 | 43 |
| LBY355 | 0.97 | 1.37E−03 | 14 | 58 | LBY355 | 0.85 | 3.36E−02 | 14 | 38 |
| LBY355 | 0.85 | 3.36E−02 | 14 | 27 | LBY355 | 0.91 | 1.26E−02 | 14 | 18 |
| LBY355 | 0.89 | 1.87E−02 | 14 | 23 | LBY355 | 0.71 | 1.17E−01 | 14 | 48 |
| LBY355 | 0.85 | 3.36E−02 | 14 | 47 | LBY355 | 0.81 | 4.92E−02 | 14 | 10 |
| LBY355 | 0.92 | 8.93E−03 | 14 | 7 | LBY355 | 0.70 | 1.20E−01 | 14 | 35 |
| LBY355 | 0.78 | 6.98E−02 | 14 | 62 | LBY355 | 0.75 | 8.87E−02 | 14 | 32 |
| LBY355 | 0.92 | 9.44E−03 | 14 | 24 | LBY355 | 0.92 | 9.36E−03 | 14 | 60 |
| LBY355 | 0.84 | 3.85E−02 | 14 | 9 | LBY355 | 0.83 | 4.02E−02 | 14 | 8 |
| LBY355 | 0.91 | 1.28E−02 | 14 | 37 | LBY355 | 0.84 | 3.73E−02 | 14 | 29 |
| LBY355 | 0.91 | 1.09E−02 | 14 | 39 | LBY355 | 0.86 | 2.95E−02 | 14 | 25 |
| LBY355 | 0.85 | 3.05E−02 | 14 | 40 | LBY355 | 0.93 | 7.75E−03 | 14 | 6 |
| LBY355 | 0.84 | 3.67E−02 | 14 | 36 | LBY355 | 0.77 | 9.93E−03 | 15 | 30 |
| LBY355 | 0.78 | 1.29E−02 | 15 | 11 | LBY356 | 0.89 | 6.59E−03 | 7 | 59 |
| LBY355 | 0.79 | 6.48E−03 | 16 | 14 | LBY355 | 0.75 | 3.22E−02 | 16 | 41 |
| LBY355 | 0.88 | 7.80E−04 | 16 | 15 | LBY355 | 0.72 | 6.58E−02 | 16 | 31 |
| LBY355 | 0.77 | 2.63E−02 | 16 | 44 | LBY355 | 0.72 | 4.34E−02 | 16 | 43 |
| LBY356 | 0.76 | 1.10E−02 | 1 | 10 | LBY356 | 0.81 | 4.09E−03 | 1 | 7 |
| LBY356 | 0.75 | 1.18E−02 | 1 | 24 | LBY356 | 0.86 | 3.16E−03 | 1 | 37 |
| LBY356 | 0.80 | 5.63E−03 | 1 | 39 | LBY356 | 0.72 | 1.77E−02 | 1 | 25 |
| LBY356 | 0.78 | 7.81E−03 | 1 | 40 | LBY356 | 0.78 | 7.57E−03 | 1 | 36 |

TABLE 240-continued

Correlation between the expression level of selected genes of some embodiments of the invention in various tissues and the phenotypic performance under normal conditions across wheat accessions

| Gene Name | R | P value | Exp. set | Corr. ID | Gene Name | R | P value | Exp. set | Corr. ID |
|---|---|---|---|---|---|---|---|---|---|
| LBY356 | 0.80 | 5.52E−03 | 4 | 50 | LBY356 | 0.79 | 7.04E−03 | 4 | 51 |
| LBY356 | 0.71 | 2.16E−02 | 4 | 5 | LBY356 | 0.84 | 2.50E−03 | 9 | 19 |
| LBY356 | 0.86 | 2.85E−02 | 5 | 58 | LBY356 | 0.94 | 4.99E−03 | 5 | 54 |
| LBY356 | 0.86 | 2.70E−02 | 5 | 41 | LBY356 | 0.91 | 1.11E−02 | 5 | 49 |
| LBY356 | 0.97 | 1.09E−03 | 5 | 42 | LBY356 | 0.84 | 3.50E−02 | 5 | 38 |
| LBY356 | 0.71 | 1.17E−01 | 5 | 56 | LBY356 | 0.92 | 9.33E−03 | 5 | 27 |
| LBY356 | 0.97 | 1.78E−03 | 5 | 55 | LBY356 | 0.90 | 1.46E−02 | 5 | 18 |
| LBY356 | 0.98 | 6.84E−04 | 5 | 52 | LBY356 | 0.84 | 3.50E−02 | 5 | 47 |
| LBY356 | 0.74 | 9.07E−02 | 5 | 10 | LBY356 | 0.84 | 3.56E−02 | 5 | 7 |
| LBY356 | 0.71 | 1.14E−01 | 5 | 35 | LBY356 | 0.90 | 1.42E−02 | 5 | 24 |
| LBY356 | 0.83 | 4.30E−02 | 5 | 60 | LBY356 | 0.91 | 1.15E−02 | 5 | 20 |
| LBY356 | 0.70 | 1.19E−01 | 5 | 8 | LBY356 | 0.82 | 4.52E−02 | 5 | 37 |
| LBY356 | 0.94 | 4.55E−03 | 5 | 39 | LBY356 | 0.90 | 1.34E−02 | 5 | 25 |
| LBY356 | 0.81 | 5.17E−02 | 5 | 6 | LBY356 | 0.88 | 1.98E−02 | 5 | 36 |
| LBY356 | 0.79 | 2.09E−02 | 6 | 2 | LBY356 | 0.75 | 1.33E−02 | 6 | 35 |
| LBY356 | 0.78 | 8.07E−03 | 7 | 62 | LBY356 | 0.78 | 1.36E−02 | 7 | 37 |
| LBY356 | 0.75 | 7.81E−03 | 8 | 34 | LBY356 | 0.77 | 2.52E−02 | 8 | 31 |
| LBY356 | 0.76 | 1.11E−02 | 9 | 61 | LBY356 | 0.77 | 9.48E−03 | 9 | 26 |
| LBY356 | 0.72 | 1.93E−02 | 9 | 48 | LBY356 | 0.97 | 1.78E−03 | 5 | 34 |
| LBY356 | 0.81 | 4.09E−03 | 10 | 7 | LBY356 | 0.75 | 1.18E−02 | 10 | 24 |
| LBY356 | 0.86 | 3.16E−03 | 10 | 37 | LBY356 | 0.80 | 5.63E−03 | 10 | 39 |
| LBY356 | 0.72 | 1.77E−02 | 10 | 25 | LBY356 | 0.78 | 7.81E−03 | 10 | 40 |
| LBY356 | 0.78 | 7.57E−03 | 10 | 36 | LBY356 | 0.71 | 2.16E−02 | 13 | 5 |
| LBY356 | 0.94 | 4.99E−03 | 14 | 54 | LBY356 | 0.86 | 2.85E−02 | 14 | 58 |
| LBY356 | 0.86 | 2.70E−02 | 14 | 41 | LBY356 | 0.91 | 1.11E−02 | 14 | 49 |
| LBY356 | 0.97 | 1.09E−03 | 14 | 42 | LBY356 | 0.84 | 3.50E−02 | 14 | 38 |
| LBY356 | 0.71 | 1.17E−01 | 14 | 56 | LBY356 | 0.92 | 9.33E−03 | 14 | 27 |
| LBY356 | 0.97 | 1.78E−03 | 14 | 55 | LBY356 | 0.90 | 1.46E−02 | 14 | 18 |
| LBY356 | 0.98 | 6.84E−04 | 14 | 52 | LBY356 | 0.84 | 3.50E−02 | 14 | 47 |
| LBY356 | 0.74 | 9.07E−02 | 14 | 10 | LBY356 | 0.84 | 3.56E−02 | 14 | 7 |
| LBY356 | 0.71 | 1.14E−01 | 14 | 35 | LBY356 | 0.90 | 1.42E−02 | 14 | 24 |
| LBY356 | 0.91 | 1.15E−02 | 14 | 20 | LBY356 | 0.83 | 4.30E−02 | 14 | 60 |
| LBY356 | 0.70 | 1.19E−01 | 14 | 8 | LBY356 | 0.82 | 4.52E−02 | 14 | 37 |
| LBY356 | 0.94 | 4.55E−03 | 14 | 39 | LBY356 | 0.90 | 1.34E−02 | 14 | 25 |
| LBY356 | 0.81 | 5.17E−02 | 14 | 6 | LBY356 | 0.88 | 1.98E−02 | 14 | 36 |
| LBY356 | 0.79 | 2.09E−02 | 15 | 2 | LBY356 | 0.75 | 1.33E−02 | 15 | 35 |
| LBY356 | 0.89 | 6.59E−03 | 16 | 59 | LBY356 | 0.78 | 8.07E−03 | 16 | 62 |
| LBY356 | 0.78 | 1.36E−02 | 16 | 37 | LBY356 | 0.76 | 1.10E−02 | 10 | 10 |
| LBY356 | 0.77 | 2.52E−02 | 17 | 31 | LBY357 | 0.71 | 2.11E−02 | 2 | 61 |
| LBY356 | 0.84 | 2.50E−03 | 18 | 19 | LBY356 | 0.76 | 1.11E−02 | 18 | 61 |
| LBY356 | 0.77 | 9.48E−03 | 18 | 26 | LBY356 | 0.72 | 1.93E−02 | 18 | 48 |
| LBY357 | 0.73 | 3.83E−02 | 2 | 21 | LBY357 | 0.79 | 4.10E−03 | 3 | 34 |
| LBY357 | 0.80 | 2.82E−03 | 3 | 58 | LBY357 | 0.72 | 1.21E−02 | 3 | 26 |
| LBY357 | 0.91 | 8.44E−05 | 3 | 23 | LBY357 | 0.74 | 9.29E−03 | 3 | 24 |
| LBY357 | 0.81 | 2.44E−03 | 3 | 32 | LBY357 | 0.75 | 7.28E−03 | 3 | 40 |
| LBY357 | 0.77 | 5.15E−03 | 3 | 6 | LBY357 | 0.79 | 6.09E−03 | 4 | 9 |
| LBY357 | 0.84 | 2.29E−03 | 4 | 8 | LBY357 | 0.73 | 1.58E−02 | 4 | 17 |
| LBY357 | 0.73 | 9.72E−02 | 5 | 58 | LBY357 | 0.81 | 5.22E−02 | 5 | 23 |
| LBY357 | 0.81 | 5.14E−02 | 5 | 48 | LBY357 | 0.70 | 1.21E−01 | 5 | 32 |
| LBY357 | 0.80 | 5.37E−02 | 5 | 40 | LBY357 | 0.87 | 2.26E−02 | 5 | 46 |
| LBY357 | 0.78 | 6.74E−02 | 5 | 6 | LBY357 | 0.77 | 9.35E−03 | 6 | 61 |
| LBY357 | 0.96 | 1.92E−04 | 6 | 21 | LBY357 | 0.81 | 2.36E−03 | 8 | 58 |
| LBY357 | 0.94 | 2.09E−05 | 8 | 23 | LBY357 | 0.76 | 6.50E−03 | 8 | 32 |
| LBY357 | 0.72 | 1.18E−02 | 8 | 60 | LBY357 | 0.72 | 1.24E−02 | 8 | 40 |
| LBY357 | 0.81 | 2.55E−03 | 8 | 6 | LBY357 | 0.71 | 2.11E−02 | 11 | 61 |
| LBY357 | 0.77 | 9.01E−03 | 9 | 33 | LBY357 | 0.95 | 9.75E−05 | 9 | 21 |
| LBY357 | 0.73 | 3.83E−02 | 11 | 21 | LBY357 | 0.80 | 2.82E−03 | 12 | 58 |
| LBY357 | 0.72 | 1.21E−02 | 12 | 26 | LBY357 | 0.91 | 8.44E−05 | 12 | 23 |
| LBY357 | 0.81 | 2.44E−03 | 12 | 32 | LBY357 | 0.74 | 9.29E−03 | 12 | 24 |
| LBY357 | 0.75 | 7.28E−03 | 12 | 40 | LBY357 | 0.77 | 5.15E−03 | 12 | 6 |
| LBY357 | 0.79 | 6.09E−03 | 13 | 9 | LBY357 | 0.84 | 2.29E−03 | 13 | 8 |
| LBY357 | 0.73 | 1.58E−02 | 13 | 17 | LBY357 | 0.77 | 9.01E−03 | 18 | 33 |
| LBY357 | 0.81 | 5.22E−02 | 14 | 23 | LBY357 | 0.81 | 5.14E−02 | 14 | 48 |
| LBY357 | 0.70 | 1.21E−01 | 14 | 32 | LBY357 | 0.80 | 5.37E−02 | 14 | 40 |
| LBY357 | 0.87 | 2.26E−02 | 14 | 46 | LBY357 | 0.78 | 6.74E−02 | 14 | 6 |
| LBY357 | 0.77 | 9.35E−03 | 15 | 61 | LBY357 | 0.96 | 1.92E−04 | 15 | 21 |
| LBY357 | 0.81 | 2.36E−03 | 17 | 58 | LBY357 | 0.94 | 2.09E−05 | 17 | 23 |
| LBY357 | 0.76 | 6.50E−03 | 17 | 32 | LBY357 | 0.72 | 1.18E−02 | 17 | 60 |
| LBY357 | 0.72 | 1.24E−02 | 17 | 40 | LBY357 | 0.81 | 2.55E−03 | 17 | 6 |
| LBY357 | 0.95 | 9.75E−05 | 18 | 21 | LBY357 | 0.73 | 9.72E−02 | 14 | 58 |
| LBY358 | 0.78 | 3.95E−02 | 2 | 31 | LBY358 | 0.90 | 1.10E−03 | 2 | 28 |
| LBY358 | 0.75 | 8.37E−02 | 5 | 45 | LBY358 | 0.79 | 5.93E−02 | 5 | 33 |
| LBY358 | 0.78 | 6.75E−02 | 5 | 21 | LBY358 | 0.89 | 1.77E−02 | 5 | 46 |

TABLE 240-continued

Correlation between the expression level of selected genes of some embodiments of the invention in various tissues and the phenotypic performance under normal conditions across wheat accessions

| Gene Name | R | P value | Exp. set | Corr. ID | Gene Name | R | P value | Exp. set | Corr. ID |
|---|---|---|---|---|---|---|---|---|---|
| LBY358 | 0.83 | 3.25E−03 | 6 | 30 | LBY358 | 0.85 | 3.58E−03 | 6 | 11 |
| LBY358 | 0.81 | 4.59E−03 | 7 | 14 | LBY358 | 0.72 | 1.83E−02 | 7 | 15 |
| LBY358 | 0.70 | 2.35E−02 | 7 | 9 | LBY358 | 0.78 | 7.96E−03 | 9 | 49 |
| LBY358 | 0.78 | 3.95E−02 | 11 | 31 | LBY358 | 0.81 | 4.59E−03 | 16 | 14 |
| LBY358 | 0.79 | 5.93E−02 | 14 | 33 | LBY358 | 0.78 | 6.75E−02 | 14 | 21 |
| LBY358 | 0.89 | 1.77E−02 | 14 | 46 | LBY358 | 0.83 | 3.25E−03 | 15 | 30 |
| LBY358 | 0.85 | 3.58E−03 | 15 | 11 | LBY359 | 0.90 | 5.16E−03 | 2 | 59 |
| LBY358 | 0.72 | 1.83E−02 | 16 | 15 | LBY358 | 0.70 | 2.35E−02 | 16 | 9 |
| LBY358 | 0.78 | 7.96E−03 | 18 | 49 | LBY358 | 0.75 | 8.37E−02 | 14 | 45 |
| LBY359 | 0.71 | 2.22E−02 | 1 | 50 | LBY359 | 0.71 | 3.19E−02 | 1 | 42 |
| LBY359 | 0.85 | 1.83E−03 | 1 | 52 | LBY359 | 0.78 | 7.62E−03 | 1 | 1 |
| LBY359 | 0.76 | 1.01E−02 | 1 | 51 | LBY359 | 0.83 | 3.14E−03 | 1 | 20 |
| LBY359 | 0.80 | 5.28E−03 | 1 | 5 | LBY359 | 0.73 | 2.55E−02 | 1 | 28 |
| LBY359 | 0.71 | 2.07E−02 | 1 | 22 | LBY359 | 0.77 | 1.43E−02 | 9 | 21 |
| LBY359 | 0.74 | 1.35E−02 | 2 | 53 | LBY359 | 0.75 | 7.81E−03 | 3 | 26 |
| LBY359 | 0.87 | 4.37E−04 | 3 | 23 | LBY359 | 0.74 | 9.78E−03 | 3 | 48 |
| LBY359 | 0.82 | 1.80E−03 | 3 | 32 | LBY359 | 0.73 | 1.00E−02 | 3 | 40 |
| LBY359 | 0.74 | 9.20E−02 | 5 | 40 | LBY359 | 0.83 | 3.91E−02 | 5 | 46 |
| LBY359 | 0.74 | 1.44E−02 | 9 | 29 | LBY359 | 0.75 | 8.65E−02 | 5 | 48 |
| LBY359 | 0.85 | 1.83E−03 | 10 | 52 | LBY359 | 0.78 | 7.62E−03 | 10 | 1 |
| LBY359 | 0.83 | 3.14E−03 | 10 | 20 | LBY359 | 0.80 | 5.28E−03 | 10 | 5 |
| LBY359 | 0.71 | 2.07E−02 | 10 | 22 | LBY359 | 0.77 | 1.43E−02 | 18 | 21 |
| LBY359 | 0.90 | 5.16E−03 | 11 | 59 | LBY359 | 0.74 | 1.35E−02 | 11 | 53 |
| LBY359 | 0.75 | 7.81E−03 | 12 | 26 | LBY359 | 0.87 | 4.37E−04 | 12 | 23 |
| LBY359 | 0.74 | 9.78E−03 | 12 | 48 | LBY359 | 0.82 | 1.80E−03 | 12 | 32 |
| LBY359 | 0.73 | 1.00E−02 | 12 | 40 | LBY359 | 0.71 | 3.19E−02 | 10 | 42 |
| LBY359 | 0.74 | 9.20E−02 | 14 | 40 | LBY359 | 0.83 | 3.91E−02 | 14 | 46 |
| LBY359 | 0.74 | 1.44E−02 | 18 | 29 | LBY359 | 0.75 | 8.65E−02 | 14 | 48 |
| LBY460 | 0.82 | 3.52E−03 | 4 | 50 | LBY460 | 0.70 | 2.37E−02 | 4 | 15 |
| LBY460 | 0.86 | 1.57E−03 | 4 | 52 | LBY460 | 0.88 | 7.69E−04 | 4 | 51 |
| LBY460 | 0.71 | 2.01E−02 | 4 | 45 | LBY460 | 0.93 | 9.05E−05 | 4 | 20 |
| LBY460 | 0.74 | 1.34E−02 | 4 | 22 | LBY460 | 0.70 | 2.37E−02 | 13 | 15 |
| LBY460 | 0.86 | 1.57E−03 | 13 | 52 | LBY460 | 0.71 | 2.01E−02 | 13 | 45 |
| LBY460 | 0.93 | 9.05E−05 | 13 | 20 | LBY460 | 0.74 | 1.34E−02 | 13 | 22 |
| LBY461 | 0.94 | 6.35E−05 | 1 | 14 | LBY461 | 0.85 | 2.03E−03 | 1 | 50 |
| LBY461 | 0.95 | 2.42E−05 | 1 | 15 | LBY461 | 0.74 | 1.37E−02 | 1 | 52 |
| LBY461 | 0.76 | 1.07E−02 | 1 | 16 | LBY461 | 0.93 | 9.86E−05 | 1 | 51 |
| LBY461 | 0.78 | 7.67E−03 | 1 | 20 | LBY461 | 0.73 | 1.69E−02 | 1 | 8 |
| LBY461 | 0.91 | 2.32E−04 | 1 | 22 | LBY461 | 0.79 | 6.59E−03 | 4 | 1 |
| LBY461 | 0.79 | 6.26E−03 | 2 | 14 | LBY461 | 0.85 | 1.71E−03 | 2 | 50 |
| LBY461 | 0.85 | 1.69E−03 | 2 | 15 | LBY461 | 0.82 | 3.64E−03 | 2 | 52 |
| LBY461 | 0.91 | 2.26E−04 | 2 | 51 | LBY461 | 0.84 | 2.14E−03 | 2 | 45 |
| LBY461 | 0.92 | 1.87E−04 | 2 | 20 | LBY461 | 0.75 | 1.18E−02 | 2 | 12 |
| LBY461 | 0.81 | 4.34E−03 | 2 | 22 | LBY461 | 0.75 | 3.06E−02 | 3 | 31 |
| LBY461 | 0.72 | 1.89E−02 | 4 | 5 | LBY461 | 0.74 | 3.54E−02 | 9 | 59 |
| LBY461 | 0.88 | 2.15E−02 | 5 | 50 | LBY461 | 0.95 | 4.04E−03 | 5 | 15 |
| LBY461 | 0.77 | 7.57E−02 | 5 | 31 | LBY461 | 0.78 | 6.55E−02 | 5 | 44 |
| LBY461 | 0.94 | 4.64E−03 | 5 | 1 | LBY461 | 0.93 | 6.36E−03 | 5 | 51 |
| LBY461 | 0.90 | 1.47E−02 | 5 | 43 | LBY461 | 0.93 | 6.81E−03 | 5 | 5 |
| LBY461 | 0.88 | 2.23E−02 | 5 | 28 | LBY461 | 0.73 | 4.03E−02 | 8 | 31 |
| LBY461 | 0.70 | 3.40E−02 | 8 | 44 | LBY461 | 0.74 | 8.58E−03 | 8 | 53 |
| LBY461 | 0.94 | 6.35E−05 | 10 | 14 | LBY461 | 0.95 | 2.42E−05 | 10 | 15 |
| LBY461 | 0.74 | 1.37E−02 | 10 | 52 | LBY461 | 0.76 | 1.07E−02 | 10 | 16 |
| LBY461 | 0.78 | 7.67E−03 | 10 | 20 | LBY461 | 0.73 | 1.69E−02 | 10 | 8 |
| LBY461 | 0.91 | 2.32E−04 | 10 | 22 | LBY461 | 0.79 | 6.59E−03 | 13 | 1 |
| LBY461 | 0.79 | 6.26E−03 | 11 | 14 | LBY461 | 0.85 | 1.69E−03 | 11 | 15 |
| LBY461 | 0.82 | 3.64E−03 | 11 | 52 | LBY461 | 0.84 | 2.14E−03 | 11 | 45 |
| LBY461 | 0.92 | 1.87E−04 | 11 | 20 | LBY461 | 0.75 | 1.18E−02 | 11 | 12 |
| LBY461 | 0.81 | 4.34E−03 | 11 | 22 | LBY461 | 0.75 | 3.06E−02 | 12 | 31 |
| LBY461 | 0.72 | 1.89E−02 | 13 | 5 | LBY461 | 0.74 | 3.54E−02 | 18 | 59 |
| LBY461 | 0.95 | 4.04E−03 | 14 | 15 | LBY461 | 0.77 | 7.57E−02 | 14 | 31 |
| LBY461 | 0.78 | 6.55E−02 | 14 | 44 | LBY461 | 0.94 | 4.64E−03 | 14 | 1 |
| LBY461 | 0.90 | 1.47E−02 | 14 | 43 | LBY461 | 0.93 | 6.81E−03 | 14 | 5 |
| LBY461 | 0.73 | 4.03E−02 | 17 | 31 | LBY461 | 0.70 | 3.40E−02 | 17 | 44 |
| LBY461 | 0.74 | 8.58E−03 | 17 | | | | | | |

Table 240. Provided are the correlations (R) between the genes expression levels in various tissues and the phenotypic performance (Tables 234-235).
"Corr. ID"—correlation vector ID according to the correlated parameters specified in Table 228.
"Exp. Set"—Expression set specified in Table 228.
"R" = Pearson correlation coefficient;
"P" = p value.

TABLE 241

Correlation between the expression level of selected genes of some embodiments of the invention in various tissues and the phenotypic performance under low N conditions across wheat accessions

| Gene Name | R | P value | Exp. set | Corr. ID | Gene Name | R | P value | Exp. set | Corr. ID |
|---|---|---|---|---|---|---|---|---|---|
| LBY288 | 0.70 | 1.55E−02 | 2 | 50 | LBY288 | 0.82 | 2.20E−03 | 2 | 55 |
| LBY288 | 0.82 | 2.49E−02 | 3 | 26 | LBY288 | 0.71 | 7.43E−02 | 3 | 5 |
| LBY288 | 0.72 | 6.72E−02 | 3 | 27 | LBY288 | 0.72 | 6.87E−02 | 3 | 8 |
| LBY288 | 0.86 | 5.94E−04 | 5 | 1 | LBY288 | 0.86 | 5.94E−04 | 5 | 47 |
| LBY288 | 0.77 | 5.75E−03 | 5 | 13 | LBY288 | 0.74 | 2.37E−02 | 5 | 39 |
| LBY288 | 0.78 | 4.57E−03 | 5 | 9 | LBY288 | 0.78 | 5.02E−03 | 5 | 2 |
| LBY288 | 0.81 | 4.52E−03 | 7 | 61 | LBY288 | 0.94 | 6.73E−05 | 7 | 55 |
| LBY288 | 0.84 | 2.62E−03 | 7 | 57 | LBY288 | 0.90 | 3.20E−04 | 7 | 62 |
| LBY288 | 0.82 | 3.51E−03 | 7 | 15 | LBY288 | 0.80 | 5.15E−03 | 7 | 14 |
| LBY288 | 0.97 | 5.24E−06 | 7 | 18 | LBY288 | 0.93 | 9.49E−05 | 7 | 29 |
| LBY288 | 0.84 | 3.73E−02 | 4 | 61 | LBY288 | 0.75 | 8.88E−02 | 4 | 23 |
| LBY288 | 0.77 | 7.49E−02 | 4 | 45 | LBY288 | 0.81 | 4.88E−02 | 4 | 19 |
| LBY288 | 0.91 | 1.25E−02 | 4 | 62 | LBY288 | 0.82 | 4.53E−02 | 4 | 42 |
| LBY288 | 0.70 | 1.55E−02 | 10 | 50 | LBY288 | 0.82 | 2.20E−03 | 10 | 55 |
| LBY288 | 0.82 | 2.49E−02 | 11 | 26 | LBY288 | 0.71 | 7.43E−02 | 11 | 5 |
| LBY288 | 0.72 | 6.72E−02 | 11 | 27 | LBY288 | 0.72 | 6.87E−02 | 11 | 8 |
| LBY288 | 0.86 | 5.94E−04 | 13 | 1 | LBY288 | 0.86 | 5.94E−04 | 13 | 47 |
| LBY288 | 0.77 | 5.75E−03 | 13 | 13 | LBY288 | 0.74 | 2.37E−02 | 13 | 39 |
| LBY288 | 0.78 | 4.57E−03 | 13 | 9 | LBY288 | 0.78 | 5.02E−03 | 13 | 2 |
| LBY288 | 0.94 | 6.73E−05 | 15 | 55 | LBY288 | 0.84 | 2.62E−03 | 15 | 57 |
| LBY288 | 0.82 | 3.51E−03 | 15 | 15 | LBY288 | 0.80 | 5.15E−03 | 15 | 14 |
| LBY288 | 0.97 | 5.24E−06 | 15 | 18 | LBY288 | 0.93 | 9.49E−05 | 15 | 29 |
| LBY288 | 0.77 | 7.49E−02 | 12 | 45 | LBY288 | 0.75 | 8.88E−02 | 12 | 23 |
| LBY288 | 0.81 | 4.88E−02 | 12 | 19 | LBY288 | 0.82 | 4.53E−02 | 12 | 42 |
| LBY355 | 0.90 | 5.97E−03 | 3 | 26 | LBY355 | 0.85 | 1.54E−02 | 3 | 5 |
| LBY355 | 0.81 | 2.60E−02 | 3 | 27 | LBY355 | 0.80 | 3.17E−02 | 3 | 2 |
| LBY355 | 0.71 | 7.36E−02 | 3 | 3 | LBY355 | 0.81 | 2.87E−02 | 3 | 8 |
| LBY355 | 0.74 | 9.47E−03 | 5 | 8 | LBY355 | 0.72 | 1.26E−02 | 8 | 36 |
| LBY355 | 0.73 | 1.72E−02 | 7 | 30 | LBY355 | 0.90 | 1.57E−02 | 4 | 1 |
| LBY355 | 0.82 | 4.67E−02 | 4 | 54 | LBY355 | 0.90 | 1.57E−02 | 4 | 47 |
| LBY355 | 0.72 | 1.07E−01 | 4 | 16 | LBY355 | 0.75 | 8.46E−02 | 4 | 7 |
| LBY355 | 0.90 | 1.41E−02 | 4 | 39 | LBY355 | 0.77 | 7.42E−02 | 4 | 9 |
| LBY355 | 0.73 | 1.04E−02 | 1 | 6 | LBY355 | 0.90 | 5.97E−03 | 11 | 26 |
| LBY355 | 0.85 | 1.54E−02 | 11 | 5 | LBY355 | 0.81 | 2.60E−02 | 11 | 27 |
| LBY355 | 0.80 | 3.17E−02 | 11 | 2 | LBY355 | 0.71 | 7.36E−02 | 11 | 3 |
| LBY355 | 0.81 | 2.87E−02 | 11 | 8 | LBY355 | 0.74 | 9.47E−03 | 13 | 8 |
| LBY355 | 0.72 | 1.26E−02 | 16 | 36 | LBY355 | 0.73 | 1.72E−02 | 15 | 30 |
| LBY355 | 0.90 | 1.57E−02 | 12 | 1 | LBY355 | 0.82 | 4.67E−02 | 12 | 54 |
| LBY355 | 0.90 | 1.57E−02 | 12 | 47 | LBY355 | 0.72 | 1.07E−01 | 12 | 16 |
| LBY355 | 0.75 | 8.46E−02 | 12 | 7 | LBY355 | 0.90 | 1.41E−02 | 12 | 39 |
| LBY355 | 0.77 | 7.42E−02 | 12 | 9 | LBY355 | 0.73 | 1.04E−02 | 9 | 6 |
| LBY356 | 0.70 | 1.58E−02 | 2 | 19 | LBY356 | 0.75 | 2.04E−02 | 2 | 60 |
| LBY356 | 0.88 | 9.70E−03 | 3 | 26 | LBY356 | 0.73 | 6.03E−02 | 3 | 43 |
| LBY356 | 0.87 | 1.04E−02 | 3 | 5 | LBY356 | 0.76 | 7.79E−02 | 3 | 38 |
| LBY356 | 0.78 | 3.66E−02 | 3 | 13 | LBY356 | 0.74 | 5.63E−02 | 3 | 4 |
| LBY356 | 0.72 | 6.68E−02 | 3 | 27 | LBY356 | 0.80 | 3.24E−02 | 3 | 24 |
| LBY356 | 0.79 | 3.29E−02 | 3 | 9 | LBY356 | 0.87 | 1.16E−02 | 3 | 2 |
| LBY356 | 0.81 | 2.59E−02 | 3 | 3 | LBY356 | 0.88 | 9.49E−03 | 3 | 8 |
| LBY356 | 0.75 | 8.20E−03 | 5 | 7 | LBY356 | 0.97 | 3.99E−06 | 7 | 61 |
| LBY356 | 0.78 | 7.38E−03 | 7 | 53 | LBY356 | 0.71 | 2.07E−02 | 7 | 23 |
| LBY356 | 0.83 | 3.16E−03 | 7 | 19 | LBY356 | 0.72 | 4.50E−02 | 7 | 35 |
| LBY356 | 0.90 | 4.10E−04 | 7 | 62 | LBY356 | 0.73 | 3.94E−02 | 7 | 34 |
| LBY356 | 0.79 | 6.83E−03 | 7 | 29 | LBY356 | 0.83 | 4.04E−02 | 4 | 41 |
| LBY356 | 0.74 | 9.27E−02 | 4 | 28 | LBY356 | 0.71 | 1.12E−01 | 4 | 58 |
| LBY356 | 0.76 | 6.91E−03 | 1 | 30 | LBY356 | 0.70 | 1.58E−02 | 10 | 19 |
| LBY356 | 0.73 | 6.03E−02 | 11 | 43 | LBY356 | 0.88 | 9.70E−03 | 11 | 26 |
| LBY356 | 0.87 | 1.04E−02 | 11 | 5 | LBY356 | 0.76 | 7.79E−02 | 11 | 38 |
| LBY356 | 0.78 | 3.66E−02 | 11 | 13 | LBY356 | 0.74 | 5.63E−02 | 11 | 4 |
| LBY356 | 0.72 | 6.68E−02 | 11 | 27 | LBY356 | 0.80 | 3.24E−02 | 11 | 24 |
| LBY356 | 0.79 | 3.29E−02 | 11 | 9 | LBY356 | 0.87 | 1.16E−02 | 11 | 2 |
| LBY356 | 0.81 | 2.59E−02 | 11 | 3 | LBY356 | 0.88 | 9.49E−03 | 11 | 8 |
| LBY356 | 0.75 | 8.20E−03 | 13 | 7 | LBY356 | 0.78 | 7.38E−03 | 15 | 53 |
| LBY356 | 0.71 | 2.07E−02 | 15 | 23 | LBY356 | 0.83 | 3.16E−03 | 15 | 19 |
| LBY356 | 0.72 | 4.50E−02 | 15 | 35 | LBY356 | 0.73 | 3.94E−02 | 15 | 34 |
| LBY356 | 0.79 | 6.83E−03 | 15 | 29 | LBY356 | 0.83 | 4.04E−02 | 12 | 41 |
| LBY356 | 0.74 | 9.27E−02 | 12 | 28 | LBY356 | 0.71 | 1.12E−01 | 12 | 58 |
| LBY356 | 0.76 | 6.91E−03 | 9 | 30 | LBY357 | 0.70 | 1.56E−02 | 2 | 12 |
| LBY357 | 0.75 | 8.49E−03 | 2 | 51 | LBY357 | 0.84 | 1.78E−02 | 3 | 26 |
| LBY357 | 0.74 | 5.81E−02 | 3 | 10 | LBY357 | 0.84 | 1.79E−02 | 3 | 50 |
| LBY357 | 0.75 | 5.05E−02 | 3 | 5 | LBY357 | 0.80 | 5.84E−02 | 3 | 38 |
| LBY357 | 0.90 | 5.83E−03 | 3 | 13 | LBY357 | 0.82 | 2.48E−02 | 3 | 7 |
| LBY357 | 0.75 | 5.18E−02 | 3 | 4 | LBY357 | 0.75 | 5.28E−02 | 3 | 27 |
| LBY357 | 0.80 | 2.96E−02 | 3 | 9 | LBY357 | 0.79 | 3.44E−02 | 3 | 2 |

TABLE 241-continued

Correlation between the expression level of selected genes of
some embodiments of the invention in various tissues and
the phenotypic performance under low N conditions across wheat accessions

| Gene Name | R | P value | Exp. set | Corr. ID | Gene Name | R | P value | Exp. set | Corr. ID |
|---|---|---|---|---|---|---|---|---|---|
| LBY357 | 0.82 | 2.28E−02 | 3 | 3 | LBY357 | 0.86 | 1.39E−02 | 3 | 6 |
| LBY357 | 0.84 | 1.79E−02 | 3 | 8 | LBY357 | 0.70 | 2.34E−02 | 7 | 12 |
| LBY357 | 0.70 | 1.20E−01 | 4 | 53 | LBY357 | 0.86 | 2.83E−02 | 4 | 46 |
| LBY357 | 0.83 | 4.06E−02 | 4 | 31 | LBY357 | 0.72 | 1.26E−02 | 1 | 30 |
| LBY357 | 0.70 | 1.56E−02 | 10 | 12 | LBY357 | 0.75 | 8.49E−03 | 10 | 51 |
| LBY357 | 0.84 | 1.78E−02 | 11 | 26 | LBY357 | 0.74 | 5.81E−02 | 11 | 10 |
| LBY357 | 0.84 | 1.79E−02 | 11 | 50 | LBY357 | 0.75 | 5.05E−02 | 11 | 5 |
| LBY357 | 0.80 | 5.84E−02 | 11 | 38 | LBY357 | 0.90 | 5.83E−03 | 11 | 13 |
| LBY357 | 0.82 | 2.48E−02 | 11 | 7 | LBY357 | 0.75 | 5.18E−02 | 11 | 4 |
| LBY357 | 0.75 | 5.28E−02 | 11 | 27 | LBY357 | 0.80 | 2.96E−02 | 11 | 9 |
| LBY357 | 0.79 | 3.44E−02 | 11 | 2 | LBY357 | 0.82 | 2.28E−02 | 11 | 3 |
| LBY357 | 0.86 | 1.39E−02 | 11 | 6 | LBY357 | 0.84 | 1.79E−02 | 11 | 8 |
| LBY357 | 0.70 | 2.34E−02 | 15 | 12 | LBY357 | 0.70 | 1.20E−01 | 12 | 53 |
| LBY357 | 0.86 | 2.83E−02 | 12 | 46 | LBY357 | 0.83 | 4.06E−02 | 12 | 31 |
| LBY357 | 0.72 | 1.26E−02 | 9 | 30 | LBY358 | 0.75 | 7.58E−03 | 2 | 10 |
| LBY358 | 0.86 | 7.40E−04 | 2 | 23 | LBY358 | 0.80 | 3.03E−03 | 2 | 45 |
| LBY358 | 0.70 | 1.62E−02 | 2 | 15 | LBY358 | 0.78 | 4.96E−03 | 2 | 14 |
| LBY358 | 0.85 | 9.79E−04 | 2 | 24 | LBY358 | 0.76 | 7.98E−03 | 3 | 32 |
| LBY358 | 0.76 | 7.76E−02 | 3 | 33 | LBY358 | 0.76 | 4.64E−02 | 3 | 57 |
| LBY358 | 0.91 | 1.10E−02 | 3 | 35 | LBY358 | 0.77 | 7.29E−02 | 3 | 34 |
| LBY358 | 0.73 | 6.35E−02 | 3 | 14 | LBY358 | 0.76 | 4.75E−02 | 3 | 24 |
| LBY358 | 0.70 | 1.58E−02 | 5 | 7 | LBY358 | 0.83 | 1.38E−02 | 5 | 6 |
| LBY358 | 0.74 | 2.16E−02 | 8 | 32 | LBY358 | 0.90 | 1.04E−03 | 8 | 33 |
| LBY358 | 0.76 | 1.70E−02 | 8 | 35 | LBY358 | 0.81 | 4.83E−02 | 4 | 12 |
| LBY358 | 0.73 | 9.82E−02 | 4 | 1 | LBY358 | 0.89 | 1.79E−02 | 4 | 10 |
| LBY358 | 0.95 | 4.04E−03 | 4 | 51 | LBY358 | 0.73 | 9.82E−02 | 4 | 47 |
| LBY358 | 0.70 | 1.19E−01 | 4 | 16 | LBY358 | 0.81 | 5.26E−02 | 4 | 11 |
| LBY358 | 0.76 | 8.24E−02 | 4 | 13 | LBY358 | 0.74 | 9.35E−02 | 4 | 4 |
| LBY358 | 0.72 | 1.09E−01 | 4 | 15 | LBY358 | 0.70 | 1.21E−01 | 4 | 14 |
| LBY358 | 0.73 | 9.78E−02 | 4 | 9 | LBY358 | 0.78 | 6.92E−02 | 4 | 2 |
| LBY358 | 0.72 | 1.10E−01 | 4 | 49 | LBY358 | 0.82 | 2.00E−03 | 1 | 53 |
| LBY358 | 0.84 | 1.09E−03 | 1 | 30 | LBY358 | 0.78 | 4.64E−03 | 1 | 36 |
| LBY358 | 0.74 | 9.56E−03 | 6 | 12 | LBY358 | 0.78 | 4.34E−03 | 6 | 14 |
| LBY358 | 0.75 | 7.58E−03 | 10 | 10 | LBY358 | 0.80 | 3.03E−03 | 10 | 45 |
| LBY358 | 0.86 | 7.40E−04 | 10 | 23 | LBY358 | 0.70 | 1.62E−02 | 10 | 15 |
| LBY358 | 0.78 | 4.96E−03 | 10 | 14 | LBY358 | 0.85 | 9.79E−04 | 10 | 24 |
| LBY358 | 0.76 | 7.98E−02 | 11 | 32 | LBY358 | 0.76 | 7.76E−02 | 11 | 33 |
| LBY358 | 0.76 | 4.64E−02 | 11 | 57 | LBY358 | 0.91 | 1.10E−02 | 11 | 35 |
| LBY358 | 0.77 | 7.29E−02 | 11 | 34 | LBY358 | 0.73 | 6.35E−02 | 11 | 14 |
| LBY358 | 0.76 | 4.75E−02 | 11 | 24 | LBY358 | 0.70 | 1.58E−02 | 13 | 7 |
| LBY358 | 0.83 | 1.38E−03 | 13 | 6 | LBY358 | 0.74 | 2.16E−02 | 16 | 32 |
| LBY358 | 0.90 | 1.04E−03 | 16 | 33 | LBY358 | 0.76 | 1.70E−02 | 16 | 35 |
| LBY358 | 0.81 | 4.83E−02 | 12 | 12 | LBY358 | 0.73 | 9.82E−02 | 12 | 1 |
| LBY358 | 0.89 | 1.79E−02 | 12 | 10 | LBY358 | 0.95 | 4.04E−03 | 12 | 51 |
| LBY358 | 0.73 | 9.82E−02 | 12 | 47 | LBY358 | 0.81 | 5.26E−02 | 12 | 11 |
| LBY358 | 0.70 | 1.19E−01 | 12 | 16 | LBY358 | 0.76 | 8.24E−02 | 12 | 13 |
| LBY358 | 0.74 | 9.35E−02 | 12 | 4 | LBY358 | 0.72 | 1.09E−01 | 12 | 15 |
| LBY358 | 0.70 | 1.21E−01 | 12 | 14 | LBY358 | 0.73 | 9.78E−02 | 12 | 9 |
| LBY358 | 0.78 | 6.92E−02 | 12 | 2 | LBY358 | 0.72 | 1.10E−01 | 12 | 49 |
| LBY358 | 0.82 | 2.00E−03 | 9 | 53 | LBY358 | 0.78 | 4.64E−03 | 9 | 36 |
| LBY358 | 0.84 | 1.09E−03 | 9 | 30 | LBY358 | 0.74 | 9.56E−03 | 14 | 12 |
| LBY358 | 0.78 | 4.34E−03 | 14 | 14 | LBY359 | 0.80 | 9.62E−03 | 2 | 31 |
| LBY359 | 0.75 | 3.31E−02 | 7 | 33 | LBY359 | 0.74 | 3.74E−02 | 7 | 31 |
| LBY359 | 0.94 | 5.08E−03 | 4 | 12 | LBY359 | 0.72 | 1.08E−01 | 4 | 1 |
| LBY359 | 0.81 | 4.89E−02 | 4 | 51 | LBY359 | 0.72 | 1.08E−01 | 4 | 47 |
| LBY359 | 0.76 | 7.74E−02 | 4 | 11 | LBY359 | 0.76 | 8.15E−02 | 4 | 46 |
| LBY359 | 0.76 | 8.16E−02 | 4 | 52 | LBY359 | 0.88 | 2.18E−02 | 4 | 49 |
| LBY359 | 0.76 | 6.10E−03 | 1 | 61 | LBY359 | 0.81 | 8.80E−03 | 1 | 33 |
| LBY359 | 0.72 | 1.30E−02 | 1 | 53 | LBY359 | 0.75 | 7.79E−03 | 1 | 55 |
| LBY359 | 0.80 | 3.18E−03 | 1 | 57 | LBY359 | 0.88 | 3.34E−04 | 1 | 62 |
| LBY359 | 0.72 | 1.28E−02 | 1 | 15 | LBY359 | 0.75 | 8.07E−03 | 1 | 14 |
| LBY359 | 0.91 | 8.07E−05 | 1 | 18 | LBY359 | 0.95 | 5.67E−06 | 1 | 29 |
| LBY359 | 0.77 | 5.70E−03 | 6 | 61 | LBY359 | 0.76 | 7.00E−03 | 6 | 53 |
| LBY359 | 0.83 | 1.59E−03 | 6 | 55 | LBY359 | 0.73 | 1.15E−02 | 6 | 57 |
| LBY359 | 0.81 | 2.44E−03 | 6 | 62 | LBY359 | 0.81 | 2.67E−03 | 6 | 15 |
| LBY359 | 0.77 | 5.76E−03 | 6 | 14 | LBY359 | 0.91 | 8.99E−05 | 6 | 18 |
| LBY359 | 0.89 | 2.25E−04 | 6 | 29 | LBY359 | 0.80 | 9.62E−03 | 10 | 31 |
| LBY359 | 0.75 | 3.31E−02 | 15 | 33 | LBY359 | 0.74 | 3.74E−02 | 15 | 31 |
| LBY359 | 0.94 | 5.08E−03 | 12 | 12 | LBY359 | 0.72 | 1.08E−01 | 12 | 1 |
| LBY359 | 0.81 | 4.89E−02 | 12 | 51 | LBY359 | 0.72 | 1.08E−01 | 12 | 47 |
| LBY359 | 0.76 | 7.74E−02 | 12 | 11 | LBY359 | 0.76 | 8.15E−02 | 12 | 46 |
| LBY359 | 0.76 | 8.16E−02 | 12 | 52 | LBY359 | 0.88 | 2.18E−02 | 12 | 49 |
| LBY359 | 0.81 | 8.80E−03 | 9 | 33 | LBY359 | 0.72 | 1.30E−02 | 9 | 53 |

TABLE 241-continued

Correlation between the expression level of selected genes of
some embodiments of the invention in various tissues and
the phenotypic performance under low N conditions across wheat accessions

| Gene Name | R | P value | Exp. set | Corr. ID | Gene Name | R | P value | Exp. set | Corr. ID |
|---|---|---|---|---|---|---|---|---|---|
| LBY359 | 0.75 | 7.79E−03 | 9 | 55 | LBY359 | 0.80 | 3.18E−03 | 9 | 57 |
| LBY359 | 0.72 | 1.28E−02 | 9 | 15 | LBY359 | 0.75 | 8.07E−03 | 9 | 14 |
| LBY359 | 0.91 | 8.07E−05 | 9 | 18 | LBY359 | 0.95 | 5.67E−06 | 9 | 29 |
| LBY359 | 0.76 | 7.00E−03 | 14 | 53 | LBY359 | 0.83 | 1.59E−03 | 14 | 55 |
| LBY359 | 0.73 | 1.15E−02 | 14 | 57 | LBY359 | 0.81 | 2.67E−03 | 14 | 15 |
| LBY359 | 0.77 | 5.76E−03 | 14 | 14 | LBY359 | 0.91 | 8.99E−05 | 14 | 18 |
| LBY359 | 0.89 | 2.25E−04 | 14 | 29 | LBY460 | 0.88 | 3.67E−04 | 2 | 57 |
| LBY460 | 0.70 | 1.55E−02 | 2 | 15 | LBY460 | 0.72 | 6.84E−02 | 3 | 1 |
| LBY460 | 0.72 | 6.84E−02 | 3 | 47 | LBY460 | 0.89 | 1.69E−02 | 3 | 38 |
| LBY460 | 0.72 | 1.05E−01 | 3 | 39 | LBY460 | 0.88 | 3.67E−04 | 10 | 57 |
| LBY460 | 0.70 | 1.55E−02 | 10 | 15 | LBY460 | 0.72 | 6.84E−02 | 11 | 1 |
| LBY460 | 0.72 | 6.84E−02 | 11 | 47 | LBY460 | 0.89 | 1.69E−02 | 11 | 38 |
| LBY460 | 0.72 | 1.05E−01 | 11 | 39 | LBY461 | 0.81 | 8.54E−03 | 2 | 33 |
| LBY461 | 0.71 | 3.07E−02 | 5 | 31 | LBY461 | 0.97 | 1.34E−05 | 4 | 61 |
| LBY461 | 0.82 | 4.58E−02 | 4 | 23 | LBY461 | 0.89 | 1.67E−02 | 4 | 19 |
| LBY461 | 0.94 | 5.85E−03 | 4 | 62 | LBY461 | 0.81 | 5.00E−02 | 4 | 42 |
| LBY461 | 0.75 | 8.83E−02 | 4 | 24 | LBY461 | 0.80 | 5.78E−02 | 4 | 29 |
| LBY461 | 0.74 | 2.14E−02 | 1 | 32 | LBY461 | 0.78 | 1.35E−02 | 1 | 35 |
| LBY461 | 0.78 | 1.23E−02 | 1 | 34 | LBY461 | 0.81 | 7.89E−03 | 6 | 32 |
| LBY461 | 0.81 | 8.05E−03 | 6 | 35 | LBY461 | 0.82 | 6.51E−03 | 6 | 34 |
| LBY461 | 0.81 | 8.54E−03 | 10 | 33 | LBY461 | 0.71 | 3.07E−02 | 13 | 31 |
| LBY461 | 0.82 | 4.58E−02 | 12 | 23 | LBY461 | 0.89 | 1.67E−02 | 12 | 19 |
| LBY461 | 0.81 | 5.00E−02 | 12 | 42 | LBY461 | 0.75 | 8.83E−02 | 12 | 24 |
| LBY461 | 0.80 | 5.78E−02 | 12 | 29 | LBY461 | 0.74 | 2.14E−02 | 9 | 32 |
| LBY461 | 0.78 | 1.35E−02 | 9 | 35 | LBY461 | 0.78 | 1.23E−02 | 9 | 34 |
| LBY461 | 0.81 | 7.89E−03 | 14 | 32 | LBY461 | 0.81 | 8.05E−03 | 14 | 35 |
| LBY461 | 0.82 | 6.51E−03 | 14 | 34 | | | | | |

Table 241. Provided are the correlations (R) between the genes expression levels in various tissues and the phenotypic performance (Tables 236-237).
"Corr. ID"—correlation vector ID according to the correlated parameters specified in Table 229.
"Exp. Set"—Expression set specified in Table 228.
"R" = Pearson correlation coefficient;
"P" = p value.

TABLE 242

Correlation between the expression level of selected genes of
some embodiments of the invention in various tissues and
the phenotypic performance under low N vs. normal conditions
(ratio) across wheat accessions

| Gene Name | R | P value | Exp. set | Corr. ID | Gene Name | R | P value | Exp. set | Corr. ID |
|---|---|---|---|---|---|---|---|---|---|
| LBY287 | 0.72 | 6.58E−02 | 3 | 10 | LBY287 | 0.82 | 2.49E−02 | 3 | 26 |
| LBY287 | 0.72 | 6.58E−02 | 11 | 10 | LBY287 | 0.82 | 2.49E−02 | 11 | 26 |
| LBY288 | 0.71 | 1.10E−01 | 3 | 7 | LBY288 | 0.76 | 1.09E−02 | 7 | 1 |
| LBY288 | 0.73 | 1.64E−02 | 7 | 20 | LBY288 | 0.93 | 6.64E−03 | 4 | 1 |
| LBY288 | 0.92 | 9.06E−03 | 4 | 25 | LBY288 | 0.95 | 3.44E−03 | 4 | 8 |
| LBY288 | 0.85 | 3.19E−02 | 4 | 6 | LBY288 | 0.71 | 1.10E−01 | 11 | 7 |
| LBY288 | 0.73 | 1.64E−02 | 15 | 20 | LBY288 | 0.92 | 9.06E−03 | 12 | 25 |
| LBY288 | 0.95 | 3.44E−03 | 12 | 8 | LBY288 | 0.85 | 3.19E−02 | 12 | 6 |
| LBY355 | 0.88 | 2.13E−02 | 3 | 7 | LBY355 | 0.76 | 4.79E−02 | 3 | 8 |
| LBY355 | 0.83 | 2.16E−02 | 3 | 6 | LBY355 | 0.86 | 7.11E−04 | 5 | 8 |
| LBY355 | 0.75 | 7.84E−03 | 5 | 6 | LBY355 | 0.92 | 4.80E−05 | 8 | 8 |
| LBY355 | 0.85 | 8.95E−04 | 8 | 6 | LBY355 | 0.74 | 8.89E−03 | 6 | 12 |
| LBY355 | 0.88 | 2.13E−02 | 11 | 7 | LBY355 | 0.76 | 4.79E−02 | 11 | 8 |
| LBY355 | 0.83 | 2.16E−02 | 11 | 6 | LBY355 | 0.86 | 7.11E−04 | 13 | 8 |
| LBY355 | 0.75 | 7.84E−03 | 13 | 6 | LBY355 | 0.92 | 4.80E−05 | 16 | 8 |
| LBY355 | 0.85 | 8.95E−04 | 16 | 6 | LBY355 | 0.74 | 8.89E−03 | 14 | 12 |
| LBY356 | 0.88 | 1.98E−02 | 3 | 7 | LBY356 | 0.77 | 5.21E−03 | 5 | 8 |
| LBY356 | 0.78 | 8.35E−03 | 8 | 7 | LBY356 | 0.79 | 6.20E−02 | 4 | 11 |
| LBY356 | 0.78 | 6.72E−02 | 4 | 29 | LBY356 | 0.88 | 2.18E−02 | 4 | 12 |
| LBY356 | 0.79 | 6.31E−02 | 4 | 23 | LBY356 | 0.71 | 1.52E−02 | 6 | 28 |
| LBY356 | 0.71 | 1.52E−02 | 6 | 22 | LBY356 | 0.88 | 1.98E−02 | 11 | 7 |
| LBY356 | 0.77 | 5.21E−03 | 13 | 8 | LBY356 | 0.78 | 8.35E−03 | 16 | 7 |
| LBY356 | 0.79 | 6.20E−02 | 12 | 11 | LBY356 | 0.78 | 6.72E−02 | 12 | 29 |
| LBY356 | 0.88 | 2.18E−02 | 12 | 12 | LBY356 | 0.79 | 6.31E−02 | 12 | 23 |
| LBY356 | 0.71 | 1.52E−02 | 14 | 28 | LBY356 | 0.71 | 1.52E−02 | 14 | 22 |
| LBY357 | 0.77 | 6.03E−03 | 2 | 24 | LBY357 | 0.72 | 1.22E−02 | 2 | 12 |
| LBY357 | 0.94 | 4.96E−05 | 7 | 24 | LBY357 | 0.79 | 2.04E−02 | 7 | 14 |

TABLE 242-continued

Correlation between the expression level of selected genes of some embodiments of the invention in various tissues and the phenotypic performance under low N vs. normal conditions (ratio) across wheat accessions

| Gene Name | R | P value | Exp. set | Corr. ID | Gene Name | R | P value | Exp. set | Corr. ID |
|---|---|---|---|---|---|---|---|---|---|
| LBY357 | 0.93 | 7.29E−03 | 4 | 24 | LBY357 | 0.77 | 6.03E−03 | 10 | 24 |
| LBY357 | 0.72 | 1.22E−02 | 10 | 12 | LBY357 | 0.94 | 4.96E−05 | 15 | 24 |
| LBY357 | 0.79 | 2.04E−02 | 15 | 14 | LBY357 | 0.93 | 7.29E−03 | 12 | 24 |
| LBY358 | 0.72 | 1.81E−02 | 2 | 7 | LBY358 | 0.83 | 2.06E−02 | 3 | 13 |
| LBY358 | 0.72 | 1.24E−02 | 5 | 8 | LBY358 | 0.88 | 8.09E−04 | 7 | 11 |
| LBY358 | 0.90 | 4.25E−04 | 7 | 29 | LBY358 | 0.81 | 4.75E−03 | 7 | 12 |
| LBY358 | 0.77 | 7.25E−02 | 4 | 5 | LBY358 | 0.86 | 2.67E−02 | 4 | 26 |
| LBY358 | 0.84 | 4.39E−03 | 6 | 14 | LBY358 | 0.72 | 1.81E−02 | 10 | 7 |
| LBY358 | 0.83 | 2.06E−02 | 11 | 13 | LBY358 | 0.72 | 1.24E−02 | 13 | 8 |
| LBY358 | 0.88 | 8.09E−04 | 15 | 11 | LBY358 | 0.90 | 4.25E−04 | 15 | 29 |
| LBY358 | 0.81 | 4.75E−03 | 15 | 12 | LBY358 | 0.77 | 7.25E−02 | 12 | 5 |
| LBY358 | 0.86 | 2.67E−02 | 12 | 26 | LBY358 | 0.84 | 4.39E−03 | 14 | 14 |
| LBY359 | 0.70 | 3.48E−02 | 2 | 14 | LBY359 | 0.84 | 1.81E−02 | 3 | 26 |
| LBY359 | 0.74 | 9.45E−02 | 3 | 18 | LBY359 | 0.85 | 1.95E−03 | 5 | 18 |
| LBY359 | 0.91 | 6.67E−04 | 7 | 18 | LBY359 | 0.74 | 9.07E−02 | 4 | 24 |
| LBY359 | 0.85 | 3.07E−02 | 4 | 14 | LBY359 | 0.76 | 6.14E−03 | 1 | 1 |
| LBY359 | 0.78 | 4.83E−03 | 1 | 20 | LBY359 | 0.80 | 5.82E−03 | 1 | 15 |
| LBY359 | 0.72 | 1.28E−02 | 6 | 1 | LBY359 | 0.70 | 3.48E−02 | 10 | 14 |
| LBY359 | 0.84 | 1.81E−02 | 11 | 26 | LBY359 | 0.74 | 9.45E−02 | 11 | 18 |
| LBY359 | 0.85 | 1.95E−03 | 13 | 18 | LBY359 | 0.91 | 6.67E−04 | 15 | 18 |
| LBY359 | 0.74 | 9.07E−02 | 12 | 24 | LBY359 | 0.85 | 3.07E−02 | 12 | 14 |
| LBY359 | 0.78 | 4.83E−03 | 9 | 20 | LBY359 | 0.80 | 5.82E−03 | 9 | 15 |
| LBY460 | 0.79 | 3.72E−03 | 2 | 20 | LBY460 | 0.70 | 3.45E−02 | 2 | 14 |
| LBY460 | 0.77 | 4.46E−02 | 3 | 19 | LBY460 | 0.79 | 3.72E−03 | 10 | 20 |
| LBY460 | 0.70 | 3.45E−02 | 10 | 14 | LBY460 | 0.77 | 4.46E−02 | 11 | 19 |
| LBY461 | 0.73 | 6.00E−02 | 3 | 20 | LBY461 | 0.74 | 8.85E−03 | 5 | 19 |
| LBY461 | 0.75 | 1.24E−02 | 7 | 26 | LBY461 | 0.71 | 1.13E−01 | 4 | 1 |
| LBY461 | 0.80 | 5.64E−02 | 4 | 25 | LBY461 | 0.97 | 1.62E−03 | 4 | 7 |
| LBY461 | 0.93 | 7.64E−03 | 4 | 8 | LBY461 | 0.97 | 1.48E−03 | 4 | 6 |
| LBY461 | 0.73 | 6.00E−02 | 11 | 20 | LBY461 | 0.74 | 8.85E−03 | 13 | 19 |
| LBY461 | 0.75 | 1.24E−02 | 15 | 26 | LBY461 | 0.80 | 5.64E−02 | 12 | 25 |
| LBY461 | 0.97 | 1.62E−03 | 12 | 7 | LBY461 | 0.93 | 7.64E−03 | 12 | 8 |
| LBY461 | 0.97 | 1.48E−03 | 12 | 6 | | | | | |

Table 242. Provided are the correlations (R) between the genes expression levels in various tissues and the phenotypic performance (Tables 238-239).
"Corr. ID"—correlation vector ID according to the correlated parameters specified in Table 230.
"Exp. Set"—Expression set specified in Table 229.
"R" = Pearson correlation coefficient;
"P" = p value

Example 21

Production of Soybean (Glycine max) Transcriptome and High Throughput Correlation Analysis with Yield Parameters Using 60 KB. Soybean Oligonucleotide Micro-Arrays In order to produce a high throughput correlation analysis, the present inventors utilized a Soybean oligonucleotide micro-array, produced by Agilent Technologies [chem. (dot) agilent (dot) com/Scripts/PDS (dot) asp?lPage=50879]. The array oligonucleotide represents about 65,000 Soybean genes and transcripts. In order to define correlations between the levels of RNA expression with yield components or plant architecture related parameters or plant vigor related parameters, various plant characteristics of 142 different *Glycine max* varieties were analyzed and 17 varieties were further used for RNA expression analysis. The correlation between the RNA levels and the characterized parameters was analyzed using Pearson correlation test.

In order to produce 8 Soybean varieties transcriptome, the present inventors utilized an Illumina [illumina. (dot) com] high throughput sequencing technology, by using TruSeq Stranded Total RNA with Ribo-Zero Plant kit [illumina. (dot) com/products/truseq-stranded-total-rna-plant. (dot) html].

Correlation of Glycine max Genes' Expression Levels with Phenotypic Characteristics Across Ecotype

Experimental Procedures

142 Soybean varieties were grown in two repetitive blocks, in field. Briefly, the growing protocol was as follows: Soybean seeds were sown in soil and grown under normal conditions (no irrigation, good agronomic practices) which included high temperature about 84.4 (° F.), low temperature about 48.6 (° F.); total precipitation rainfall from May through September (from sowing until harvest) was about 28.42 inch (Temperatures about 10-15 degrees below average, effect on reproductive development between varieties).

In order to define correlations between the levels of RNA expression with yield components, plant architecture related parameters or vigor related parameters, 17 different Soybean varieties (out of 142 varieties) were analyzed and used for gene expression analysis. Analysis was performed at two pre-determined time periods: at vegetative stage (V5) and at pod set (R4-R5, when the soybean pods are formed).

TABLE 243

Soybean transcriptome expression sets

| Expression Set | Set ID |
|---|---|
| Stem at vegetative stage under normal growth condition | 1 |
| Apical meristem at vegetative stage under normal growth condition | 2 |
| Basal pods at pod setting stage under normal growth condition | 3 |
| Distal pods at pod setting stage under normal growth condition | 4 |
| Root branch at vegetative stage under normal growth condition | 5 |

Table 243. Provided are the identification (ID) digits of each of the Soybean expression sets. The samples were taken for micro-array analysis.

TABLE 244

Soybean transcriptome expression sets

| Expression Set | Set ID |
|---|---|
| Apical meristem at vegetative stage under normal growth condition | 1 |
| Basal pods at pod setting stage under normal growth condition | 2 |
| Distal pods at pod setting stage under normal growth condition | 3 |

Table 244. Provided are the identification (ID) digits of each of the Soybean expression sets. The samples were taken for RNA sequencing analysis (RNAseq).

RNA extraction—Selected Soybean varieties were sampled [17 varieties for micro-array analysis: lines 2, 4, 16, 22, 23, 25, 27, 53, 55, 70, 75, 76, 95, 102, 105, 127, 131 and 8 varieties for RNAseq analysis: lines 1, 6, 7, 27, 46, 70, 87, 108] and Plant tissues [Stem, apical meristem, basal and distal pods and root] growing under normal conditions were sampled and RNA was extracted as described above.

The collected data parameters were as follows:

Stem width at pod set [cm]—the diameter of the base of the main stem (based diameter), average of three plants per plot.

Pods on main stem at harvest [number]—number of pods on main stem at harvest, average of three plants per plot.

Nodes on main stem at harvest [number]—count of number of nodes on main stem starting from first node above ground, average of three plants per plot.

Plant height at harvest [cm]—Height of main stem, measure from first node above ground to last node before apex, average of three plants per plot.

Ratio of the number of pods per node on main stem at pod set—calculated in Formula 23 (above), average of three plants per plot.

Total yield per plot at harvest [gr.]—weight of all seeds on lateral branches and main stem at harvest, average of three plants per plot.

Days till 50% flowering [days]—number of days till 50% flowering for each plot.

Maturity [days]—measure as 95% of the pods in a plot have ripened (turned 100% brown). Delayed leaf drop and green stems are not considered in assigning maturity. Tests were observed 3 days per week, every other day, for maturity. The maturity date is the date that 95% of the pods have reached final color. Maturity is expressed in days after August 31 [according to the accepted definition of maturity in USA, Descriptor list for SOYBEAN, ars-grin (dot) gov/cgi-bin/npgs/html/desclist(dot)pl?51].

Reproductive period [days]—number of days till 50% flowering minus days to maturity.

Yield at harvest [bushels/hectare]—calculated at harvest (per 2 inner rows of a trimmed plot) as weight in grams of cleaned seeds, adjusted to 13% moisture, and then expressed as bushels per acre.

Main stem average internode length [cm]—Calculate plant height at pod set and divide by the total number of nodes on main stem at pod set.

Vegetative nodes growth rate [number/day]—Calculated in Formula 67 average of three plants per plot.

TABLE 245

Soybean correlated parameters (vectors)

| Correlated parameter with | Correlation ID |
|---|---|
| Stem width (PS) [cm] | 1 |
| Number of days to 50% flowering | 2 |
| Number days to Maturity | 3 |
| Reproductive Period [number] | 4 |
| Pods on main stem (H) [number] | 5 |
| Ratio number of pods per node on main stem [value] | 6 |
| Total yield per plot [gr] | 7 |
| bushels per acre [Kg] | 8 |
| Nodes on main stem (H) [number] | 9 |
| Plant height (H) [cm] | 10 |
| Main stem average internode length [number] | 11 |
| Vegetative nodes growth rate [number/day] | 12 |

Table 245.
"PS"—pod setting;
"H"—harvest;

Experimental Results 142 different Soybean varieties lines were grown and characterized for 12 parameters as specified above. Tissues for expression analysis were sampled from a subset of 17 lines. The correlated parameters are described in Table 245 above. The average for each of the measured parameters was calculated using the JMP software (Tables 246-250) and a subsequent correlation analysis was performed (Table 251-252). Results were then integrated to the database.

TABLE 246

Measured parameters in Soybean varieties (lines 1-32)

| Line/Corr. ID | 1 | 2 | 3 | 4 | 5 | 6 | 7 | 8 | 9 | 10 | 11 | 12 |
|---|---|---|---|---|---|---|---|---|---|---|---|---|
| Line-1 | 5.88 | 43.00 | 138.5 | 95.50 | 40.80 | 2.95 | 2481.5 | 67.70 | 13.80 | 263.0 | 19.10 | 0.53 |
| Line-2 | 6.31 | 44.00 | 136.0 | 92.00 | 40.50 | 3.16 | 2203.0 | 59.90 | 12.80 | 235.7 | 18.40 | 0.43 |
| Line-3 | NA | 44.00 | 131.0 | 87.00 | 35.30 | 2.96 | 2825.0 | 76.90 | 12.00 | 240.2 | 20.10 | NA |
| Line-4 | 7.27 | 40.50 | 132.0 | 91.50 | 33.00 | 2.71 | 2250.5 | 61.20 | 12.20 | 222.3 | 18.30 | 0.27 |
| Line-5 | NA | 42.50 | 131.0 | 88.50 | 40.30 | 3.27 | 2524.5 | 68.40 | 12.20 | 244.8 | 20.30 | NA |
| Line-6 | 6.73 | 42.50 | 131.0 | 88.50 | 30.80 | 2.85 | 2523.0 | 68.80 | 10.80 | 235.8 | 21.80 | NA |
| Line-7 | 6.39 | 37.50 | 123.0 | 85.50 | 41.80 | 3.22 | 2003.0 | 54.20 | 13.00 | 282.0 | 21.70 | 0.43 |
| Line-8 | 7.08 | 41.50 | 127.0 | 85.50 | 30.30 | 2.79 | 2389.0 | 65.00 | 10.80 | 285.7 | 26.30 | 0.43 |
| Line-9 | NA | 42.00 | 127.0 | 85.00 | 36.00 | 3.23 | 2169.0 | 59.00 | 11.20 | 218.7 | 19.50 | NA |
| Line-10 | NA | 39.00 | 136.5 | 97.50 | 35.70 | 3.18 | 2580.5 | 70.20 | 11.20 | 155.0 | 13.80 | NA |
| Line-11 | NA | 46.00 | 131.0 | 85.00 | 34.00 | 2.96 | 1357.0 | 36.90 | 11.50 | 227.2 | 19.80 | NA |

TABLE 246-continued

Measured parameters in Soybean varieties (lines 1-32)

| Line/Corr. ID | 1 | 2 | 3 | 4 | 5 | 6 | 7 | 8 | 9 | 10 | 11 | 12 |
|---|---|---|---|---|---|---|---|---|---|---|---|---|
| Line-12 | NA | 37.00 | 123.5 | 86.50 | 31.30 | 2.77 | 2123.0 | 57.90 | 11.30 | 222.2 | 19.70 | NA |
| Line-13 | 8.35 | 42.00 | 126.5 | 84.50 | 31.30 | 2.60 | 2771.0 | 75.30 | 12.00 | 231.3 | 19.30 | NA |
| Line-14 | NA | 41.50 | 125.0 | 83.50 | 33.50 | 3.09 | 2637.0 | 71.60 | 10.80 | 216.7 | 20.10 | NA |
| Line-15 | NA | 36.00 | 123.0 | 87.00 | 37.30 | 3.25 | 2650.0 | 72.30 | 11.50 | 183.5 | 15.90 | NA |
| Line-16 | 6.22 | 35.00 | 125.5 | 90.50 | 38.80 | 3.05 | 2985.5 | 81.70 | 12.70 | 228.0 | 18.10 | 0.67 |
| Line-17 | NA | 36.00 | 126.0 | 90.00 | 39.50 | 3.02 | 2942.0 | 80.40 | 13.00 | 247.0 | 19.00 | NA |
| Line-18 | NA | 37.00 | 121.0 | 84.00 | 44.20 | 3.12 | 2628.5 | 71.80 | 14.20 | 220.2 | 15.50 | NA |
| Line-19 | NA | 36.50 | 117.5 | 81.00 | 32.50 | 2.95 | 2470.5 | 67.50 | 11.00 | 242.0 | 22.00 | NA |
| Line-20 | 6.71 | 44.00 | 130.5 | 86.50 | 35.00 | 3.38 | 1719.5 | 46.60 | 10.20 | 278.8 | 28.40 | 0.33 |
| Line-21 | NA | 40.50 | 129.0 | 88.50 | 33.80 | 3.13 | 2103.5 | 57.30 | 10.80 | 213.3 | 19.70 | NA |
| Line-22 | 7.58 | 42.00 | 129.0 | 87.00 | 34.80 | 3.21 | 2265.5 | 61.60 | 10.80 | 234.0 | 21.60 | 0.43 |
| Line-23 | 6.11 | 38.50 | 121.5 | 83.00 | 36.80 | 3.45 | 1649.0 | 44.90 | 10.70 | 229.5 | 21.60 | 0.38 |
| Line-24 | NA | 36.00 | 123.5 | 87.50 | 43.30 | 3.51 | 2637.0 | 71.90 | 12.30 | 265.7 | 21.80 | NA |
| Line-25 | 8.88 | 39.00 | 135.0 | 96.00 | 43.80 | 3.33 | 2487.0 | 67.70 | 13.20 | 245.5 | 18.60 | 0.38 |
| Line-26 | 8.72 | 41.50 | 132.0 | 90.50 | 27.30 | 2.52 | 2091.0 | 56.90 | 10.80 | 244.3 | 22.60 | 0.77 |
| Line-27 | 5.50 | 42.50 | 114.0 | 71.50 | 35.80 | 2.87 | 2132.5 | 58.30 | 12.50 | 229.3 | 18.80 | 0.25 |
| Line-28 | NA | 35.00 | 115.0 | 80.00 | 32.70 | 3.11 | 2368.0 | 64.60 | 10.50 | 245.2 | 23.40 | NA |
| Line-29 | NA | 38.00 | 121.0 | 83.00 | 27.50 | 2.55 | 2370.5 | 64.40 | 10.80 | 245.0 | 22.70 | NA |
| Line-30 | 7.04 | 35.00 | 122.5 | 87.50 | 33.20 | 2.97 | 2363.5 | 64.60 | 11.20 | 255.2 | 22.90 | 0.43 |
| Line-31 | NA | 42.00 | 125.0 | 83.00 | 36.80 | 3.12 | 2737.5 | 74.10 | 11.70 | 273.2 | 23.70 | NA |
| Line-32 | NA | 38.00 | 125.0 | 87.00 | 38.50 | 2.95 | 2345.0 | 63.70 | 13.00 | 243.7 | 18.80 | NA |

Table 246.

TABLE 247

Measured parameters in Soybean varieties (lines 33-64)

| Line/Corr. ID | 1 | 2 | 3 | 4 | 5 | 6 | 7 | 8 | 9 | 10 | 11 | 12 |
|---|---|---|---|---|---|---|---|---|---|---|---|---|
| Line-33 | NA | 39.50 | 134.50 | 95.00 | 37.80 | 3.18 | 2186.50 | 59.60 | 11.80 | 246.70 | 20.90 | NA |
| Line-34 | 6.59 | 44.00 | 131.50 | 87.50 | 29.00 | 2.63 | 1194.00 | 32.40 | 11.00 | 311.50 | 28.40 | 0.53 |
| Line-35 | NA | 35.00 | 123.50 | 88.50 | 40.00 | 3.07 | 2741.00 | 74.40 | 13.00 | 288.00 | 22.50 | NA |
| Line-36 | NA | 40.50 | 121.00 | 80.50 | 41.70 | 3.25 | 2296.00 | 62.30 | 12.80 | 246.00 | 19.30 | NA |
| Line-37 | NA | 42.50 | 122.00 | 79.50 | 33.30 | 3.08 | 2034.50 | 55.90 | 10.80 | 253.20 | 23.60 | NA |
| Line-38 | 6.20 | 37.00 | 131.00 | 94.00 | 43.00 | 3.15 | 2575.50 | 68.90 | 13.70 | 240.50 | 17.60 | 0.38 |
| Line-39 | NA | 41.00 | 134.50 | 93.50 | 24.70 | 2.30 | 1831.00 | 49.80 | 10.70 | 249.00 | 23.40 | NA |
| Line-40 | NA | 44.50 | 126.50 | 82.00 | 27.20 | 2.84 | 2380.00 | 64.90 | 9.50 | 243.30 | 25.90 | NA |
| Line-41 | NA | 35.00 | 124.50 | 89.50 | 29.80 | 2.84 | 2277.50 | 61.70 | 10.50 | 242.80 | 23.30 | NA |
| Line-42 | NA | 40.00 | 134.00 | 94.00 | 36.00 | 2.96 | 1987.00 | 54.10 | 12.20 | 256.80 | 21.10 | NA |
| Line-43 | NA | 41.00 | 137.00 | 96.00 | 37.80 | 3.11 | 2096.00 | 57.00 | 12.20 | 260.80 | 21.40 | NA |
| Line-44 | NA | 35.00 | 123.50 | 88.50 | 27.30 | 2.52 | 2729.50 | 74.20 | 10.80 | 257.30 | 23.80 | NA |
| Line-45 | NA | 41.00 | 133.50 | 92.50 | 38.30 | 3.15 | 1696.00 | 46.20 | 12.20 | 234.30 | 19.20 | NA |
| Line-46 | 5.83 | 39.50 | 122.00 | 82.50 | 38.30 | 2.91 | 1305.50 | 35.20 | 13.20 | 236.20 | 17.90 | 0.58 |
| Line-47 | NA | 41.00 | 131.00 | 90.00 | 30.30 | 2.56 | 1783.50 | 48.40 | 11.80 | 320.30 | 27.10 | NA |
| Line-48 | NA | 37.50 | 123.00 | 85.50 | 31.20 | 2.83 | 2266.00 | 61.50 | 11.00 | 239.00 | 21.70 | NA |
| Line-49 | 8.07 | 38.50 | 130.50 | 92.00 | 26.50 | 2.44 | 1387.50 | 37.70 | 10.80 | 287.80 | 26.60 | 0.55 |
| Line-50 | NA | 39.00 | 126.00 | 87.00 | 28.80 | 2.54 | 1704.50 | 46.20 | 11.30 | 255.20 | 22.60 | NA |
| Line-51 | NA | 40.00 | 124.50 | 84.50 | 39.30 | 3.33 | 1784.50 | 48.60 | 11.80 | 253.00 | 21.40 | NA |
| Line-52 | 8.03 | 42.00 | 137.00 | 95.00 | 32.70 | 2.65 | 2530.00 | 68.90 | 12.30 | 279.50 | 22.70 | 0.37 |
| Line-53 | 7.03 | 42.50 | 135.50 | 93.00 | 38.80 | 3.02 | 2584.00 | 70.40 | 12.80 | 264.30 | 20.70 | 0.67 |
| Line-54 | NA | 42.00 | 132.00 | 90.00 | 30.70 | 2.74 | 2418.00 | 65.70 | 11.20 | 236.80 | 21.30 | NA |
| Line-55 | 8.63 | 41.00 | 135.00 | 94.00 | 34.20 | 3.11 | 2820.50 | 76.40 | 11.70 | 244.50 | 22.20 | 0.48 |
| Line-56 | NA | 43.50 | 126.50 | 83.00 | 28.80 | 2.58 | 2397.00 | 65.20 | 11.20 | 295.30 | 26.60 | NA |
| Line-57 | NA | 37.00 | 126.50 | 89.50 | 29.00 | 2.85 | 1779.50 | 48.50 | 10.20 | 250.50 | 24.80 | NA |
| Line-58 | NA | 41.00 | 124.50 | 83.50 | 24.80 | 2.41 | 2786.50 | 75.60 | 10.30 | 225.00 | 21.80 | NA |
| Line-59 | NA | 40.00 | 130.50 | 90.50 | 35.50 | 2.98 | 2639.00 | 71.80 | 11.80 | 233.50 | 19.90 | NA |
| Line-60 | NA | 42.50 | 131.50 | 89.00 | 31.70 | 3.10 | 2869.50 | 78.10 | 10.20 | 231.00 | 22.80 | NA |
| Line-61 | NA | 43.50 | 132.50 | 89.00 | 39.30 | 3.15 | 2582.00 | 70.00 | 12.50 | 269.70 | 21.60 | NA |
| Line-62 | NA | 42.50 | 125.50 | 83.00 | 39.00 | 3.30 | 2480.00 | 67.30 | 11.80 | 233.30 | 19.70 | NA |
| Line-63 | NA | 41.50 | 132.50 | 91.00 | 41.50 | 3.41 | 2419.00 | 65.80 | 12.20 | 257.30 | 21.10 | NA |
| Line-64 | NA | 40.50 | 122.00 | 81.50 | 33.70 | 3.02 | 2579.00 | 70.30 | 11.20 | 278.00 | 24.90 | NA |

Table 247.

TABLE 248

Measured parameters in Soybean varieties (lines 65-96)

| Line/Corr. ID | 1 | 2 | 3 | 4 | 5 | 6 | 7 | 8 | 9 | 10 | 11 | 12 |
|---|---|---|---|---|---|---|---|---|---|---|---|---|
| Line-65 | NA | 39.00 | 130.50 | 91.50 | 35.00 | 2.92 | 2584.0 | 70.20 | 12.00 | 234.8 | 19.60 | NA |
| Line-66 | NA | 40.00 | 123.50 | 83.50 | 31.00 | 2.78 | 1626.5 | 44.30 | 11.20 | 231.3 | 20.70 | NA |
| Line-67 | NA | 36.50 | 111.50 | 75.00 | 33.30 | 3.55 | 2940.0 | 80.20 | 9.30 | 239.3 | 25.80 | NA |
| Line-68 | 4.96 | 40.00 | 126.50 | 86.50 | 29.20 | 2.74 | 1870.0 | 50.80 | 10.70 | 243.5 | 23.10 | 0.53 |
| Line-69 | NA | 39.00 | 124.00 | 85.00 | 33.80 | 3.08 | 1657.5 | 45.10 | 11.00 | 234.5 | 21.40 | NA |
| Line-70 | 7.25 | 37.00 | 125.50 | 88.50 | 42.50 | 3.24 | 2280.0 | 62.20 | 13.00 | 227.0 | 17.60 | 0.22 |
| Line-71 | NA | 35.00 | 120.50 | 85.50 | 36.00 | 2.80 | 2463.5 | 67.50 | 12.80 | 241.5 | 18.80 | NA |
| Line-72 | 6.37 | 35.00 | 120.50 | 85.50 | 29.20 | 2.57 | 2419.0 | 65.70 | 11.30 | 252.0 | 22.10 | NA |
| Line-73 | NA | 38.50 | 126.50 | 88.00 | 45.30 | 3.39 | 2279.5 | 62.20 | 13.30 | 241.3 | 18.10 | NA |
| Line-74 | NA | 36.00 | 124.00 | 88.00 | 36.50 | 2.94 | 2586.5 | 70.20 | 12.30 | 246.3 | 20.10 | NA |
| Line-75 | 8.74 | 40.00 | 125.50 | 85.50 | 35.80 | 3.03 | 2483.5 | 67.40 | 11.80 | 252.0 | 21.40 | 0.33 |
| Line-76 | 7.35 | 53.00 | 132.50 | 79.50 | 28.30 | 3.04 | 1000.0 | 27.10 | 9.30 | 270.2 | 28.90 | 0.55 |
| Line-77 | NA | 38.00 | 119.50 | 81.50 | 33.20 | 3.06 | 2290.0 | 62.30 | 10.80 | 251.3 | 23.20 | NA |
| Line-78 | NA | 41.00 | 122.50 | 81.50 | 26.70 | 2.50 | 2386.0 | 64.50 | 10.70 | 237.3 | 22.20 | NA |
| Line-79 | NA | 37.00 | 123.50 | 86.50 | 43.30 | 3.67 | 2388.5 | 65.00 | 11.80 | 250.2 | 21.10 | NA |
| Line-80 | NA | 38.00 | 128.50 | 90.50 | 32.20 | 3.27 | 2374.5 | 63.80 | 9.80 | 242.5 | 24.70 | NA |
| Line-81 | NA | 42.00 | 121.00 | 79.00 | 30.30 | 2.81 | 1671.0 | 45.50 | 10.80 | 264.3 | 24.50 | NA |
| Line-82 | NA | 48.00 | 126.50 | 78.50 | 32.70 | 3.37 | 1477.0 | 40.10 | 9.70 | 244.3 | 25.40 | NA |
| Line-83 | NA | 39.00 | 123.50 | 84.50 | 33.50 | 2.85 | 2059.5 | 56.10 | 11.70 | 238.0 | 20.40 | NA |
| Line-84 | 6.47 | 38.00 | 127.00 | 89.00 | 40.50 | 3.86 | 1994.5 | 54.50 | 10.50 | 229.5 | 21.90 | 0.53 |
| Line-85 | 7.19 | 38.50 | 120.00 | 81.50 | 26.80 | 2.62 | 2280.0 | 62.10 | 10.20 | 224.3 | 22.10 | 0.20 |
| Line-86 | NA | 40.00 | 135.50 | 95.50 | 38.80 | 3.19 | 2561.0 | 69.70 | 12.20 | 268.5 | 22.20 | NA |
| Line-87 | 7.15 | 39.00 | 131.00 | 92.00 | 34.00 | 2.92 | 2292.0 | 62.30 | 11.70 | 254.0 | 21.80 | 0.43 |
| Line-88 | NA | 37.00 | 127.00 | 90.00 | 27.30 | 2.65 | 2453.0 | 67.10 | 10.30 | 220.3 | 21.30 | NA |
| Line-89 | NA | 42.00 | 128.00 | 86.00 | 33.00 | 3.14 | 2181.5 | 59.20 | 10.50 | 232.3 | 22.40 | NA |
| Line-90 | NA | 37.00 | 127.50 | 90.50 | 32.70 | 2.80 | 1971.5 | 53.60 | 11.70 | 214.7 | 18.50 | NA |
| Line-91 | 6.97 | 42.00 | 130.00 | 88.00 | 30.20 | 2.79 | 2018.5 | 54.90 | 10.80 | 216.3 | 20.00 | 0.43 |
| Line-92 | NA | 41.00 | 122.50 | 81.50 | 35.00 | 3.09 | 2059.5 | 55.80 | 11.30 | 240.7 | 22.60 | NA |
| Line-93 | NA | 42.00 | 126.50 | 84.50 | 28.20 | 2.53 | 1434.5 | 38.90 | 11.20 | 253.0 | 22.70 | NA |
| Line-94 | NA | 43.00 | 119.50 | 76.50 | 39.20 | 2.97 | 2412.0 | 65.40 | 13.20 | 244.7 | 18.70 | NA |
| Line-95 | 6.70 | 39.50 | 122.00 | 82.50 | 35.70 | 3.03 | 1743.0 | 47.50 | 11.70 | 245.7 | 21.00 | 0.27 |
| Line-96 | NA | 40.00 | 131.50 | 91.50 | 34.70 | 2.88 | 2390.0 | 65.10 | 12.00 | 248.5 | 20.80 | NA |

Table 248.

TABLE 249

Measured parameters in Soybean varieties (lines 97-128)

| Line/Corr. ID | 1 | 2 | 3 | 4 | 5 | 6 | 7 | 8 | 9 | 10 | 11 | 12 |
|---|---|---|---|---|---|---|---|---|---|---|---|---|
| Line-97 | NA | 41.50 | 127.00 | 85.50 | 24.70 | 2.39 | 2437.0 | 66.10 | 10.30 | 255.30 | 24.70 | NA |
| Line-98 | NA | 42.00 | 136.50 | 94.50 | 36.20 | 2.86 | 1405.0 | 38.10 | 12.70 | 276.20 | 21.90 | NA |
| Line-99 | 6.69 | 39.00 | 127.00 | 88.00 | 32.20 | 2.88 | 1891.0 | 51.20 | 11.20 | 226.20 | 20.30 | 0.87 |
| Line-100 | NA | 41.00 | 124.00 | 83.00 | 35.80 | 2.86 | 1814.0 | 49.10 | 12.50 | 253.30 | 20.30 | NA |
| Line-101 | 6.33 | 39.50 | 114.00 | 74.50 | 33.30 | 3.08 | 1831.0 | 49.30 | 10.80 | 252.70 | 23.30 | NA |
| Line-102 | 7.30 | 45.00 | 126.00 | 81.00 | 27.50 | 2.54 | 837.00 | 22.70 | 10.70 | 244.70 | 23.20 | 0.27 |
| Line-103 | 7.68 | 52.00 | 135.50 | 83.50 | 32.30 | 2.98 | 1059.0 | 28.70 | 10.80 | 252.70 | 23.30 | NA |
| Line-104 | NA | 36.50 | 101.00 | 64.50 | 31.20 | 3.12 | 1605.0 | 43.70 | 10.00 | 289.50 | 28.90 | NA |
| Line-105 | 7.75 | 40.50 | 125.00 | 84.50 | 31.70 | 3.17 | 2473.5 | 67.10 | 10.80 | 235.80 | 23.70 | 0.20 |
| Line-106 | 7.51 | 39.00 | 122.00 | 83.00 | 33.20 | 3.10 | 1402.0 | 38.00 | 10.70 | 255.00 | 24.20 | 0.60 |
| Line-107 | NA | 54.00 | 138.00 | 84.00 | 19.20 | 2.55 | 586.50 | 15.90 | 7.30 | 261.30 | 37.20 | NA |
| Line-108 | 6.72 | 35.00 | 101.00 | 66.00 | 26.80 | 2.82 | 1748.5 | 47.60 | 9.50 | 256.80 | 27.10 | 0.27 |
| Line-109 | NA | 41.50 | 127.50 | 86.00 | 34.30 | 2.94 | 2597.5 | 70.40 | 11.70 | 213.80 | 18.40 | NA |
| Line-110 | NA | 41.00 | 129.00 | 88.00 | 29.50 | 2.95 | 2406.5 | 65.00 | 10.00 | 246.20 | 24.60 | NA |
| Line-111 | NA | 37.50 | 101.00 | 63.50 | 28.20 | 2.91 | 1748.5 | 47.60 | 9.70 | 265.80 | 27.50 | NA |
| Line-112 | NA | 45.00 | 130.50 | 85.50 | 29.00 | 2.74 | 1208.0 | 32.80 | 10.50 | 244.30 | 23.50 | NA |
| Line-113 | NA | 47.00 | 124.50 | 77.50 | 26.80 | 2.71 | 1896.0 | 50.30 | 9.70 | 256.80 | 27.40 | NA |
| Line-114 | NA | 36.50 | 111.00 | 74.50 | 31.30 | 3.10 | 1722.0 | 46.70 | 10.00 | 247.70 | 25.90 | NA |
| Line-115 | NA | 40.50 | 127.50 | 87.00 | 34.30 | 3.03 | 2525.0 | 68.60 | 11.30 | 299.50 | 26.30 | NA |
| Line-116 | NA | 39.50 | 126.50 | 87.00 | 32.00 | 3.04 | 2319.0 | 63.20 | 10.50 | 221.00 | 21.10 | NA |
| Line-117 | 7.01 | 40.50 | 128.00 | 87.50 | 26.70 | 2.74 | 953.00 | 25.90 | 9.70 | 231.50 | 24.10 | 0.38 |
| Line-118 | NA | 36.50 | 117.00 | 80.50 | 41.00 | 3.23 | 2658.5 | 72.20 | 12.70 | 245.30 | 19.40 | NA |
| Line-119 | 5.59 | 35.00 | 112.50 | 77.50 | 31.80 | 2.71 | 1910.0 | 51.90 | 11.80 | 254.50 | 21.70 | 0.55 |
| Line-120 | NA | 40.00 | 120.00 | 80.00 | 32.50 | 2.60 | 1730.5 | 47.10 | 12.50 | 189.20 | 15.10 | NA |
| Line-121 | NA | 39.00 | 124.00 | 85.00 | 38.50 | 2.96 | 2647.5 | 71.80 | 13.00 | 245.50 | 18.90 | NA |
| Line-122 | NA | 38.00 | 124.00 | 86.00 | 38.20 | 3.16 | 2186.5 | 59.50 | 12.00 | 239.20 | 20.00 | NA |
| Line-123 | 6.04 | 35.00 | 126.00 | 91.00 | 29.50 | 2.63 | 2397.0 | 65.30 | 11.30 | 233.20 | 20.60 | 0.20 |
| Line-124 | NA | 38.00 | 127.00 | 89.00 | 32.30 | 2.94 | 2318.0 | 63.10 | 11.00 | 247.50 | 22.50 | NA |
| Line-125 | NA | 39.00 | 126.50 | 87.50 | 37.70 | 3.22 | 2548.5 | 69.20 | 11.70 | 206.70 | 17.70 | NA |
| Line-126 | NA | 38.50 | 129.00 | 90.50 | 29.30 | 2.71 | 2083.0 | 56.30 | 10.80 | 207.80 | 19.20 | NA |

TABLE 249-continued

Measured parameters in Soybean varieties (lines 97-128)

| Line/Corr. ID | 1 | 2 | 3 | 4 | 5 | 6 | 7 | 8 | 9 | 10 | 11 | 12 |
|---|---|---|---|---|---|---|---|---|---|---|---|---|
| Line-127 | 7.41 | 38.50 | 127.00 | 88.50 | 30.30 | 2.68 | 1834.0 | 49.90 | 11.30 | 241.30 | 21.30 | 0.50 |
| Line-128 | 7.28 | 49.50 | 136.00 | 86.50 | 27.20 | 2.66 | 844.50 | 22.90 | 10.20 | 309.30 | 30.40 | 0.70 |

Table 249.

TABLE 250

Measured parameters in Soybean varieties (lines 129-142)

| Line/Corr. ID | 1 | 2 | 3 | 4 | 5 | 6 | 7 | 8 | 9 | 10 | 11 | 12 |
|---|---|---|---|---|---|---|---|---|---|---|---|---|
| Line-129 | NA | 43.00 | 129.50 | 86.50 | 25.70 | 2.17 | 1699.0 | 46.10 | 11.80 | 245.50 | 20.80 | NA |
| Line-130 | NA | 35.00 | 127.00 | 92.00 | 31.30 | 2.69 | 2534.0 | 68.70 | 11.70 | 233.70 | 20.00 | NA |
| Line-131 | 7.01 | 35.00 | 117.50 | 82.50 | 35.50 | 2.91 | 2391.0 | 65.30 | 12.20 | 239.30 | 19.80 | 0.27 |
| Line-132 | NA | 37.00 | 125.50 | 88.50 | 31.70 | 2.79 | 2791.5 | 75.70 | 11.30 | 231.00 | 20.40 | NA |
| Line-133 | NA | 35.00 | 116.50 | 81.50 | 37.30 | 3.06 | 2489.0 | 67.60 | 12.20 | 236.30 | 19.60 | NA |
| Line-134 | NA | 35.00 | 122.00 | 87.00 | 34.30 | 2.58 | 2912.0 | 79.40 | 13.30 | 234.20 | 17.70 | NA |
| Line-135 | NA | 39.20 | 126.80 | 87.50 | 33.70 | 2.82 | 2488.0 | 67.30 | 11.90 | 225.00 | 18.90 | NA |
| Line-136 | NA | 39.50 | 121.00 | 81.50 | 29.20 | 2.68 | 2085.3 | 56.30 | 10.90 | 215.00 | 20.10 | NA |
| Line-137 | NA | 41.00 | 129.50 | 88.50 | 25.70 | 2.56 | 1722.5 | 46.80 | 10.00 | 213.80 | 21.40 | NA |
| Line-138 | NA | 35.00 | 122.50 | 87.50 | 40.30 | 2.96 | 2810.5 | 76.60 | 13.70 | 241.00 | 17.70 | NA |
| Line-139 | NA | 40.50 | 133.00 | 92.50 | 31.50 | 2.70 | 2493.5 | 67.90 | 11.70 | 232.00 | 19.90 | NA |
| Line-140 | NA | 36.00 | 124.50 | 88.50 | 32.20 | 2.68 | 2874.0 | 78.40 | 12.00 | 238.70 | 19.90 | NA |
| Line-141 | NA | 35.00 | 127.00 | 92.00 | 32.80 | 2.77 | 2599.0 | 71.10 | 11.80 | 243.70 | 20.60 | NA |
| Line-142 | NA | 39.00 | 123.00 | 84.00 | 43.20 | 3.24 | 2249.5 | 61.50 | 13.30 | 245.00 | 18.40 | NA |

Table 250.

TABLE 251

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LBY398 | 0.74 | 6.20E−03 | 1 | 7 | LBY398 | 0.71 | 1.01E−02 | 1 | 6 |
| LBY398 | 0.73 | 6.53E−03 | 1 | 8 | LBY400 | 0.74 | 8.84E−03 | 5 | 9 |
| LBY401 | 0.70 | 1.63E−02 | 5 | 12 | LGD30 | 0.71 | 9.50E−03 | 1 | 7 |
| LGD30 | 0.75 | 4.91E−03 | 1 | 12 | LGD30 | 0.72 | 8.86E−03 | 1 | 8 |
| LYD943 | 0.70 | 1.09E−02 | 1 | 6 | LYD946 | 0.86 | 2.88E−04 | 1 | 7 |
| LYD946 | 0.86 | 2.91E−04 | 1 | 8 | LYD947 | 0.71 | 3.12E−03 | 3 | 12 |
| LYD947 | 0.85 | 4.38E−04 | 1 | 7 | LYD947 | 0.85 | 3.99E−04 | 1 | 8 |
| LYD949 | 0.72 | 1.20E−02 | 5 | 9 | LYD949 | 0.70 | 1.62E−02 | 5 | 5 |
| LYD971 | 0.74 | 9.71E−03 | 5 | 7 | LYD971 | 0.75 | 8.34E−03 | 5 | 9 |
| LYD971 | 0.74 | 9.19E−03 | 5 | 8 | LYD971 | 0.70 | 3.46E−03 | 3 | 12 |
| LYD971 | 0.87 | 2.52E−04 | 1 | 7 | LYD971 | 0.87 | 2.29E−04 | 1 | 8 |
| LYD972 | 0.73 | 1.06E−02 | 5 | 6 | LYD972 | 0.79 | 3.46E−03 | 5 | 5 |
| LYD975 | 0.72 | 2.43E−03 | 3 | 12 | LYD975 | 0.77 | 3.35E−03 | 1 | 7 |
| LYD975 | 0.77 | 3.28E−03 | 1 | 8 | LYD978 | 0.73 | 1.15E−02 | 5 | 9 |
| LYD978 | 0.74 | 9.95E−03 | 5 | 5 | LYD981 | 0.72 | 8.47E−03 | 1 | 7 |
| LYD981 | 0.73 | 7.56E−03 | 1 | 8 | LYD982 | 0.71 | 1.45E−02 | 5 | 3 |
| LYD982 | 0.70 | 1.09E−02 | 1 | 7 | LYD982 | 0.71 | 1.01E−02 | 1 | 8 |
| LYD982 | 0.72 | 1.55E−03 | 4 | 12 | LYD983 | 0.73 | 1.06E−02 | 5 | 5 |
| LYD983 | 0.72 | 2.40E−03 | 3 | 12 | LYD984 | 0.78 | 5.94E−04 | 3 | 2 |
| LYD985 | 0.72 | 1.30E−02 | 5 | 4 | MGP58 | 0.74 | 6.20E−03 | 1 | 8 |
| MGP54 | 0.73 | 7.61E−03 | 1 | 11 | MGP58 | 0.74 | 5.97E−03 | 1 | 7 |

Table 251. Provided are the correlations (R) between the expression levels yield improving genes and their homologs in various tissues [Expression (Exp) sets, Table 243] and the phenotypic performance [yield, biomass, and plant architecture as described in Tables 246-250 using the Correlation vectors (Corr.) described in Table 245] under normal conditions across soybean varieties.
P = p value.

TABLE 252

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LBY398 | 0.90 | 1.51E−02 | 1 | 7 | LBY398 | 0.90 | 1.32E−02 | 1 | 8 |
| LBY398 | 0.78 | 3.75E−02 | 3 | 12 | LBY400 | 0.84 | 3.45E−02 | 1 | 10 |
| LBY401 | 0.72 | 4.53E−02 | 3 | 7 | LBY401 | 0.71 | 4.95E−02 | 3 | 8 |
| LBY401 | 0.80 | 1.81E−02 | 2 | 11 | LGA27 | 0.82 | 4.49E−02 | 1 | 11 |
| LGA27 | 0.78 | 2.11E−02 | 2 | 3 | LGA27 | 0.72 | 4.57E−02 | 2 | 4 |
| LYD942 | 0.82 | 4.57E−02 | 1 | 10 | LYD942 | 0.75 | 3.19E−02 | 3 | 9 |
| LYD943 | 0.90 | 1.39E−02 | 1 | 7 | LYD943 | 0.90 | 1.42E−02 | 1 | 8 |
| LYD943 | 0.90 | 2.03E−03 | 3 | 10 | LYD944 | 0.76 | 7.75E−02 | 1 | 10 |
| LYD946 | 0.80 | 5.75E−02 | 1 | 1 | LYD947 | 0.75 | 8.70E−02 | 1 | 11 |
| LYD949 | 0.83 | 4.22E−02 | 1 | 7 | LYD949 | 0.76 | 8.27E−02 | 1 | 2 |
| LYD949 | 0.83 | 4.10E−02 | 1 | 8 | LYD949 | 0.75 | 3.05E−02 | 2 | 11 |
| LYD971 | 0.76 | 8.00E−02 | 1 | 2 | LYD971 | 0.93 | 8.02E−03 | 1 | 9 |
| LYD971 | 0.78 | 6.79E−02 | 1 | 3 | LYD971 | 0.84 | 3.73E−02 | 1 | 5 |
| LYD971 | 0.87 | 5.38E−03 | 2 | 2 | LYD974 | 0.70 | 5.30E−02 | 3 | 9 |
| LYD976 | 0.72 | 1.09E−01 | 1 | 10 | LYD977 | 0.72 | 4.59E−02 | 2 | 7 |
| LYD977 | 0.75 | 3.39E−02 | 2 | 2 | LYD977 | 0.72 | 4.48E−02 | 2 | 8 |
| LYD978 | 0.75 | 3.06E−02 | 2 | 9 | LYD979 | 0.72 | 1.06E−01 | 1 | 2 |
| LYD980 | 0.90 | 1.53E−02 | 1 | 1 | LYD980 | 0.70 | 5.17E−02 | 3 | 3 |
| LYD981 | 0.76 | 7.74E−02 | 1 | 12 | LYD981 | 0.77 | 2.66E−02 | 2 | 2 |
| LYD981 | 0.75 | 3.20E−02 | 2 | 3 | LYD982 | 0.71 | 1.16E−01 | 1 | 2 |
| LYD982 | 0.75 | 3.34E−02 | 2 | 3 | LYD983 | 0.78 | 6.87E−02 | 1 | 10 |
| LYD985 | 0.86 | 2.81E−02 | 1 | 10 | LYD985 | 0.71 | 5.01E−02 | 2 | 10 |
| LYD986 | 0.73 | 1.01E−01 | 1 | 1 | LYD986 | 0.79 | 2.07E−02 | 2 | 1 |
| MGP53 | 0.71 | 4.86E−02 | 2 | 11 | MGP54 | 0.85 | 6.92E−03 | 3 | 11 |
| MGP54 | 0.76 | 2.79E−02 | 2 | 11 | MGP58 | 0.74 | 8.96E−02 | 1 | 7 |
| MGP58 | 0.86 | 2.89E−02 | 1 | 3 | MGP58 | 0.74 | 9.28E−02 | 1 | 8 |
| MGP58 | 0.81 | 5.23E−02 | 1 | 4 | MGP82 | 0.74 | 3.74E−02 | 2 | 3 |
| MGP82 | 0.77 | 2.60E−02 | 2 | 4 | | | | | |

Table 252. Provided are the correlations (R) between the expression levels yield improving genes and their homologs in various tissues [Expression (Exp) sets, Table 244] and the phenotypic performance [yield, biomass, and plant architecture as described in Tables 246-250 using the Correlation vectors (Corr.) described in Table 245] under normal conditions across soybean varieties.
P = p value.

Example 22

Production of Maize Transcriptom and High Throughput Correlation Analysis Using 60K Maize Oligonucleotide Micro-Array To produce a high throughput correlation analysis, the present inventors utilized a Maize oligonucleotide microarray, produced by Agilent Technologies [chem. (dot) agilent (dot) com/Scripts/PDS (dot) asp?lPage=50879]. The array oligonucleotide represents about 60K Maize genes and transcripts designed based on data from Public databases (Example 23). To define correlations between the levels of RNA expression and yield, biomass components or vigor related parameters, various plant characteristics of 149 different Maize inbreds were analyzed. Among them, 41 inbreds encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

149 Maize inbred lines were grown in 4 repetitive plots in 2 fields. In field A Maize seeds were planted at density of 35K per acre and grown using dry fall commercial fertilization, no tillage and were preceded by Soybean crop. In Field B Maize seeds were planted at density of 35K per acre and grown using swine manure fertilization, tillage and were preceded by Maize crop.

Field A with 35K plants per acre—tissues were collected from field at different developmental stages including Ear (VT), Leaf (V9 and R2), Stem (V9, VT and R2) and Female (ear) Meristem (V9).

Field B with 35K plants per acre—tissues were collected from field at different developmental stages including Ear (VT), Leaf (V9 and R2), Stem (V9 and R2) and Female (ear) Meristem (V9).

These tissues, representing different plant characteristics, were sampled and RNA was extracted as described in "GENERAL EXPERIMENTAL AND BIOINFORMATICS METHODS". For convenience, each micro-array expression information tissue type has received a Set ID as summarized in Table 253 below.

TABLE 253

Tissues used for Maize transcriptome expression sets of field A 35K

| Expression Set | Set ID |
|---|---|
| Leaf at reproductive stage R2 | 1 |
| Leaf at vegetative stage V9 | 2 |
| Stem at reproductive stage R2 | 3 |
| Stem at vegetative stage V9 | 4 |
| Stem at reproductive stage VT | 5 |

TABLE 253-continued

Tissues used for Maize transcriptome expression sets of field A 35K

| Expression Set | Set ID |
|---|---|
| Ear at reproductive stage VT | 6 |
| Female meristem at vegetative stage V9 | 7 |

Table 253: Provided are the maize transcriptome expression sets and identification numbers (IDs) for samples originating from field A.
Leaf = the leaf below the main ear;
Ear = Distal maize developing grains from the cob extreme area;
Stem = the stem tissue directly below the main ear;
FM = Female meristem (represented in separate correlation table).

TABLE 254

Tissues used for Maize transcriptome expression sets of field B 35K

| Expression Set | Set ID |
|---|---|
| Ear at reproductive stage VT | 1 |
| Leaf at reproductive stage R2 | 2 |
| Leaf at vegetative stage V9 | 3 |
| Stem at reproductive stage R2 | 4 |
| Stem at vegetative stage V9 | 5 |
| Ear at reproductive stage R2 | 6 |

Table 254: Provided are the maize transcriptome expression sets for samples originating from field B.
Leaf = the leaf below the main ear;
Female meristem = the female flower at the anthesis day.
Ear = Distal maize developing grains from the cob extreme area;
Stem = the stem tissue directly below the main ear;
FM = Female meristem.

The following parameters were collected:

Plant height [cm]—Plants were characterized for height at harvesting. In each measure, 6 plants were measured for their height using a measuring tape. Height was measured from ground level to top of the plant below the tassel.

NDVI (Normalized Difference Vegetation Index) [ratio]—Measure with portable NDVI sensor. One measurement per plot of a fixed duration (depending on plot size), approximately 5 seconds for a 5 meter plot.

Main cob DW[gr.]—dry weight of the cob of the main ear, without grains.

Num days to heading [num of days]—number of days from sowing until the day in which 50% or more of plants within the plot reached tassel emergence.

SPAD (VT) (R2) [SPAD units]—Chlorophyll content was determined using a Minolta SPAD 502 chlorophyll meter. SPAD meter readings were done on fully developed leaf. Three measurements per leaf were taken per plot.

% Yellow leaves number (VT) (SP) [%]—All leaves were classified as Yellow or Green. This is the percent of yellow leaves from the total leaves.

Middle stem width [cm]—Measurement of the width in the middle of the internode below the main ear with a caliper.

Num days to silk [num of days]—number of days from sowing until the day in which 50% or more of plants within the plot have emerged silks (Silks first emerge from the husk).

Ear row num—count of number of kernel rows per main ear (horizontal).

Middle stem brix [brix°]—applied pressure on the stem from the top (near the ear—shank) until a drop is secreted and then placed on a refractometer for Bx° analysis.

Lodging [1-3]—Plants were subjectively evaluated and categorized into 3 groups. 1=plant is erect; 2=plant is semi-lodged; 3=plant is fully lodged.

Num days to maturity [num of days]—number of days from sowing until the day in which the husks and grains in the ear are dry and have accumulated their maximum dry matter.

Ear Area [$cm^2$]—At the end of the growing period, ears were photographed and images were processed using the below described image processing system. The Ear area was measured from those images and was divided by the number of ears.

Ear filled grain area [$cm^2$]—At the end of the growing period, ears were photographed and images were processed using the below described image processing system. The Ear area filled with kernels was measured from those images and was divided by the number of Ears.

Specific leaf area [$cm^2/g$]—Calculated ratio of leaf area per gram of leaf dry weight.

% Canopy coverage (R4) [%]—percent Canopy coverage at R4 stage (24-28 days after silking). The % Canopy coverage is calculated using Formula 32 above.

Total ears DW per plant (SP) [gr.]—The weight of all the main ears in the plot harvested at the end of the trial divided by the number of plants in that plot.

Ear growth rate (VT to R2) [g/day]—Accumulated main ear dry weight between VT (tassel emergence) and R2 (10-14 days after silking) developmental stages, divided by number of days between these two stages.

Ear Length [cm]—At the end of the growing period, ears were photographed and images were processed using the below described image processing system. The Ear length was measured from those images and was divided by the number of ears.

Ear Width [cm]—At the end of the growing period ears were photographed and images were processed using the below described image processing system. The Ear width (longest axis) was measured from those images and was divided by the number of ears.

⅓ ear Grain area [$cm^2$]—At the end of the growing period, ears were photographed and images were processed using the below described image processing system. Only the top ⅓ of the Ear area was measured from those images and was divided by the number of ears.

⅓ ear 1000 grains weight [gr.]—Top ⅓ main ear grains were sampled, and a fraction (~25 gr.) of grains from this sample was used for grain number count using image processing system (described below). Calculation of 1000 grains weight was then applied (according to Formula 14)

Avr. Leaf Area per plant [$cm^2$]—total leaf area divided by the number of plants calculated using image processing system (described below).

Blisters number per ear—calculated using image processing system (described below). The total row number was multiplied by the number of kernels in each row.

Cob Area [$cm^2$]—multiply between the width and the length of the cob without kernels, using image processing system (described below).

Cob density [$gr./cm^3$]—calculated by dividing the dry cob dry weight (without kernels) by the volume of the cob using image processing system (described below)

Cob Length [cm]—measured using image processing system (described below) The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for—Cob length, density and area; Ear length and width; ⅓ ear 1000 grains weight and area; blisters number per ear; Avr. (average) Leaf Area per plant; was saved to text files and analyzed using the JMP statistical analysis software (SAS institute).

Additional parameters were collected either by sampling several plants per plot or by measuring the parameter across all the plants within the plot.

Ears per plant [num]—number of ears per plant was counted.

Total Leaf Area per plant [cm$^2$]—Total measured leaf area in a plot divided by the number of plants in that plot.

1000 grain weight [gr.]—as described in Formula 14.

Grains per row [num]—The number of grains per row was counted.

Harvest Index (HI) [ratio]—The harvest index per plant was calculated using Formula 16 above.

Cob width [cm]—The diameter of the cob without grains was measured using a ruler.

Total plant biomass [kg]/Total N content [gr.]—The ratio of the total plant material weight (including cob) divided by the total N content of the whole plant (including cob).

Total plant biomass [kg]/N content of Vegetative [gr.]—The ratio of the total plant material weight (including cob) divided by the total N content of the vegetative material (without the cob).

Ear tip uniformity [ratio]—The yield of the ear tip (the top ⅓ of the ear) divided by the ear tip grain area CV (coefficient of variation).

Yield per ear filling rate [gr./day]—The ratio of grain yield per ear (gr.) to the grain fill duration in days.

1000 grain weight filling rate [gr./day]—calculated using Formula 36.

Grain filling duration [num of days]—Calculation of the number of days to reach maturity stage subtracted by the number of days to reach silking stage.

Leaf carbon isotope discrimination [% c]—Leaves were dried, frozen and sent to lab for 13C isotope abundance analysis by EA-IRMS (Elemental Analysis-Isotope Ratio Mass Spectrometry)

Plant height growth [cm/day]—plant height was measured once a week (as described above) and divided by the sum of days during the measurement period.

Main Ear Grains yield [gr.]—ears were dried, grains were manually removed and weighed.

Anthesis silking interval [num of days]—A difference of the average number of days between the maize tassel emergence and the first visible silk (stigma) emergence.

Middle stem width [cm]—The width of the internode below the main ear was measured by a caliper.

Avr. ⅓ ear Grains number—total number of grains counted in the upper ⅓ part of the main ear divided by the number of plants measured.

Avr. Ears DW per plant [gr.]—the dry weight of ears divided by the number of plants.

Avr. internode length [cm]—average of the length of the lowest whole and visible internode, measured by caliper.

Avr. Tassel DW per plant [gr.]—total tassel dry weight divided by the number of plants.

Avr. Total plants biomass [kg]—total plant biomass (vegetative and reproductive) divided by the number of plants.

Blisters number in one row—blisters were manually counted in entire row (top to bottom of ear).

Moisture [%]—the percent of moisture in the grains was obtained by the combine at harvest.

Bushels per acre [kg]—the amount of bushels per acre was obtained by the combine at harvest.

Bushels per plant [kg]-bushels per acre divided by the total stand count of the plants.

N content of whole plant (VT) [%]—plants (including ear) were fully dried and then sent to lab for analysis of nitrogen content.

Calculated grains per ear [num]—calculated by dividing the 1000 grains weight by 1000 and multiply by the total grains weight.

Grains in tip*ratio tip vs. base TGW [ratio]—calculation, multiply the amount of grains in the top ⅓ of the ear with the ratio between 1000 grain weight of the top ⅓ and lower ⅔ of the ear.

TABLE 255

Maize correlated parameters Inbred Field A
35K per acre (vectors) (parameters set 1)

| Correlated parameter with | Correlation ID |
|---|---|
| Average Tassel DW per plant (VT) [gr.] | 1 |
| Average Total plants biomass (SP) [kg] | 2 |
| Grains in tip * ratio tip vs. base TGW [ratio] | 3 |
| SPAD (R2) [SPAD units] | 4 |
| % yellow leaves number (H) [%] | 5 |
| % yellow leaves number (R2) [%] | 6 |
| Grains per row [num] | 7 |
| SPAD (VT) [SPAD units] | 8 |
| ⅓ ear 1000 grains weight [gr.] | 9 |
| Blisters number in one row (VT) [num] | 10 |
| Blisters number per ear [num] | 11 |
| Harvest index [ratio] | 12 |
| Leaf carbon isotope discrimination (H) [‰] | 13 |
| Specific leaf area (VT) [cm$^2$/gr.] | 14 |
| bushels per acre [kg] | 15 |
| bushels per plant [kg] | 16 |
| Lodging [1-3] | 17 |
| ⅓ ear Grain area [cm$^2$] | 18 |
| Calculated grains per ear [num] | 19 |
| Cob Area [cm$^2$] | 20 |
| Main cob DW [gr.] | 21 |
| Main Ear Grains yield [gr.] | 22 |
| Total ears DW per plant (SP) [kg] | 23 |
| Total Leaf Area per plant (VT) [cm$^2$] | 24 |
| Cob density [g/mm$^3$] | 25 |
| Cob Length [cm] | 26 |
| Middle stem brix (R2) [Brix°] | 27 |
| Middle stem width (R2) [mm] | 28 |
| Total plant biomass/Total N content (VT) [gr.] | 29 |
| Total plant biomass/N content of Vegetative (H) [gr.] | 30 |
| 1000 grain weight filling rate [gr./day] | 31 |
| 1000 grains weight [gr.] | 32 |
| Cob width [cm] | 33 |
| Moisture [%] | 34 |
| N content of whole plant (VT) [%] | 35 |
| NDVI (V5) [ratio] | 36 |
| Yield per ear filling rate [gr./day] | 37 |
| Ear Area [cm$^2$] | 38 |
| Ear Area (VT) [cm$^2$] | 39 |
| Num days to Heading [num of days] | 40 |
| Num days to Maturity [num of days] | 41 |
| Ear Filled Grain Area [cm$^2$] | 42 |
| Ear Filled Grain Area (VT) [cm$^2$] | 43 |
| Num days to Silk [num of days] | 44 |
| Ear growth rate (VT to R2) [gr./day] | 45 |
| Plant height [cm] | 46 |
| Anthesis silking interval [num of days] | 47 |
| Ear length [cm] | 48 |
| Plant height growth [cm/day] | 49 |
| Avr ⅓ ear Grains number [num] | 50 |
| Avr Ears DW per plant (R2) [gr.] | 51 |
| Ear row number (VT) | 52 |
| Ear tip uniformity [ratio] | 53 |
| Ear Width [cm] | 54 |
| Avr Ears DW per plant (VT) [gr.] | 55 |
| Avr internode length [cm] | 56 |

TABLE 255-continued

Maize correlated parameters Inbred Field A
35K per acre (vectors) (parameters set 1)

| Correlated parameter with | Correlation ID |
|---|---|
| Avr Leaf area per plant (VT) [cm$^2$] | 57 |
| Ear Width (VT) [cm] | 58 |
| Ears per plant (SP) [num] | 59 |
| % Canopy coverage (R4) [%] | 60 |
| Grain filling duration [num of days] | 61 |

Table 255.
"Avr." = Average,
1/3 Ear = the 3$^{rd}$ most distant part of the Ear from the stem,
"VT" = Tassel emergence,
"R2" = 10-14 days after silking,
"SP" = selected plants,
"H" = Harvest,
"R4" = 24-28 days after silking,
"V5" = 5 leaves appear and initiation of tassel and ear.
"DW" = Dry Weight,
"num" = number,
"kg" = kilogram(s),
"cm" = centimeter(s),
"mm" = millimeter(s),
"gr." = grams;
"%" = percent;
"ratio" = values between −1 and 1.

TABLE 256

Maize correlated parameters of Inbred Field
B 35K per acre (vectors) (parameters set 2)

| Correlated parameter with | Correlation ID |
|---|---|
| Ear Area [cm$^2$] | 1 |
| Ear Area (VT) [cm$^2$] | 2 |
| SPAD (R4) [SPAD units] | 3 |
| Specific leaf area (VT) [cm$^2$/gr.] | 4 |
| % Canopy coverage (R4) [%] | 5 |
| Ear Filled Grain Area [cm$^2$] | 6 |
| Ear Filled Grain Area (VT) [cm$^2$] | 7 |
| Total ears DW per plant (SP) [kg] | 8 |
| % yellow leaves number (H) [%] | 9 |
| % yellow leaves number (R2) [%] | 10 |
| Ear growth rate (VT to R2) [gr./day] | 11 |
| Ear length [cm] | 12 |
| Total Leaf Area per plant (VT) [cm$^2$] | 13 |
| 1/3 ear 1000 grains weight [gr.] | 14 |
| Ear row number (VT) [num] | 15 |
| Total plant biomass [kg]/Total N content (VT)[gr.] | 16 |
| Total plant biomass [kg]/N content of Vegetative (H)[gr.] | 17 |
| 1/3 ear Grain area [cm$^2$] | 18 |
| Ear tip uniformity [ratio] | 19 |
| Ear Width [cm] | 20 |
| Ear Width (VT) [cm] | 21 |
| Ears per plant (SP) [number] | 22 |
| Yield per ear filling rate [gr./day] | 23 |
| 1000 grain weight filling rate [gr./day] | 24 |
| Grain filling duration [num of days] | 25 |
| Grains in tip * ratio tip/base TGW [ratio] | 26 |
| 1000 grains weight [gr.] | 27 |
| Grains per row [num] | 28 |
| Harvest index [gr.] | 29 |
| Leaf carbon isotope discrimination (H) [‰] | 30 |
| Lodging [1-3] | 31 |
| Main cob DW [gr.] | 32 |
| Main Ear Grains yield [gr.] | 33 |
| Middle stem brix (R2) [Brix°] | 34 |
| Anthesis silking interval [num of days] | 35 |
| Avr 1/3 ear Grains number [num] | 36 |
| Middle stem width (R2) [mm] | 37 |
| Moisture [%] | 38 |
| Avr Ears DW per plant (R2) [gr.] | 39 |
| Avr Ears DW per plant (VT) [gr.] | 40 |
| Avr internode length [cm] | 41 |
| Avr Leaf Area per plant (VT) [cm$^2$] | 42 |
| N content of whole plant (VT) [%] | 43 |
| NDVI (V5) [ratio] | 44 |
| Num days to Heading [num of days] | 45 |
| Num days to Maturity [num of days] | 46 |
| Num days to Silk [num of days] | 47 |
| Avr Tassel DW per plant (VT) [gr.] | 48 |
| Avr Total plants biomass (SP) [kg] | 49 |
| Plant height [cm] | 50 |
| Plant height growth [cm/day] | 51 |
| Blisters number in one row (VT) [num] | 52 |
| Blisters number per ear [num] | 53 |
| bushels per acre [kg] | 54 |
| bushels per plant [kg] | 55 |
| Calculated grains per ear [num] | 56 |
| Cob Area [cm$^2$] | 57 |
| Cob density [gr./mm$^3$] | 58 |
| Cob Length [cm] | 59 |
| Cob width [cm] | 60 |
| SPAD (R2) [SPAD units] | 61 |

Table 256.
"Avr." = Average, 1/3 Ear = the 3$^{rd}$ most distant part of the Ear from the stem,
"VT" = Tassel emergence,
"R2" = 10-14 days after silking,
"SP" = selected plants,
"H" = Harvest,
"R4" = 24-28 days after silking,
"V5" = 5 leaves appear and initiation of tassel and ear.
"DW" = Dry Weight,
"num" = number,
"kg" = kilogram(s),
"cm" = centimeter(s),
"mm" = millimeter(s),
"gr." = grams;
"%" = percent;
"ratio" = values between −1 and 1.

Experimental Results 41 maize varieties were characterized for parameters, as described above (Tables 255-256). The average for each parameter was calculated using the JMP software, and values are summarized in Tables 257-281 below. Subsequent correlation between the various transcriptome sets for all or sub sets of lines was done by the bioinformatic unit and results were integrated into the database (Table 282-284 below).

TABLE 257

Measured parameters in Maize Inbred Field A 35K per acre (lines 1-8)

| Line/Correlation ID | Line-1 | Line-2 | Line-3 | Line-4 | Line-5 | Line-6 | Line-7 | Line-8 |
|---|---|---|---|---|---|---|---|---|
| 60 | 79.8 | NA | 72.8 | NA | 61.8 | 60.1 | NA | 80.9 |
| 5 | NA | 100 | 100 | 87.2 | 100 | 98.6 | 59 | 100 |
| 6 | 9.4 | 13.9 | NA | 14.7 | 8 | 16.9 | 13.1 | 14.2 |
| 31 | 5.35 | 3.32 | 4.64 | 9.83 | 3.31 | 4.08 | 7.85 | 7.5 |

TABLE 257-continued

Measured parameters in Maize Inbred Field A 35K per acre (lines 1-8)

| Line/Correlation ID | Line-1 | Line-2 | Line-3 | Line-4 | Line-5 | Line-6 | Line-7 | Line-8 |
|---|---|---|---|---|---|---|---|---|
| 32 | 237.3 | 143.6 | 219.8 | 263.8 | 165.7 | 196 | 220 | 205 |
| 9 | 216.5 | 128.3 | 213 | 246 | 141.4 | 170.4 | 209.5 | 191.3 |
| 18 | 0.508 | 0.34 | 0.514 | 0.52 | 0.404 | 0.47 | 0.46 | 0.417 |
| 47 | 1.67 | 9 | 7 | 22.67 | 0 | 6 | 19.67 | 23.67 |
| 50 | 54.7 | 131.1 | 81.3 | 75.6 | 89.5 | 81.4 | 67.3 | 48.1 |
| 51 | 29.9 | 25.5 | NA | 30.2 | 18.9 | 12.7 | 22.7 | 18.6 |
| 55 | 19.41 | NA | 4.28 | 4.82 | 4.54 | 4.06 | 1.62 | 1.34 |
| 57 | 27.4 | NA | 25.4 | 29.2 | NA | NA | 26.9 | 30.8 |
| 1 | 4.33 | NA | 7 | 2 | 7.79 | 5.91 | 4.15 | 3.43 |
| 2 | 0.268 | 0.304 | 0.312 | 0.375 | 0.18 | 0.363 | 0.54 | 0.296 |
| 56 | 12.3 | 14.3 | 12.1 | 11.9 | 11.2 | 14 | 12.4 | 11.4 |
| 10 | 44.9 | NA | 34.2 | 38.9 | 27.4 | 36.4 | 41.1 | 28.6 |
| 11 | 807.8 | NA | 461.2 | 534.2 | 362.8 | 573.8 | 643.3 | 420.8 |
| 19 | 178.6 | 416.4 | 267.5 | 269.9 | 258.9 | 294.2 | 280.7 | 225.9 |
| 20 | 24.8 | 35 | 28.2 | 32.4 | 21.5 | 31.9 | 34.3 | 34.2 |
| 26 | 10.6 | 15.4 | 12.9 | 14 | 9.7 | 12.5 | 15.3 | 13.8 |
| 33 | 2.89 | 2.89 | 2.78 | 2.95 | 2.81 | 3.24 | 2.84 | 3.15 |
| 38 | 48.2 | 61.6 | 49.5 | 53.5 | 35.6 | 57.8 | 63 | 51.3 |
| 39 | 57.25 | NA | 9.6 | 25.14 | 9.79 | 7.62 | 11.79 | 12.95 |
| 42 | 46.5 | 60.5 | 48.2 | 52.4 | 34.9 | 53.6 | 55.8 | 48.6 |
| 43 | 56.95 | NA | 9.58 | 25.07 | 9.73 | 7.6 | 11.79 | 12.88 |
| 54 | 4.39 | 4.48 | 4.36 | 4.52 | 4.34 | 5.12 | 4.46 | 4.38 |
| 58 | 3.72 | NA | 1.45 | 2.47 | 1.75 | 1.27 | 1.52 | 1.68 |
| 45 | 9.49 | NA | NA | 6.94 | 3.37 | 2.42 | 4.59 | 4.11 |
| 48 | 13.8 | 17.5 | 14.3 | 15.1 | 10.4 | 14.4 | 17.9 | 14.8 |
| 52 | 18 | NA | 13.5 | 13.7 | 13.2 | 15.8 | 15.7 | 14.8 |
| 53 | 2.83 | 6.69 | 4.67 | 4.93 | 4.71 | 3.47 | 5.26 | 2.34 |
| 59 | 1 | 1.21 | 1.08 | 1.47 | 1.19 | 1.06 | 1.74 | 1.08 |
| 61 | 47 | 41 | 47.3 | 26.3 | 50 | 50 | 29.7 | 29 |
| 3 | 42.7 | 102.9 | 75.6 | 65 | 65.7 | 60 | 60.9 | 41 |
| 7 | 13.7 | NA | 19.8 | 21.1 | 19.6 | 19 | 17.9 | 14.4 |
| 12 | 0.142 | NA | 0.222 | NA | 0.265 | NA | NA | 0.204 |
| 13 | 14.046 | 13.2284 | 11.779 | 11.9453 | 12.5584 | 12.9428 | 12.9099 | 13.9413 |
| 17 | 1 | 2 | 1.33 | 1 | 1.5 | 2 | 1 | 1 |
| 22 | 42.5 | 63.3 | 59.6 | 73.4 | 45.5 | 63 | 63.4 | 48.2 |
| 21 | 11.5 | 18.6 | 13.8 | 16.3 | 10 | 14.7 | 21.7 | 15.2 |
| 27 | 9.75 | 9.58 | NA | 8.17 | 9.94 | 8.94 | 11.12 | 11.42 |
| 28 | 18.1 | 16.6 | NA | 15.4 | 17.4 | 19.6 | 15.2 | 15.1 |
| 34 | 16.3 | 14.7 | 14.1 | 15.3 | NA | NA | 15.4 | 14.3 |
| 35 | 1.43 | NA | 1.65 | 1.46 | 1.82 | 1.47 | 1.27 | 1.4 |
| 36 | 0.31 | 0.475 | 0.375 | 0.442 | NA | NA | 0.38 | 0.462 |
| 40 | 86.3 | 72.7 | 61.7 | 75.5 | 66 | 66 | 72.7 | 69.3 |
| 41 | 135 | 122 | 116 | 127.2 | 116 | 122 | 122 | 122 |
| 44 | 88 | 81 | 68.7 | 98 | 66 | 72 | 92.3 | 93 |
| 46 | 156 | 186.7 | 133.1 | 154.6 | 133.8 | 149.4 | 171.2 | 160.5 |
| 49 | 0.91 | 1.77 | 1.45 | 1.51 | 1.83 | 1.92 | 1.53 | 1.68 |
| 4 | NA | 38.1 | NA | 47.1 | 48.9 | 46.8 | 46 | 51.4 |
| 8 | 47.8 | 39.3 | 55.5 | 42.9 | NA | NA | 49.8 | 52.1 |
| 14 | 114.4 | NA | 237.3 | 78.4 | NA | NA | 110.1 | 81.6 |
| 24 | 3446.6 | NA | 5565.6 | 2550.5 | NA | NA | 2901.7 | 1872.5 |
| 23 | 0.0535 | 0.0794 | 0.0669 | 0.0886 | 0.0553 | 0.0694 | 0.1002 | 0.0592 |
| 29 | 0.082 | NA | 0.174 | 0.285 | 0.103 | 0.198 | 0.438 | 0.181 |
| 30 | 0.102 | 0.164 | 0.137 | 0.187 | 0.183 | 0.159 | 0.176 | 0.178 |
| 37 | 1.03 | 1.51 | 1.26 | 2.95 | 0.91 | 1.31 | 2.29 | 1.74 |
| 15 | 45.9 | 50.1 | 37.7 | 71 | NA | NA | 73.9 | 47.3 |
| 16 | 0.747 | 0.864 | 0.599 | 1.253 | NA | NA | 1.196 | 0.769 |
| 25 | 0.169 | 0.184 | 0.179 | 0.171 | 0.165 | 0.142 | 0.224 | 0.141 |

Table 257. Provided are the values of each of the parameters (as described above) measured in maize accessions (Line). Growth conditions are specified in the experimental procedure section.

TABLE 258

Measured parameters in Maize Inbred Field A 35K per acre (lines 9-16)

| Line/Corr. ID | Line-9 | Line-10 | Line-11 | Line-12 | Line-13 | Line-14 | Line-15 | Line-16 |
|---|---|---|---|---|---|---|---|---|
| 60 | 62.4 | NA | 67.2 | 71.3 | NA | 81.1 | NA | 82.6 |
| 5 | 99.2 | NA | 99.6 | 96.4 | 99.4 | 88.8 | 100 | 97.4 |
| 6 | 16.4 | 13.1 | 10.5 | 6.8 | 9 | 16.6 | 12.4 | 9.2 |
| 31 | 4.16 | 4.96 | 3.46 | 3.76 | 4.18 | 5.06 | 4.95 | 3.78 |
| 32 | 112 | 218.2 | 163.2 | 169.5 | 186.6 | 243.1 | 265.6 | 172.4 |
| 9 | 67.4 | 193.2 | 150.9 | 145.4 | 167.7 | 215 | 248.6 | 159.2 |
| 18 | 0.262 | 0.538 | 0.403 | 0.411 | 0.436 | 0.493 | 0.602 | 0.447 |
| 47 | 19 | 17.5 | 5 | 2.67 | 10.33 | 4 | 7.33 | 10.33 |

TABLE 258-continued

Measured parameters in Maize Inbred Field A 35K per acre (lines 9-16)

| Line/Corr. ID | Line-9 | Line-10 | Line-11 | Line-12 | Line-13 | Line-14 | Line-15 | Line-16 |
|---|---|---|---|---|---|---|---|---|
| 50 | 63.4 | 74.3 | 87.9 | 138.2 | 109.2 | 79.5 | 106.1 | 104 |
| 51 | 11.4 | 30.7 | 19 | 37.1 | 28.6 | 16.7 | 22.2 | 11.2 |
| 55 | 3.64 | 5.21 | 4.6 | 4.1 | NA | 4.23 | 2.27 | 1.07 |
| 57 | NA | 13.1 | 19.9 | 24.8 | 30.1 | NA | 31 | 33.8 |
| 1 | 6.25 | 3.97 | 5.25 | 1.87 | NA | 6.2 | 4.34 | 3.73 |
| 2 | 0.221 | NA | 0.257 | 0.373 | 0.375 | 0.419 | 0.329 | 0.363 |
| 56 | 10.5 | NA | 12.7 | 13.8 | 13.7 | 13.7 | 10.7 | 11.9 |
| 10 | 30.5 | NA | 35.5 | 41.1 | NA | NA | NA | NA |
| 11 | 490.2 | NA | 596.6 | 696.6 | NA | NA | NA | NA |
| 19 | 304 | 348.2 | 318.8 | 508.6 | 419.3 | 270.6 | 320.2 | 392.8 |
| 20 | 29.4 | 38.1 | 26.7 | 37.5 | 34.8 | 32.6 | 36 | 39.2 |
| 26 | 13.9 | 14.4 | 11.6 | 14.7 | 14.3 | 15.9 | 13.7 | 14.8 |
| 33 | 2.69 | 3.37 | 2.91 | 3.25 | 3.1 | 2.61 | 3.35 | 3.36 |
| 38 | 45.6 | 55.8 | 46.3 | 63.2 | 59.4 | 60.6 | 58.1 | 64.2 |
| 39 | 4.71 | 28.5 | 9.6 | 20.58 | 18.85 | 10.97 | 17.28 | NA |
| 42 | 40.5 | 51.2 | 44.4 | 61.6 | 58.5 | 58.2 | 57.1 | 62.2 |
| 43 | 4.67 | 28.48 | 9.5 | 20.57 | 18.8 | 10.97 | 17.21 | NA |
| 54 | 4 | 4.89 | 4.61 | 5.09 | 4.84 | 4.21 | 5.02 | 5.02 |
| 58 | 0.87 | 2.65 | 1.48 | 2.18 | 2.12 | 1.28 | 1.88 | NA |
| 45 | 1.82 | 7.85 | 3.49 | 8.28 | 6.52 | 2.94 | 5.31 | 2.8 |
| 48 | 14.4 | 14.5 | 12.7 | 15.8 | 15.6 | 18.3 | 14.7 | 16.2 |
| 52 | 15.7 | 14.8 | 16.8 | 16.9 | NA | 11.3 | 15.2 | 16.7 |
| 53 | 2.5 | 4.17 | 4.6 | 8.41 | 8.28 | 5.26 | 6.85 | 6.13 |
| 59 | 1.12 | NA | 1.16 | 1.71 | 1.21 | 1.19 | 1.06 | 1.21 |
| 61 | 33 | 34 | 47.5 | 45.3 | 45.3 | 48 | 55.5 | 45.3 |
| 3 | 20.5 | 57.3 | 74.4 | 98.4 | 86.4 | 61.3 | 91.6 | 82.5 |
| 7 | 19.5 | 22.5 | 19 | 30 | NA | 24.6 | 21.8 | 23.7 |
| 12 | 0.222 | NA | 0.205 | NA | 0.261 | 0.131 | 0.308 | 0.212 |
| 13 | 12.7629 | NA | 12.2642 | 13.2253 | 13.7632 | 11.7345 | 13.27 | 13 |
| 17 | 1 | 1.5 | 1.25 | 1 | 1 | 1 | 1.17 | 1 |
| 22 | 46.4 | 83 | 54.7 | 95.7 | 84.3 | 70.1 | 87.1 | 67.9 |
| 21 | 11.4 | 24.8 | 15.6 | 21.7 | 18.5 | 14.6 | 24 | 18 |
| 27 | 11.08 | 15.62 | 10.25 | 10.17 | 11.38 | 11.58 | 11.96 | 12 |
| 28 | 15.6 | 19.2 | 14.4 | 16.8 | 19.4 | 17.8 | 18.1 | 18.5 |
| 34 | 12.7 | NA | 14.9 | 15.3 | 16 | 15.4 | 17.1 | 15.5 |
| 35 | 1.53 | 1.37 | 1.47 | NA | NA | 1.46 | 1.26 | 1.51 |
| 36 | 0.357 | 0.412 | 0.477 | 0.532 | 0.528 | 0.377 | 0.592 | 0.431 |
| 40 | 66 | 72 | 63.5 | 70 | 74.7 | 66 | 75.7 | 72 |
| 41 | 118 | 123.5 | 116 | 118 | 130.3 | 118 | 138.5 | 127.7 |
| 44 | 85 | 89.5 | 68.5 | 72.7 | 85 | 70 | 83 | 82.3 |
| 46 | 127.1 | NA | 146.7 | 169.5 | 182.7 | 157.6 | 152.7 | 172.7 |
| 49 | 1.33 | 1.29 | 2.04 | 1.66 | 1.7 | 1.87 | 1.31 | 1.4 |
| 4 | 46.8 | 43.9 | 30.9 | 48.8 | 47.9 | 44.7 | 44.4 | 49.2 |
| 8 | 48.6 | 45.3 | 24.8 | 47.1 | 49.5 | 35.5 | 45.2 | 49.9 |
| 14 | NA | 24.5 | 223.7 | 127.3 | NA | NA | 110.2 | 150.7 |
| 24 | NA | 797.7 | 5200.6 | 3135.3 | 2109 | NA | 3959.9 | 4729.1 |
| 23 | 0.0515 | NA | 0.0662 | 0.1166 | 0.1005 | 0.0805 | 0.1063 | 0.0838 |
| 29 | 0.15 | NA | 0.18 | NA | NA | 0.233 | 0.184 | NA |
| 30 | 0.147 | NA | 0.17 | 0.169 | 0.159 | 0.192 | 0.214 | 0.127 |
| 37 | 1.68 | 1.89 | 1.15 | 2.12 | 1.86 | 1.46 | 1.64 | 1.54 |
| 15 | 26.1 | NA | 51.3 | 85.8 | 76.5 | 66.1 | 83.1 | 58.6 |
| 16 | 0.673 | NA | 0.794 | 1.498 | 1.355 | 1.313 | 1.489 | 1.037 |
| 25 | 0.145 | 0.193 | 0.2 | 0.178 | 0.172 | 0.172 | 0.201 | 0.137 |

Table 258. Provided are the values of each of the parameters (as described above) measured in maize accessions (Line). Growth conditions are specified in the experimental procedure section.

TABLE 259

Measured parameters in Maize Inbred Field A 35K per acre (lines 17-24)

| Line/Correlation ID | Line-17 | Line-18 | Line-19 | Line-20 | Line-21 | Line-22 | Line-23 | Line-24 |
|---|---|---|---|---|---|---|---|---|
| 60 | NA | 82.5 | NA | 83 | 81.8 | NA | NA | NA |
| 5 | 100 | 93.9 | NA | NA | NA | 50.8 | 76.3 | NA |
| 6 | 14.1 | 17.7 | 1.9 | 21.1 | 15.6 | 14.1 | 23.4 | 17 |
| 31 | 5.25 | 5.87 | 5.75 | 3.94 | 4.51 | 5.16 | 4.28 | 4.91 |
| 32 | 208.3 | 150.2 | 251.5 | 269.2 | 239.1 | 221.9 | 173.2 | 264 |
| 9 | 192.1 | 131.7 | 238.4 | 245 | 213.4 | 204.1 | 163.4 | 249.3 |
| 18 | 0.497 | 0.346 | 0.48 | 0.468 | 0.488 | 0.531 | 0.417 | 0.536 |
| 47 | 18.33 | 19 | 10.5 | 5.25 | 6.67 | 16.67 | 5.25 | 13.33 |
| 50 | 99.5 | 98.4 | 62.5 | 33.9 | 69.1 | 112.2 | 104.3 | 52.6 |
| 51 | 23.3 | 15.5 | 17.2 | 12.8 | 16.3 | 32.3 | 24.1 | 14.7 |
| 55 | 1.51 | NA | 1.36 | 0.98 | 1.34 | 1.22 | 3.13 | 0.6 |
| 57 | 18.9 | 34.8 | 25.3 | 37.2 | 30.5 | 31.8 | 29.8 | 33.6 |

TABLE 259-continued

Measured parameters in Maize Inbred Field A 35K per acre (lines 17-24)

| Line/Correlation ID | Line-17 | Line-18 | Line-19 | Line-20 | Line-21 | Line-22 | Line-23 | Line-24 |
|---|---|---|---|---|---|---|---|---|
| 1 | 2.36 | NA | 5.15 | 4.6 | 5.33 | 2.28 | 1.87 | 3.04 |
| 2 | 0.349 | 0.318 | 0.605 | 0.339 | 0.319 | 0.522 | 0.619 | 0.375 |
| 56 | 12.2 | 12.7 | 13.7 | 12.1 | 11.5 | 13.7 | 13.3 | 13.4 |
| 10 | 36.1 | NA | NA | 28.2 | 33.1 | 44.2 | NA | 34.9 |
| 11 | 555.5 | NA | NA | 392.3 | 548.1 | 741.1 | NA | 511.7 |
| 19 | 384.8 | 360.3 | 239 | 116.8 | 274.4 | 421.1 | 420.6 | 223.1 |
| 20 | 33.8 | 28.4 | 33.9 | 32.9 | 39.6 | 39.8 | 36 | 27.1 |
| 26 | 13.6 | 13.6 | 13.9 | 14.8 | 16.8 | 14.7 | 13.6 | 12.7 |
| 33 | 3.17 | 2.67 | 3.09 | 2.81 | 2.98 | 3.46 | 3.37 | 2.71 |
| 38 | 53.7 | 46.9 | 63.3 | 46 | 58.5 | 63.8 | 58 | 41.3 |
| 39 | 11.06 | 9.66 | 16.63 | 10.28 | 11.94 | 8.09 | 21.15 | 5.77 |
| 42 | 52.7 | 45.7 | 58.6 | 42.8 | 50.1 | 61.4 | 56.1 | 39.7 |
| 43 | 11.06 | 9.65 | 16.63 | 10.26 | 11.89 | 8.09 | 21.09 | 5.77 |
| 54 | 4.86 | 4.11 | 4.54 | 3.69 | 4.16 | 5.25 | 4.9 | 4.25 |
| 58 | 1.59 | 1.39 | 1.86 | 1.36 | 1.39 | 1.38 | 2.22 | 1.11 |
| 45 | 5.25 | 2.9 | 4.22 | 3.22 | 3.88 | 6.89 | 4.1 | 3.76 |
| 48 | 14 | 14.3 | 17.6 | 15.7 | 17.9 | 15.4 | 15 | 12.2 |
| 52 | 15.3 | NA | 15.3 | 13.8 | 15.8 | 16.8 | 17 | 14.7 |
| 53 | 6.86 | 5.66 | 3.96 | 2.74 | 3.49 | 6.92 | 7.11 | 3.06 |
| 59 | 1.25 | 1.12 | 1.34 | 1.03 | 1.08 | 1.5 | 1.19 | 1 |
| 61 | 39.7 | 29 | 45 | 70 | 58 | 36.7 | 40.5 | 56 |
| 3 | 83.2 | 74.1 | 54.6 | 27.8 | 51.8 | 93.6 | 91.8 | 46.2 |
| 7 | 25.1 | NA | 17.1 | 9.4 | 17.7 | 24.6 | 24.2 | 15.3 |
| 12 | 0.285 | 0.182 | 0.143 | 0.094 | 0.279 | NA | NA | 0.168 |
| 13 | 12.9117 | 12.0596 | 12.6853 | 12.5432 | 14.0549 | 13.8286 | 13.9608 | 14.0242 |
| 17 | 1 | 1 | 1 | 1 | 1.67 | 1 | 1 | 1 |
| 22 | 84.1 | 59.8 | 59.7 | 33.2 | 69.4 | 98 | 75.6 | 61.1 |
| 21 | 16.2 | 11.9 | 26.6 | 18 | 19.4 | 53.7 | 20.5 | 13.3 |
| 27 | 12.38 | 10.85 | 10.38 | 9.62 | 10.83 | 13.6 | 13.67 | 12.54 |
| 28 | 17.8 | 19.6 | 19.6 | 16.2 | 16.6 | 18.4 | 19.7 | 18.7 |
| 34 | 18 | 12.6 | 17.1 | 12.2 | 17.1 | 16.4 | 18.1 | 18.4 |
| 35 | 1.63 | 1.55 | 1.35 | 1.53 | 1.33 | 1.39 | 1.14 | 1.51 |
| 36 | 0.477 | 0.473 | 0.354 | 0.464 | 0.456 | 0.436 | 0.449 | 0.424 |
| 40 | 74.7 | 71 | 76.2 | 79 | 78 | 75.7 | 76.2 | 74 |
| 41 | 132.7 | 119 | 131.8 | 154.7 | 143.5 | 129 | 122 | 143.3 |
| 44 | 93 | 90 | 86.8 | 84.2 | 84.7 | 92.3 | 81.5 | 87.3 |
| 46 | 190.2 | 170.9 | 194.9 | 170.2 | 165.2 | 187.2 | 187.2 | 162.8 |
| 49 | 1.58 | 1.6 | 1.63 | 1.6 | 1.35 | 1.76 | 1.81 | 1.71 |
| 4 | 54.8 | 48.4 | 49.7 | 50 | 50.4 | 52.1 | 50.5 | 40.2 |
| 8 | 55.9 | 41 | 46.9 | 40.2 | 43.9 | 46.9 | 49 | 43.5 |
| 14 | 72.8 | NA | 65.7 | 114.6 | 112.7 | 122 | 73.3 | 99.7 |
| 24 | 2375.3 | 2608.5 | 3248.6 | 3805.9 | 3427.7 | 3564.7 | 3013 | 2913.7 |
| 23 | 0.0993 | 0.061 | 0.0702 | 0.0475 | 0.0732 | 0.1058 | 0.0853 | 0.0635 |
| 29 | 0.184 | NA | 0.321 | 0.194 | 0.193 | 0.182 | 0.403 | 0.161 |
| 30 | 0.207 | 0.193 | 0.132 | 0.101 | 0.166 | 0.17 | 0.14 | 0.124 |
| 37 | 2.12 | 2.25 | 1.45 | 0.5 | 1.08 | 2.29 | 1.87 | 1.09 |
| 15 | 82.7 | 34.6 | 58.1 | 20.4 | 45.1 | 84.5 | 75.6 | 42.3 |
| 16 | 1.434 | 0.581 | 0.978 | 0.343 | 0.695 | 1.403 | 1.298 | 0.936 |
| 25 | 0.15 | 0.158 | 0.266 | 0.194 | 0.168 | 0.17 | 0.169 | 0.18 |

Table 259. Provided are the values of each of the parameters (as described above) measured in maize accessions (Line). Growth conditions are specified in the experimental procedure section.

TABLE 260

Measured parameters in Maize Inbred Field A 35K per acre (lines 25-32)

| Line/Correlation ID | Line-25 | Line-26 | Line-27 | Line-28 | Line-29 | Line-30 | Line-31 | Line-32 |
|---|---|---|---|---|---|---|---|---|
| 60 | NA | NA | 80.9 | NA | 83.4 | 79 | NA | 94.3 |
| 5 | 87.7 | 100 | 97.9 | 100 | 85 | 98.3 | 100 | NA |
| 6 | 3.3 | 23.9 | 11.4 | 15.7 | 17.1 | 18.8 | 16.3 | 8.5 |
| 31 | 7.31 | 3.85 | 5.16 | 4.87 | 5.94 | 8.71 | 5.26 | NA |
| 32 | 284.8 | 230.8 | 266.6 | 285.1 | 176 | 217.3 | 230.5 | 182.5 |
| 9 | 256 | 215.9 | 245 | 260.9 | 175.4 | 206.5 | 217.4 | 168.7 |
| 18 | 0.58 | 0.465 | 0.503 | 0.551 | 0.434 | 0.493 | 0.506 | 0.443 |
| 47 | 19 | 6.33 | 2.5 | 8 | 15 | 20 | 14.67 | 8.5 |
| 50 | 83.9 | 40.2 | 72.3 | 60.9 | 134.3 | 82.4 | 56.4 | 65.3 |
| 51 | 23.6 | 17.5 | 29.2 | 13.6 | 20.4 | 13.1 | 16.6 | 11.6 |
| 55 | 1.04 | NA | NA | 2.67 | NA | NA | NA | 2.86 |
| 57 | 30.5 | NA | NA | 16.5 | 27 | 29.5 | NA | 25.1 |
| 1 | 3.97 | NA | NA | 5.25 | NA | NA | NA | 6.03 |
| 2 | 0.481 | 0.418 | 0.349 | 0.342 | 0.504 | 0.442 | 0.323 | 0.262 |
| 56 | 12.1 | 10.1 | 12.1 | 13.6 | 13.6 | 12.5 | 10.2 | 14.4 |
| 10 | 42.7 | NA | NA | 34.5 | NA | NA | NA | 35.9 |

TABLE 260-continued

Measured parameters in Maize Inbred Field A 35K per acre (lines 25-32)

| Line/Correlation ID | Line-25 | Line-26 | Line-27 | Line-28 | Line-29 | Line-30 | Line-31 | Line-32 |
|---|---|---|---|---|---|---|---|---|
| 11 | 561.8 | NA | NA | 470.9 | NA | NA | NA | 609.9 |
| 19 | 290.4 | 233.7 | 280.6 | 232.6 | 448.6 | 304.6 | 223.7 | 279.7 |
| 20 | 34 | 32.5 | 34.8 | 33.8 | 39.5 | 28.5 | 25.2 | 28.8 |
| 26 | 13.1 | 11.8 | 14.5 | 14.7 | 17.1 | 14.9 | 11.4 | 12.5 |
| 33 | 3.29 | 3.44 | 3.04 | 2.91 | 2.93 | 2.42 | 2.81 | 2.86 |
| 38 | 63.2 | 52.1 | 57.7 | 53.3 | 69.8 | 55.6 | 44.8 | 45.9 |
| 39 | 9.72 | 9.8 | NA | 17.45 | 12.2 | 9.8 | NA | 18.88 |
| 42 | 61.2 | 44.5 | 55.2 | 50 | 68.9 | 54.2 | 40.9 | 43.1 |
| 43 | 9.71 | 9.8 | NA | 17.4 | 12.19 | 9.8 | NA | 18.58 |
| 54 | 5.1 | 4.73 | 4.65 | 4.4 | 4.55 | 4.17 | 4.63 | 4.44 |
| 58 | 1.41 | 1.71 | NA | 2 | 1.42 | 1.35 | NA | 2.15 |
| 45 | 7 | 2.45 | NA | 3.21 | 5.58 | 2.81 | NA | 3.51 |
| 48 | 15.7 | 14 | 15.6 | 15.3 | 19.4 | 16.9 | 12.3 | 13 |
| 52 | 13.2 | NA | NA | 13.7 | NA | NA | NA | 17 |
| 53 | 5.03 | 2.64 | 4.73 | 4.25 | 8.19 | 5.45 | 4.12 | 5.04 |
| 59 | 1.05 | 1.83 | 1.53 | 1.22 | 1.54 | 1.46 | 1.12 | 1 |
| 61 | 36 | 54 | 52.8 | 59 | 31.5 | 28 | 45.3 | NA |
| 3 | 66 | 36 | 60.6 | 50.3 | 128.5 | 74.3 | 49.8 | 55.5 |
| 7 | 22.8 | NA | NA | 18.1 | NA | NA | NA | 16.5 |
| 12 | 0.16 | NA | NA | NA | NA | NA | 0.229 | 0.207 |
| 13 | 13.0292 | 13.27 | 13.2261 | 13.7948 | 12.3016 | 12.5913 | 13.3612 | 14.5404 |
| 17 | 1 | 1.33 | 1.25 | 1.5 | 1 | 1 | 1 | NA |
| 22 | 81.2 | 57 | 74 | 70.5 | 79.6 | 67.9 | 53 | 53.5 |
| 21 | 20 | 16.2 | 22 | 16.6 | 21.7 | 11.6 | 14.9 | 22.5 |
| 27 | 10.46 | 9.79 | 10.9 | 10.38 | 12.33 | 12.45 | 14.04 | 10.19 |
| 28 | 19.6 | 16.1 | 17.6 | 18.9 | 17.5 | 15.4 | 17.4 | 17.6 |
| 34 | 16.8 | 17.3 | 17.2 | 17.2 | 15.8 | 15.7 | 17.5 | NA |
| 35 | 1.47 | NA | NA | 1.32 | 1.57 | 1.9 | NA | 1.46 |
| 36 | 0.398 | 0.48 | 0.346 | 0.491 | 0.436 | 0.526 | 0.384 | NA |
| 40 | 74 | 74.7 | 80 | 76.2 | 70 | 70 | 72.7 | 88 |
| 41 | 129 | 135 | 135.2 | 143.2 | 122 | 118 | 132.7 | NA |
| 44 | 93 | 81 | 82.5 | 84.2 | 85 | 90 | 87.3 | 96.5 |
| 46 | 156.7 | 160 | 171.9 | 178.4 | 150.6 | 158.7 | 134.2 | 202.3 |
| 49 | 1.55 | 1.43 | 1.2 | 1.26 | 1.27 | 1.46 | 1.2 | 1.12 |
| 4 | 52 | 43.9 | 56.4 | 48.9 | 46.3 | 47.1 | 48.8 | NA |
| 8 | 46.3 | 44.9 | 49.8 | 44.8 | 43.4 | 51.8 | 46.5 | 45.5 |
| 14 | 144.6 | NA | NA | 69.6 | NA | NA | NA | 91.2 |
| 24 | 4355.9 | NA | NA | 2507.1 | 2625.9 | 3737.3 | NA | 2667.3 |
| 23 | 0.098 | 0.103 | 0.101 | 0.084 | 0.0981 | 0.0778 | 0.0642 | 0.0664 |
| 29 | 0.248 | NA | NA | 0.189 | NA | NA | NA | 0.1 |
| 30 | 0.123 | 0.176 | 0.119 | 0.167 | 0.137 | 0.125 | 0.134 | 0.15 |
| 37 | 2.48 | 0.95 | 1.45 | 1.2 | 2.65 | 2.84 | 1.27 | NA |
| 15 | 88.4 | 59.9 | 72.6 | 70.3 | 68.8 | 51.2 | 44.1 | NA |
| 16 | 1.601 | 1.085 | 1.308 | 1.151 | 1.266 | 0.846 | 0.791 | NA |
| 25 | 0.172 | 0.152 | 0.207 | 0.169 | 0.189 | 0.168 | 0.21 | 0.257 |

Table 260. Provided are the values of each of the parameters (as described above) measured in maize accessions (Line). Growth conditions are specified in the experimental procedure section.

TABLE 261

Measured parameters in Maize Inbred Field A 35K per acre (lines 33-40)

| Line/Correlation ID | Line-33 | Line-34 | Line-35 | Line-36 | Line-37 | Line-38 | Line-39 | Line-40 |
|---|---|---|---|---|---|---|---|---|
| 60 | 89.1 | 84.6 | 91 | 78.9 | 57.5 | NA | 85.6 | 98.5 |
| 5 | NA | 100 | NA | 100 | NA | 98.4 | NA | NA |
| 6 | 10.9 | 25.5 | 29 | 19.5 | NA | NA | 2.6 | 17.1 |
| 31 | 4.3 | 4.24 | 3.68 | 5.59 | NA | 3.15 | 5.22 | 3.02 |
| 32 | 296.4 | 212.5 | 224.2 | 231.4 | NA | 160.7 | 314.1 | 220.6 |
| 9 | 289.1 | 196.8 | 210.4 | 201.9 | NA | 133.9 | 297.1 | 215.3 |
| 18 | 0.6 | 0.492 | 0.472 | 0.507 | NA | 0.375 | 0.531 | 0.488 |
| 47 | 11.33 | 10 | 8.67 | 7.33 | 3 | 5.33 | 5.25 | 5 |
| 50 | 123.4 | 47.2 | 52.9 | 76.4 | NA | 61 | 63.9 | 43.1 |
| 51 | 16.4 | 8.7 | 11.1 | 24.3 | NA | NA | 12.8 | 13.3 |
| 55 | 0.33 | 0.49 | NA | 1.58 | 4.16 | 3.72 | NA | NA |
| 57 | 30.7 | 27.5 | NA | 26.2 | NA | 26.4 | NA | NA |
| 1 | 5.3 | 6.62 | NA | 4.28 | 5.45 | 5.11 | NA | NA |
| 2 | 0.609 | 0.434 | 0.23 | 0.358 | NA | 0.269 | 0.374 | 0.605 |
| 56 | 10.9 | 11.5 | 9.4 | 12.3 | NA | 12.2 | 9.8 | 10.6 |
| 10 | 29.8 | 21.9 | NA | 30.1 | 30.2 | 35.2 | NA | NA |
| 11 | 476.8 | 311 | NA | 443.4 | 454.4 | 535.1 | NA | NA |
| 19 | 414.6 | 287.1 | 201 | 273.1 | 193.4 | 281.5 | 226.6 | 182.3 |
| 20 | 48.1 | 33.7 | 21.1 | 30 | 38.5 | 37.3 | 40.1 | 25.8 |
| 26 | 17 | 13.3 | 9.2 | 13.9 | 17 | 15.7 | 15 | 10.2 |

TABLE 261-continued

Measured parameters in Maize Inbred Field A 35K per acre (lines 33-40)

| Line/Correlation ID | Line-33 | Line-34 | Line-35 | Line-36 | Line-37 | Line-38 | Line-39 | Line-40 |
|---|---|---|---|---|---|---|---|---|
| 33 | 3.6 | 3.22 | 2.88 | 2.72 | 2.88 | 3.03 | 3.4 | 3.22 |
| 38 | 68.7 | 45.4 | 38.3 | 64.8 | 51.7 | 53.7 | 58.1 | 52.7 |
| 39 | 4.77 | 5.63 | NA | 9.61 | 8.62 | 12.2 | NA | NA |
| 42 | 64.2 | 41.1 | 36.4 | 62.9 | 40.9 | 47 | 57.7 | 51.6 |
| 43 | 4.77 | 5.62 | NA | 9.55 | 8.25 | 12.17 | NA | NA |
| 54 | 5.2 | 4.49 | 4.21 | 4.6 | 4.12 | 4.26 | 4.63 | 4.55 |
| 58 | 0.96 | 1.17 | NA | 1.45 | 1.46 | 1.68 | NA | NA |
| 45 | 4.01 | 2.25 | NA | 6.17 | NA | NA | NA | NA |
| 48 | 16.6 | 12.7 | 11.4 | 17.9 | 15.9 | 16 | 15.9 | 14.6 |
| 52 | 16 | 14.2 | NA | 14.7 | 15 | 15.2 | NA | NA |
| 53 | 9.42 | 3.33 | 3.65 | 4.28 | NA | 2.66 | 3.84 | 2.75 |
| 59 | 1.04 | 1 | 1.14 | 1.46 | NA | 1.4 | 1 | 1.38 |
| 61 | 66 | 43.7 | 63.3 | 42.7 | 49 | 51.3 | 59.8 | 73 |
| 3 | 117.4 | 40.1 | 45.6 | 56.3 | NA | 38.6 | 56.6 | 41 |
| 7 | 25.9 | 20.5 | NA | 18.5 | 13.3 | 18.7 | NA | NA |
| 12 | 0.182 | 0.169 | 0.213 | 0.226 | NA | 0.307 | 0.185 | NA |
| 13 | 14.3634 | 13.2371 | 13.0652 | 13.2555 | 12.8298 | NA | NA | 14.4108 |
| 17 | 1 | 1 | 1.33 | 1.33 | NA | 1.67 | 1 | 1 |
| 22 | 124 | 65.4 | 45.9 | 68.9 | 51.1 | 51.8 | 73 | 40.8 |
| 21 | 31.3 | 25.9 | 10.2 | 18.3 | 18.5 | 20 | 18.4 | 15.5 |
| 27 | 11.11 | 9.62 | 9.88 | 10.71 | NA | NA | 10.84 | 8.25 |
| 28 | 20.8 | 17 | 14.4 | 17.5 | NA | NA | 16.5 | 14.9 |
| 34 | 24.9 | 15 | 25.6 | 15.2 | NA | 14.8 | 18.8 | 34.5 |
| 35 | 1.54 | 1.2 | NA | 1.42 | 1.75 | 1.92 | NA | NA |
| 36 | 0.361 | 0.437 | 0.438 | 0.386 | NA | 0.414 | 0.338 | NA |
| 40 | 79.7 | 79 | 86.3 | 79 | 64 | 61.3 | 79 | 93 |
| 41 | 157 | 132.7 | 158.3 | 129 | 116 | 118 | 144 | 171 |
| 44 | 91 | 89 | 95 | 86.3 | 67 | 66.7 | 84.2 | 98 |
| 46 | 169.7 | 166.8 | 120.9 | 175.3 | NA | 128.7 | 125.7 | 174.9 |
| 49 | 1.12 | 1.28 | 0.91 | 1.43 | 2.17 | 2.03 | 1.19 | 1.11 |
| 4 | 55.5 | 35.2 | NA | 48.1 | NA | NA | 52.4 | NA |
| 8 | 53.8 | 27.8 | 33.6 | 40.1 | NA | 31.5 | 41.7 | 53.5 |
| 14 | 115.6 | 134.7 | NA | 128 | NA | 218.9 | NA | NA |
| 24 | 5193.6 | 4171.6 | NA | 3181.1 | NA | 4424.7 | NA | NA |
| 23 | 0.1041 | 0.0626 | 0.0443 | 0.0975 | NA | 0.0701 | 0.0778 | 0.0931 |
| 29 | 0.21 | 0.272 | NA | 0.231 | NA | 0.143 | NA | NA |
| 30 | 0.134 | 0.165 | 0.157 | 0.126 | NA | NA | NA | 0.157 |
| 37 | 1.87 | 1.3 | 0.79 | 1.68 | 1.06 | 1.01 | 1.21 | 0.56 |
| 15 | 73.1 | 39.3 | 44.2 | 64 | NA | 57.1 | 58.4 | 66 |
| 16 | 1.49 | 0.619 | 0.764 | 1.118 | NA | 1.054 | 1.158 | 1.388 |
| 25 | 0.182 | 0.235 | 0.175 | 0.232 | 0.168 | 0.178 | 0.134 | 0.187 |

Table 261. Provided are the values of each of the parameters (as described above) measured in maize accessions (Line). Growth conditions are specified in the experimental procedure section.

TABLE 262

Measured parameters in Maize Inbred Field A 35K per acre (lines 41-48)

| Line/Correlation ID | Line-41 | Line-42 | Line-43 | Line-44 | Line-45 | Line-46 | Line-47 | Line-48 |
|---|---|---|---|---|---|---|---|---|
| 60 | 89 | 93.5 | NA | 78.2 | NA | 88.7 | 87.2 | 79.9 |
| 5 | NA | NA | NA | NA | 98.5 | NA | NA | NA |
| 6 | 7.2 | 8.7 | NA | 10.7 | 1.5 | 15.5 | 19.7 | 11.1 |
| 31 | 3.49 | NA | 3.77 | 4.03 | 6.98 | 3.52 | 3.91 | 3.76 |
| 32 | 234.3 | NA | 275.4 | 182.6 | 288.2 | 258.4 | 307 | 254.2 |
| 9 | 211.4 | NA | 243 | 154.1 | 248.5 | 240 | 303.8 | 237 |
| 18 | 0.407 | NA | 0.571 | 0.436 | 0.655 | 0.554 | 0.562 | 0.569 |
| 47 | 10 | 6 | NA | 2.67 | 8 | 10.33 | 4.75 | 12 |
| 50 | 75.8 | NA | 80 | 54.1 | 73.9 | 77.8 | 80.9 | 62.5 |
| 51 | 10.4 | 12.4 | NA | 16.5 | 23.5 | 6.1 | 10.9 | 10.9 |
| 55 | 5.74 | NA | NA | NA | NA | 0.72 | NA | 0.75 |
| 57 | 37.3 | NA | NA | NA | 22.5 | 33.6 | NA | 34.5 |
| 1 | 4.4 | NA | NA | NA | NA | 7.48 | NA | 3.18 |
| 2 | 0.374 | 0.401 | 0.52 | 0.212 | 0.531 | 0.35 | 0.438 | 0.352 |
| 56 | 11.2 | 12.4 | 11.2 | 13.6 | 13.1 | 11.6 | 10.9 | 14.5 |
| 10 | 34.9 | NA | NA | NA | NA | 46.8 | NA | 39.3 |
| 11 | 462.1 | NA | NA | NA | NA | 528.5 | NA | 609.3 |
| 19 | 323.8 | 92.7 | 233.4 | 175 | 270.7 | 274.7 | 251.9 | 340.2 |
| 20 | 38.2 | 31.6 | 31.5 | 25.5 | 46 | 29.8 | 34 | 40.7 |
| 26 | 15.1 | 12.1 | 13.8 | 11.4 | 16.3 | 15.1 | 14.3 | 15.9 |
| 33 | 3.21 | 3.33 | 2.9 | 2.81 | 3.59 | 2.49 | 3.02 | 3.27 |
| 38 | 61.5 | 45 | 48.5 | 45.2 | 71.1 | 55.9 | 57.4 | 64 |
| 39 | 21.66 | NA | NA | NA | NA | 7.93 | NA | 6.86 |
| 42 | 60.7 | 42.4 | 40 | 42.6 | 67.6 | 50.9 | 55.9 | 61 |

TABLE 262-continued

Measured parameters in Maize Inbred Field A 35K per acre (lines 41-48)

| Line/Correlation ID | Line-41 | Line-42 | Line-43 | Line-44 | Line-45 | Line-46 | Line-47 | Line-48 |
|---|---|---|---|---|---|---|---|---|
| 43 | 21.45 | NA | NA | NA | NA | 7.92 | NA | 6.86 |
| 54 | 4.68 | 4.68 | 4.3 | 4.22 | 5.62 | 4.13 | 4.5 | 4.67 |
| 58 | 2.08 | NA | NA | NA | NA | 1 | NA | 1.08 |
| 45 | 4.7 | NA | NA | NA | 4.78 | 1.73 | NA | 2.72 |
| 48 | 16.7 | 12.1 | 14.2 | 13.6 | 16.1 | 17 | 16.2 | 17.4 |
| 52 | 13.2 | NA | NA | NA | NA | 11.2 | NA | 15.4 |
| 53 | 4.1 | NA | 4.43 | 2.99 | 4.33 | 4.21 | 5.59 | 4.82 |
| 59 | 1.19 | 1.29 | 1.12 | 1.04 | 1.5 | 1 | 1 | 1 |
| 61 | 67.5 | 64.7 | 76.5 | 50.3 | 46 | 73.7 | 79.2 | 71.3 |
| 3 | 61.1 | NA | 61 | 36.7 | 59.4 | 65.2 | 79.3 | 53.5 |
| 7 | 24.5 | NA | NA | NA | NA | 24.4 | NA | 21.9 |
| 12 | 0.268 | 0.054 | 0.13 | 0.236 | NA | 0.208 | 0.178 | 0.275 |
| 13 | 13.7023 | 13.6365 | 11.9151 | 13.6717 | 12.5777 | 13.655 | 13.0256 | 15.8302 |
| 17 | 1 | 1 | 1 | 1 | 1 | 2 | 1 | 1 |
| 22 | 81.4 | 24.4 | 68.3 | 35 | 76.3 | 72.9 | 77.5 | 90 |
| 21 | 19.4 | 40.9 | 32.7 | 22 | 37.5 | 12.9 | 14.6 | 17.8 |
| 27 | 10.81 | 8.54 | NA | 9 | 12.25 | 9.12 | 9.28 | 9.83 |
| 28 | 16.7 | 17.6 | NA | 14.8 | 17.8 | 19.1 | 18 | 17.7 |
| 34 | 25.4 | 21.3 | 31.9 | 15.3 | 16.6 | 26.8 | 25.4 | 18.2 |
| 35 | 1.35 | NA | NA | NA | NA | 1.59 | NA | 1.42 |
| 36 | NA | NA | NA | NA | 0.356 | 0.415 | 0.372 | 0.47 |
| 40 | 83 | 86.3 | NA | 82 | 74.7 | 84.7 | 78.2 | 83 |
| 41 | 160.5 | 157 | 171 | 135 | 131.3 | 168.7 | 162.2 | 166.3 |
| 44 | 93 | 92.3 | 94.5 | 84.7 | 83 | 95 | 83 | 95 |
| 46 | 147.5 | 170.8 | 181.1 | 179 | 169.7 | 170.4 | 151.9 | 235 |
| 49 | 1.13 | 1.27 | 1.01 | 1.29 | 1.21 | 0.87 | 1.06 | 1.66 |
| 4 | NA | NA | NA | 53.1 | 54.9 | NA | 47.1 | NA |
| 8 | 41.3 | 44.9 | NA | 44.9 | 49.2 | 37 | 49.4 | 45.5 |
| 14 | 105.1 | NA | NA | NA | NA | 115.3 | NA | 97 |
| 24 | 4344.9 | NA | NA | NA | 814.7 | 4492.1 | NA | 3429.1 |
| 23 | 0.1092 | 0.0514 | 0.0759 | 0.0571 | 0.1369 | 0.0705 | 0.0846 | 0.1035 |
| 29 | 0.17 | NA | NA | NA | NA | 0.117 | NA | 0.102 |
| 30 | 0.156 | 0.223 | 0.119 | 0.145 | 0.149 | 0.201 | 0.169 | 0.182 |
| 37 | 1.2 | 0.37 | 0.94 | 0.77 | 1.43 | 1 | 0.98 | 1.31 |
| 15 | 72.6 | 46.8 | 38.4 | 36.3 | 83.1 | 48.8 | 64.2 | 61.7 |
| 16 | 1.411 | 0.914 | 0.782 | 0.634 | 1.723 | 0.826 | 1.027 | 1.432 |
| 25 | 0.159 | 0.389 | 0.168 | 0.274 | 0.224 | 0.176 | 0.143 | 0.134 |

Table 262. Provided are the values of each of the parameters (as described above) measured in maize accessions (Line). Growth conditions are specified in the experimental procedure section.

TABLE 263

Measured parameters in Maize Inbred Field A 35K per acre (lines 49-56)

| Line/Correlation ID | Line-49 | Line-50 | Line-51 | Line-52 | Line-53 | Line-54 | Line-55 | Line-56 |
|---|---|---|---|---|---|---|---|---|
| 60 | 79 | 89.3 | 83.8 | NA | 78.7 | NA | 78.4 | 75.5 |
| 5 | 71.9 | NA | 77.3 | 100 | 100 | 51.4 | NA | 100 |
| 6 | 14.4 | 10.5 | NA | 0 | 20.1 | 19.6 | 5.6 | 5.7 |
| 31 | 4.55 | 4.25 | 7.58 | 3.77 | 5.75 | 5.3 | 4.66 | 2.54 |
| 32 | 237.8 | 293.9 | 180.6 | 193.9 | 265.9 | 222.3 | 356.8 | 118.3 |
| 9 | 223.1 | 320.3 | 157.5 | 170.7 | 243.3 | 170.7 | 360.1 | 109 |
| 18 | 0.501 | 0.52 | 0.412 | 0.437 | 0.514 | 0.434 | 0.726 | 0.256 |
| 47 | 5.62 | 13.33 | 30 | 8 | 8.5 | 10.25 | 5.67 | 6.67 |
| 50 | 34.6 | 57.4 | 123.1 | 120.2 | 26.9 | 53.4 | 33 | 92.1 |
| 51 | 14 | 13.9 | NA | 15.2 | 13.6 | 16.8 | 7.3 | 9.8 |
| 55 | 1.58 | NA | NA | 0.58 | 1.43 | 0.36 | NA | NA |
| 57 | 19 | NA | 32.8 | 27.4 | 33.8 | 25.1 | NA | NA |
| 1 | 2.21 | NA | NA | 3.19 | 5.53 | 5.98 | NA | NA |
| 2 | 0.336 | 0.757 | 0.476 | 0.3 | 0.282 | 0.447 | 0.457 | 0.293 |
| 56 | 12.7 | 14 | 11 | 10.2 | 10.3 | 11.2 | 11.1 | 9.1 |
| 10 | NA | NA | NA | 41.8 | NA | 36.2 | NA | NA |
| 11 | NA | NA | NA | 626.2 | NA | 574.1 | NA | NA |
| 19 | 191.9 | 201.9 | 395.6 | 373.6 | 136.3 | 278.5 | 146.4 | 287.9 |
| 20 | 20.7 | 36.4 | 48.9 | 33.8 | 34.4 | 35.3 | 23.3 | 25.7 |
| 26 | 10.9 | 14.2 | 17.5 | 14.9 | 15.3 | 14.6 | 11.8 | 13.6 |
| 33 | 2.42 | 3.29 | 3.55 | 2.88 | 2.87 | 3.07 | 2.44 | 2.43 |
| 38 | 35.4 | 48.2 | 76.2 | 55.4 | 42.8 | 57.1 | 38.4 | 39 |
| 39 | 8.01 | NA | 16.39 | 5.44 | 11.06 | 4.45 | NA | NA |
| 42 | 32.2 | 43.9 | 71.5 | 51.9 | 35.7 | 49.1 | 36.9 | 38.6 |
| 43 | 8 | NA | 16.37 | 5.44 | 11.06 | 4.45 | NA | NA |
| 54 | 4.07 | 3.97 | 4.9 | 4.56 | 3.65 | 4.48 | 4.02 | 3.21 |
| 58 | 1.38 | NA | 1.87 | 1.08 | 1.42 | 1.02 | NA | NA |
| 45 | 2.92 | NA | NA | 3.4 | 3.57 | 3.4 | NA | NA |

TABLE 263-continued

Measured parameters in Maize Inbred Field A 35K per acre (lines 49-56)

| Line/Correlation ID | Line-49 | Line-50 | Line-51 | Line-52 | Line-53 | Line-54 | Line-55 | Line-56 |
|---|---|---|---|---|---|---|---|---|
| 48 | 11 | 14.6 | 19.7 | 15.4 | 14.2 | 16.1 | 11.9 | 15.3 |
| 52 | 11.8 | NA | NA | 15.2 | 14.7 | 15.8 | NA | NA |
| 53 | 1.91 | 3.11 | 8.18 | 6.27 | 2.02 | 3.43 | 1.88 | 8.63 |
| 59 | 1.56 | 1.28 | 1.12 | 1.5 | 1.09 | 1.19 | 1 | 1.42 |
| 61 | 52.1 | 70.7 | 26.7 | 53 | 48 | 37.3 | 76.7 | 47.7 |
| 3 | 30.3 | 50.2 | 91.6 | 88.2 | 22.6 | 39.3 | 31.7 | 77.2 |
| 7 | 17.1 | NA | NA | 24.5 | 8.8 | 16.6 | NA | NA |
| 12 | 0.258 | 0.093 | NA | 0.306 | 0.123 | NA | 0.118 | 0.153 |
| 13 | 12.6048 | 12.1484 | 14.1534 | 12.2006 | 15.0086 | 13.3284 | 12.6647 | 12.3616 |
| 17 | 1.14 | 1.25 | 1 | 1 | 1.5 | 1 | 1 | 1 |
| 22 | 47.7 | 56.5 | 77.5 | 77.5 | 37 | 61 | 52.3 | 35.4 |
| 21 | 13.9 | 25.5 | 27.1 | 20.8 | 17.3 | 18.5 | 12 | 8.9 |
| 27 | 14.44 | 8.62 | NA | 15.08 | 9.72 | 11.08 | 9.12 | 10.25 |
| 28 | 13.8 | 17.2 | NA | 17 | 15 | 17.4 | 18 | 15 |
| 34 | 18 | 31.1 | 14.7 | 16.4 | 12.1 | 16.1 | 29 | 11.3 |
| 35 | 1.37 | 1.28 | NA | 1.54 | 1.43 | 1.54 | NA | NA |
| 36 | 0.379 | 0.511 | 0.469 | 0.423 | 0.433 | 0.41 | 0.382 | 0.346 |
| 40 | 77.5 | 81.5 | 68 | 75 | 77 | 74 | 86.3 | 78 |
| 41 | 135.6 | 167.5 | 124.7 | 136 | 133.5 | 122 | 168.7 | 132.3 |
| 44 | 83.1 | 95.7 | 98 | 83 | 85.5 | 84.2 | 92 | 84.7 |
| 46 | 165.1 | 234.9 | 155 | 156.5 | 166.8 | 146.4 | 146.3 | 114 |
| 49 | 1.31 | 2.07 | 1.53 | 1.42 | 1.29 | 1.25 | 1.05 | 0.93 |
| 4 | 42.6 | NA | 45.1 | 53.4 | 44.5 | 36.4 | NA | 39.5 |
| 8 | 34.4 | 49.4 | 51.1 | 49.6 | 38.4 | 37.5 | 32.8 | 39.9 |
| 14 | 67.6 | NA | NA | 51.1 | 96.4 | 101.6 | NA | NA |
| 24 | 1813.9 | NA | 830 | 2257.9 | 2599 | 3084.9 | NA | NA |
| 23 | 0.0702 | 0.0556 | 0.0872 | 0.1026 | 0.0455 | 0.0723 | 0.0463 | 0.0423 |
| 29 | 0.191 | NA | NA | 0.144 | 0.21 | 0.173 | NA | NA |
| 30 | 0.137 | 0.17 | 0.168 | 0.187 | 0.132 | 0.15 | 0.109 | 0.136 |
| 37 | 0.94 | 0.79 | 3.32 | 1.52 | 0.8 | 1.63 | 0.68 | 0.76 |
| 15 | 52.3 | 38.8 | 59.2 | 66.6 | 26.9 | 72.7 | 37 | 20.5 |
| 16 | 0.907 | 0.714 | 1.138 | 1.344 | 0.45 | 1.209 | 0.645 | 0.379 |
| 25 | 0.28 | 0.176 | 0.157 | 0.215 | 0.176 | 0.17 | 0.219 | 0.14 |

Table 263. Provided are the values of each of the parameters (as described above) measured in maize accessions (Line). Growth conditions are specified in the experimental procedure section.

TABLE 264

Measured parameters in Maize Inbred Field A 35K per acre (lines 57-64)

| Line/Correlation ID | Line-57 | Line-58 | Line-59 | Line-60 | Line-61 | Line-62 | Line-63 | Line-64 |
|---|---|---|---|---|---|---|---|---|
| 60 | 90.4 | 86.2 | 88.8 | 85.2 | NA | 82.6 | NA | 81.9 |
| 5 | NA | NA | NA | NA | 99.2 | NA | 100 | 87 |
| 6 | 19.4 | 18 | 9 | 16.5 | 11.9 | 21.1 | 10 | 12.2 |
| 31 | 2.69 | 3.7 | 3.01 | 5.19 | 4.51 | 3.42 | 3.52 | 7.08 |
| 32 | 182.7 | 248.3 | 241.2 | 332.8 | 202.1 | 249.8 | 180.6 | 228.8 |
| 9 | 176.3 | 235.3 | 222.5 | 332.8 | 186.5 | 237.8 | 164.3 | 211.4 |
| 18 | 0.433 | 0.557 | 0.515 | 0.671 | 0.402 | 0.528 | 0.496 | 0.513 |
| 47 | 5.5 | 12.33 | 3.67 | 8.67 | 8 | 9 | 11.42 | 14.67 |
| 50 | 43.1 | 69.5 | 81.8 | 32.5 | 78.3 | 75.2 | 76.6 | 91.4 |
| 51 | 6.6 | 14.6 | 11.6 | 11.1 | 14.3 | 7.1 | 14.2 | 16.5 |
| 55 | 3.43 | 2.32 | 3.13 | NA | NA | 1.68 | 0.42 | 1.47 |
| 57 | 26.6 | 32.3 | 32.8 | NA | 21.2 | 34.9 | 28.4 | 20.5 |
| 1 | 8.76 | 6.48 | 7.02 | NA | NA | 6.39 | 8.45 | 7.22 |
| 2 | 0.238 | 0.345 | 0.391 | 0.372 | 0.411 | 0.33 | 0.245 | 0.363 |
| 56 | 11.6 | 11.3 | 13.1 | 11.2 | 11.8 | 11.4 | 11.2 | 13.7 |
| 10 | 42.3 | 34.8 | 32.7 | NA | NA | 36.4 | 38.4 | 27.8 |
| 11 | 629.3 | 505.9 | 365.2 | NA | NA | 454.7 | 658.5 | 435.4 |
| 19 | 203.7 | 282.1 | 257.6 | 124.6 | 248.6 | 253.1 | 312 | 316.9 |
| 20 | 26.2 | 38.1 | 28.9 | 29.3 | 32 | 32.6 | 26.4 | 33.6 |
| 26 | 12.7 | 14.3 | 13.2 | 12.2 | 13.9 | 13.2 | 10 | 13.9 |
| 33 | 2.56 | 3.38 | 2.77 | 3.06 | 2.95 | 3.13 | 3.34 | 3.06 |
| 38 | 26.4 | 54.5 | 48.7 | 43 | 56.1 | 41.4 | 36.1 | 61.1 |
| 39 | 23.45 | 10.93 | 12.94 | NA | NA | 11.32 | 4.98 | 3.8 |
| 42 | 24.7 | 52.8 | 47.2 | 42.4 | 53.8 | 39.4 | 34.6 | 60.5 |
| 43 | 23.25 | 10.9 | 12.94 | NA | NA | 11.23 | 4.98 | 3.8 |
| 54 | 3.3 | 4.82 | 4.41 | 4.25 | 4.52 | 3.96 | 4.53 | 5.01 |
| 58 | 2.01 | 1.58 | 1.7 | NA | NA | 1.34 | 1.14 | 0.92 |
| 45 | 2.07 | 3.27 | 3.46 | NA | 5.18 | 2.05 | 3.68 | 3.6 |
| 48 | 9.2 | 14.2 | 14 | 12.7 | 15.7 | 12.7 | 9.9 | 15.4 |
| 52 | 14.8 | 14.5 | 11.2 | NA | NA | 13 | 17.1 | 15.7 |
| 53 | 3.25 | 4.13 | 4.55 | 2.17 | 3.62 | 4.67 | 4.01 | 5.32 |
| 59 | 1.12 | 1.12 | 1.17 | 1 | 1.08 | 1 | 1.01 | 1.26 |

TABLE 264-continued

Measured parameters in Maize Inbred Field A 35K per acre (lines 57-64)

| Line/Correlation ID | Line-57 | Line-58 | Line-59 | Line-60 | Line-61 | Line-62 | Line-63 | Line-64 |
|---|---|---|---|---|---|---|---|---|
| 61 | 63.2 | 67 | 77.3 | 66.7 | 46 | 76.3 | 51.8 | 39.7 |
| 3 | 41.8 | 60.7 | 69.1 | 32.7 | 60.4 | 68 | 63.1 | 76.8 |
| 7 | 13.7 | 19.5 | 22.4 | NA | NA | 20.2 | 20.9 | 20.2 |
| 12 | 0.178 | NA | NA | 0.102 | 0.128 | 0.179 | 0.267 | NA |
| 13 | 13.0251 | 13.5444 | 14.1593 | 12.8535 | 14.0662 | 14.4775 | 12.3054 | 12.9265 |
| 17 | 1 | 1.33 | 1 | 2 | 1 | 1.33 | 1.08 | 1 |
| 22 | 37.7 | 70.3 | 64.5 | 41 | 53.5 | 57.2 | 59.7 | 75.6 |
| 21 | 31.1 | 28.2 | 11.7 | 73.1 | 19.6 | 13.3 | 17.9 | 14.1 |
| 27 | 8.5 | 8.5 | 8.29 | 9.79 | 10.12 | 7.59 | 10.83 | 10 |
| 28 | 16.2 | 16.5 | 15.5 | 17.8 | 18.1 | 20.4 | 18 | 16.1 |
| 34 | 22.2 | 22 | 28.9 | 20.7 | 16.3 | 21 | 17.8 | 15.2 |
| 35 | 1.46 | 1.31 | 1.52 | NA | NA | 1.56 | 1.32 | 1.44 |
| 36 | 0.387 | 0.392 | 0.379 | 0.355 | 0.378 | 0.469 | 0.352 | 0.509 |
| 40 | 87.5 | 82.3 | 90 | 86.3 | 74.7 | 83.3 | 76.6 | 66 |
| 41 | 156.2 | 161.7 | 171 | 161.7 | 129 | 168.7 | 139.8 | 120.3 |
| 44 | 93 | 94.7 | 93.7 | 95 | 83 | 92.3 | 88 | 80.7 |
| 46 | 152.2 | 171.6 | 181.5 | 161.2 | 153.1 | 158.8 | 147.4 | 174.8 |
| 49 | 0.91 | 1.03 | 1.25 | 1.45 | 1.29 | 1.09 | 1.21 | 2.11 |
| 4 | NA | NA | NA | NA | 46.8 | NA | 35.1 | 45.9 |
| 8 | 32.9 | 38.8 | 40.8 | 35.6 | 41.7 | 29.4 | 38.2 | 42.8 |
| 14 | 100.3 | 102.7 | 105.1 | NA | NA | 108.9 | 46 | 196.2 |
| 24 | 3687.4 | 4097.6 | 4776.2 | NA | 1625.2 | 4305.4 | 3948.8 | 4792.1 |
| 23 | 0.0255 | 0.0848 | 0.0715 | 0.0592 | 0.0674 | 0.0449 | 0.0442 | 0.0825 |
| 29 | 0.1 | 0.147 | 0.13 | NA | NA | 0.156 | 0.248 | 0.299 |
| 30 | 0.124 | 0.204 | 0.12 | 0.141 | 0.101 | 0.109 | 0.153 | 0.153 |
| 37 | 0.55 | 1.05 | 0.81 | 0.69 | 1.3 | 0.77 | 1.16 | 2.33 |
| 15 | 33.9 | 68.1 | 59.1 | 32.9 | 58.9 | 30.8 | 37.2 | 67.9 |
| 16 | 0.627 | 1.276 | 0.994 | 0.638 | 0.987 | 0.552 | 0.759 | 1.185 |
| 25 | 0.352 | 0.218 | 0.146 | 0.818 | 0.205 | 0.13 | 0.165 | 0.138 |

Table 264. Provided are the values of each of the parameters (as described above) measured in maize accessions (Line). Growth conditions are specified in the experimental procedure section.

TABLE 265

Measured parameters in Maize Inbred Field A 35K per acre (lines 65-72)

| Line/Correlation ID | Line-65 | Line-66 | Line-67 | Line-68 | Line-69 | Line-70 | Line-71 | Line-72 |
|---|---|---|---|---|---|---|---|---|
| 60 | NA | NA | NA | 80.3 | NA | 83.6 | 82.2 | NA |
| 5 | NA | 96.3 | 60.6 | 86.3 | NA | 100 | 100 | 82.4 |
| 6 | 14.4 | 23.8 | 14.6 | 15.6 | 21.2 | 24 | 19.3 | 14.5 |
| 31 | 5.34 | 2.12 | 5.36 | 3.23 | 4.97 | 4.38 | 5.03 | 3.57 |
| 32 | 277.6 | 78.3 | 198.3 | 168.1 | 193.9 | 220.1 | 206.8 | 152.8 |
| 9 | 282.9 | 57.6 | 191.6 | 149.8 | 178.1 | 184.9 | 185.7 | 134.1 |
| 18 | 0.618 | 0.217 | 0.455 | 0.377 | 0.42 | 0.521 | 0.434 | 0.378 |
| 47 | 11.25 | 10.5 | 14 | 3 | 11.75 | 7.75 | 4 | 5.5 |
| 50 | 71.8 | 143.5 | 79.9 | 112.3 | 82.1 | 87.8 | 66.6 | 125.4 |
| 51 | 13.1 | 17.4 | 10.8 | 23.2 | 21.1 | 17.8 | 15.2 | 18.5 |
| 55 | 0.92 | NA | 1.36 | 0.83 | 0.66 | 0.74 | NA | 1.68 |
| 57 | 28.7 | NA | 31.8 | 32.3 | 38.5 | 29 | NA | 27.8 |
| 1 | 3.74 | NA | 3.19 | 5.21 | 6.92 | 6.78 | NA | 3.66 |
| 2 | 0.286 | 0.512 | 0.534 | 0.353 | 0.327 | 0.517 | 0.335 | 0.499 |
| 56 | 13.5 | 15 | 12.6 | 13.3 | 12.8 | 12.9 | 11.9 | 11 |
| 10 | 42.4 | NA | NA | 24.8 | 34.5 | 38 | NA | 35.5 |
| 11 | 445.4 | NA | NA | 355.4 | 459.6 | 797 | NA | 625.5 |
| 19 | 245.5 | 514.7 | 244.9 | 353.4 | 267.7 | 229.1 | 248.7 | 476.9 |
| 20 | 35.7 | 42.1 | 33.2 | 35.9 | 26.7 | 34.8 | 35.9 | 34.2 |
| 26 | 17.1 | 16.2 | 14.9 | 14.7 | 12.4 | 12.9 | 14 | 14.6 |
| 33 | 2.66 | 3.27 | 2.85 | 3.11 | 2.73 | 3.43 | 3.21 | 2.98 |
| 38 | 55.2 | 69.2 | 55.8 | 58 | 46.7 | 53.1 | 50.5 | 61.8 |
| 39 | 11.14 | NA | 10.12 | 7.51 | 5.88 | 9.09 | NA | 13.86 |
| 42 | 53.4 | 61.9 | 48.5 | 55.8 | 44.8 | 48 | 46 | 60.8 |
| 43 | 11.14 | NA | 10.12 | 7.51 | 5.88 | 9.08 | NA | 13.85 |
| 54 | 4.23 | 4.74 | 4.24 | 4.41 | 4.28 | 4.98 | 4.34 | 4.86 |
| 58 | 1.29 | NA | 1.33 | 1.16 | 1.13 | 1.32 | NA | 1.86 |
| 45 | 2.74 | NA | 2.51 | 5.6 | 4.25 | 4.38 | NA | 4.54 |
| 48 | 16.5 | 18.4 | 16.7 | 16.7 | 13.9 | 13.5 | 14.8 | 16.1 |
| 52 | 10.6 | NA | 18.2 | 13.5 | 13.3 | 21 | NA | 17.7 |
| 53 | 5.18 | 4.96 | 5.29 | 7.33 | 4.43 | 7.88 | 4.33 | 6.43 |
| 59 | 1.09 | 1 | 1.5 | 1.06 | 1.48 | 1 | 1.12 | 1.69 |
| 61 | 53.5 | 39 | 43.2 | 52.8 | 44 | 51.5 | 42 | 49 |
| 3 | 57.6 | 85.4 | 74.5 | 86.3 | 68.2 | 48 | 53.7 | 94.8 |
| 7 | 23.4 | NA | 13.9 | 29.4 | 19.4 | 12.9 | NA | 27.4 |
| 12 | 0.346 | 0.099 | 0.165 | 0.269 | 0.174 | 0.114 | 0.167 | NA |

TABLE 265-continued

Measured parameters in Maize Inbred Field A 35K per acre (lines 65-72)

| Line/Correlation ID | Line-65 | Line-66 | Line-67 | Line-68 | Line-69 | Line-70 | Line-71 | Line-72 |
|---|---|---|---|---|---|---|---|---|
| 13 | 13.9317 | 15.0363 | 12.9732 | 13.5166 | 12.3814 | 14.2434 | 12.0391 | 13.1738 |
| 17 | 1.25 | 1 | 1 | 1 | 1 | 2 | 1 | 1 |
| 22 | 81.4 | 44.2 | 49 | 63.5 | 54.2 | 53.3 | 55.6 | 80 |
| 21 | 17.8 | 25.1 | 20.5 | 18.7 | 11.9 | 41.9 | 19 | 20.2 |
| 27 | 12.83 | 9.56 | 11.97 | 8.63 | 7.83 | 7.46 | 11.8 | 10.12 |
| 28 | 15.8 | 19.5 | 15.7 | 15.7 | 15.7 | 18.3 | 17.6 | 15.9 |
| 34 | 17.6 | 18.6 | 15 | 17.9 | 16.6 | 23.3 | 14.8 | 18.1 |
| 35 | 1.64 | NA | 1.5 | 1.31 | 1.41 | 1.91 | NA | 1.52 |
| 36 | 0.432 | NA | 0.392 | 0.48 | 0.511 | 0.43 | 0.464 | 0.482 |
| 40 | 75 | 77.5 | 76.2 | 79.5 | 74 | 80.5 | 69 | 75.5 |
| 41 | 139.8 | 127 | 133.5 | 135.2 | 129.8 | 139.8 | 116 | 130 |
| 44 | 86.2 | 88 | 90.2 | 82.5 | 85.8 | 88.2 | 74 | 81 |
| 46 | 167.7 | 206.8 | 170.6 | 173 | 151.8 | 187.3 | 139.7 | 164.7 |
| 49 | 1.57 | 1.54 | 1.43 | 1.53 | 1.34 | 1.54 | 1.58 | 1.5 |
| 4 | 41.2 | 50.6 | 46.5 | 41.3 | 41.2 | 49.5 | 45 | 49.2 |
| 8 | 40.3 | 38.8 | 48.7 | 43.8 | 42.4 | 51.8 | 48.2 | 49.2 |
| 14 | 76.4 | NA | 79 | 86.7 | 108.3 | 84.8 | NA | 128.4 |
| 24 | 3036.9 | NA | 2374 | 2943.4 | 2790.4 | 3155.1 | NA | 4360.5 |
| 23 | 0.0866 | 0.0581 | 0.0688 | 0.0787 | 0.0699 | 0.0674 | 0.0594 | 0.0907 |
| 29 | 0.129 | NA | 0.333 | 0.154 | 0.292 | 0.171 | NA | 0.225 |
| 30 | 0.232 | 0.11 | 0.122 | 0.159 | 0.138 | 0.081 | 0.174 | 0.123 |
| 37 | 1.56 | 1.19 | 1.35 | 1.19 | 1.35 | 1.05 | 1.39 | 1.87 |
| 15 | 78.6 | 31.8 | 35 | 56.9 | 53.4 | 50.6 | 55.4 | 56.2 |
| 16 | 1.43 | 0.722 | 0.72 | 1.081 | 0.895 | 0.866 | 0.975 | 1.128 |
| 25 | 0.186 | 0.184 | 0.215 | 0.172 | 0.163 | 0.298 | 0.165 | 0.197 |

Table 265. Provided are the values of each of the parameters (as described above) measured in maize accessions (Line). Growth conditions are specified in the experimental procedure section.

TABLE 266

Measured parameters in Maize Inbred Field A 35K per acre (lines 73-80)

| Line/Correlation ID | Line-73 | Line-74 | Line-75 | Line-76 | Line-77 | Line-78 | Line-79 | Line-80 |
|---|---|---|---|---|---|---|---|---|
| 60 | NA | NA | 85 | 88.8 | NA | 83.2 | 85.7 | 87.3 |
| 5 | 56.6 | NA | 100 | NA | 100 | NA | 100 | NA |
| 6 | 21.5 | 5.8 | 10 | 21.5 | 10.5 | 15.2 | 6.9 | 26.9 |
| 31 | 4.73 | 5.22 | 3.55 | 3.15 | 3.89 | 3.6 | 3.06 | 3.77 |
| 32 | 185.1 | 225.5 | 199.8 | 167.8 | 198.9 | 201.7 | 160.8 | 291.4 |
| 9 | 166.9 | 194.6 | 183.9 | 154.5 | 188 | 185.8 | 145.4 | 277.7 |
| 18 | 0.443 | 0.491 | 0.473 | 0.465 | 0.485 | 0.46 | 0.371 | 0.556 |
| 47 | 8.25 | 12.67 | 8.25 | 2.5 | 9 | 11.75 | 6 | 6.67 |
| 50 | 112.4 | 51.2 | 73.8 | 60.5 | 91.9 | 89.3 | 95.6 | 34.8 |
| 51 | 21.5 | 19.5 | 15.9 | 16.4 | 16 | 10 | 20.2 | 9.1 |
| 55 | 1.62 | NA | 1.03 | NA | NA | 0.38 | 1.47 | 2.23 |
| 57 | 32.8 | NA | 28.7 | NA | 26.6 | 30.5 | 26.5 | 29.5 |
| 1 | 3.81 | NA | 6.86 | NA | NA | 5.2 | 2.45 | 6.14 |
| 2 | 0.538 | 0.273 | 0.386 | 0.21 | 0.283 | 0.332 | 0.304 | 0.308 |
| 56 | 10 | 12.3 | 9 | 10.5 | 11.1 | 11.9 | 11.8 | 11 |
| 10 | 43 | NA | 31.9 | NA | NA | 22.5 | 40.4 | 32.7 |
| 11 | 677.4 | NA | 763.8 | NA | NA | 353.1 | 703.5 | 318.3 |
| 19 | 371.3 | 333.8 | 402.1 | 254.8 | 320.3 | 321.4 | 409 | 168.8 |
| 20 | 34.4 | 30.3 | 36.2 | 29.2 | 32.6 | 36.2 | 33.9 | 29.3 |
| 26 | 14.8 | 13.8 | 13.2 | 13.1 | 12.6 | 12.9 | 14.1 | 13.5 |
| 33 | 2.95 | 2.79 | 3.5 | 2.83 | 3.28 | 3.56 | 3.06 | 2.78 |
| 38 | 68.9 | 51.8 | 53.7 | 42.4 | 47 | 35.5 | 49.3 | 40.8 |
| 39 | 15.07 | 13.43 | 6.46 | NA | 22.81 | 5.44 | 10.09 | 14.84 |
| 42 | 64.2 | 49.4 | 51.1 | 40.2 | 43.9 | 33.1 | 47.5 | 38.4 |
| 43 | 15.07 | 13.39 | 6.46 | NA | 22.77 | 5.42 | 10.09 | 14.77 |
| 54 | 4.94 | 4.76 | 5.41 | 4.13 | 4.65 | 4.19 | 4.34 | 3.77 |
| 58 | 1.76 | 1.75 | 1.28 | NA | 2.29 | 1.11 | 1.41 | 1.61 |
| 45 | 5.31 | 4.9 | 4.05 | NA | 2.4 | 2.42 | 4.29 | 1.76 |
| 48 | 17.7 | 13.8 | 12.5 | 13 | 12.7 | 10.1 | 14.4 | 13.4 |
| 52 | 14.6 | NA | 23.8 | NA | NA | 15.5 | 17.4 | 9.8 |
| 53 | 5.33 | 2.77 | 4.07 | 3.71 | 5.59 | 4.72 | 6.03 | 2.55 |
| 59 | 1.04 | 1.17 | 1 | 1.06 | 1.04 | 1.12 | 1.25 | 1.14 |
| 61 | 39.5 | 49 | 52.8 | 53.5 | 51.7 | 68.5 | 53 | 78 |
| 3 | 89.7 | 39 | 61.7 | 51.9 | 80.4 | 72.2 | 77 | 31.2 |
| 7 | 25.9 | NA | 15.7 | NA | NA | 26.7 | 22.8 | 17.5 |
| 12 | 0.145 | 0.315 | 0.297 | 0.14 | 0.229 | 0.186 | NA | 0.135 |
| 13 | 12.4493 | 13.0235 | 13.0238 | 12.7792 | 12.4061 | 12.3927 | 14.1154 | NA |
| 17 | 1 | 1 | 1 | 1 | 1 | 1 | 1.25 | 1 |
| 22 | 72.7 | 83.9 | 85.1 | 45.8 | 64.3 | 67.6 | 69.9 | 50.8 |
| 21 | 19.4 | 14.3 | 26.6 | 14.2 | 12.7 | 15.2 | 15.3 | 11.3 |

TABLE 266-continued

Measured parameters in Maize Inbred Field A 35K per acre (lines 73-80)

| Line/Correlation ID | Line-73 | Line-74 | Line-75 | Line-76 | Line-77 | Line-78 | Line-79 | Line-80 |
|---|---|---|---|---|---|---|---|---|
| 27 | 8.62 | 13 | 11.29 | 8.69 | 9.21 | 8.34 | 12.18 | 7.94 |
| 28 | 17.2 | 18.6 | 18.6 | 15.2 | 19.5 | 20.4 | 18.5 | 15.9 |
| 34 | 16.5 | 16.8 | 22.4 | 16.8 | 18.7 | 22.2 | 18.2 | 22.7 |
| 35 | 1.32 | NA | 1.44 | NA | NA | 1.52 | 1.22 | 1.29 |
| 36 | 0.436 | 0.408 | 0.475 | NA | 0.411 | 0.426 | 0.447 | NA |
| 40 | 76 | 74.7 | 82.2 | 85.5 | 72 | 77.8 | 81.5 | 84.7 |
| 41 | 123.8 | 131 | 143.2 | 141.5 | 132.7 | 158 | 140.5 | 167.5 |
| 44 | 84.2 | 87.3 | 90.5 | 88 | 81 | 89.5 | 87.5 | 91.3 |
| 46 | 153.2 | 155.5 | 119 | 121.2 | 135.3 | 150.8 | 185 | 138.1 |
| 49 | 1.4 | 1.59 | 0.99 | 0.85 | 1.02 | 1.14 | 1.52 | 1.01 |
| 4 | 43 | 52.1 | 40.6 | NA | 30 | 35.6 | NA | NA |
| 8 | 41.5 | 47.6 | 40.7 | 31.6 | 33.5 | 29.6 | 41.7 | 33.6 |
| 14 | 55.7 | NA | 112.9 | NA | NA | 107.9 | 94.5 | 102.6 |
| 24 | 2530.4 | NA | 4824.6 | NA | 2573.4 | 3793.3 | 3043.5 | 3314.4 |
| 23 | 0.0851 | 0.093 | 0.0763 | 0.047 | 0.0644 | 0.0387 | 0.079 | 0.0346 |
| 29 | 0.404 | NA | 0.215 | NA | NA | 0.178 | 0.191 | 0.185 |
| 30 | 0.126 | 0.216 | 0.103 | 0.13 | 0.137 | 0.14 | 0.168 | NA |
| 37 | 1.86 | 1.9 | 1.5 | 0.87 | 1.3 | 1.21 | 1.34 | 0.66 |
| 15 | 66.2 | 81.2 | 56.5 | 37.2 | 63.7 | 51.8 | 66.9 | 35.4 |
| 16 | 1.122 | 1.698 | 1.155 | 0.773 | 1.103 | 0.824 | 1.136 | 0.57 |
| 25 | 0.192 | 0.171 | 0.21 | 0.169 | 0.119 | 0.118 | 0.146 | 0.14 |

Table 266. Provided are the values of each of the parameters (as described above) measured in maize accessions (Line). Growth conditions are specified in the experimental procedure section.

TABLE 267

Measured parameters in Maize Inbred Field A 35K per acre (lines 81-88)

| Line/Correlation ID | Line-81 | Line-82 | Line-83 | Line-84 | Line-85 | Line-86 | Line-87 | Line-88 |
|---|---|---|---|---|---|---|---|---|
| 60 | 90.7 | 84 | NA | 80.6 | NA | 84.8 | 87.1 | 84.6 |
| 5 | 35.4 | NA | 80.6 | NA | NA | NA | NA | NA |
| 6 | 16.9 | 9.1 | 8.5 | 15.3 | 6.1 | 10.9 | 3.9 | NA |
| 31 | 3.27 | 2.97 | 3.61 | 3.65 | 4.59 | 3.81 | 3.33 | 2.97 |
| 32 | 168.5 | 226 | 189.1 | 212.1 | 247.5 | 215.7 | 270.2 | 243.5 |
| 9 | 149 | 210.1 | 178.4 | 197.2 | 225 | 196.3 | 250.4 | 224.4 |
| 18 | 0.395 | 0.411 | 0.447 | 0.447 | 0.455 | 0.479 | 0.498 | 0.46 |
| 47 | 4.93 | 9.67 | 4.67 | 3.67 | 8 | 8.33 | 3.75 | 6.5 |
| 50 | 65.4 | 26.3 | 71 | 62.2 | 89.3 | 102.3 | 41.7 | 64.8 |
| 51 | 16.9 | 9.1 | 21.3 | 18.7 | 16.9 | 21.4 | 16.2 | NA |
| 55 | 1.81 | NA | 1.47 | 3.29 | 1.06 | NA | 1.7 | 1.95 |
| 57 | 28 | NA | 26.9 | 27.4 | 30.2 | NA | 29.6 | 32.3 |
| 1 | 1.82 | NA | 2.82 | 0.98 | 5.33 | NA | 5.33 | 5.68 |
| 2 | 0.288 | 0.327 | 0.421 | 0.232 | 0.41 | 0.501 | 0.439 | 0.298 |
| 56 | 12 | 10.3 | 13.1 | 13.3 | 11.6 | 12.6 | 12.8 | 10.9 |
| 10 | 39.2 | NA | NA | 38.5 | 35.7 | NA | 34.8 | 21.8 |
| 11 | 821.5 | NA | NA | 655.9 | 537.7 | NA | 372 | 246.4 |
| 19 | 355.9 | 172.2 | 408.6 | 311.1 | 307.1 | 365.9 | 135.9 | 236.9 |
| 20 | 32.9 | 26.6 | 39.8 | 31.6 | 37 | 36.2 | 31.9 | 27.4 |
| 26 | 12.5 | 12.3 | 14.7 | 12.3 | 15.7 | 13.7 | 14.9 | 12.4 |
| 33 | 3.33 | 2.76 | 3.45 | 3.26 | 3 | 3.36 | 2.72 | 2.81 |
| 38 | 46 | 31.1 | 59.7 | 47.9 | 57 | 59.1 | 47.7 | 43.5 |
| 39 | 13.08 | NA | 8.04 | 20.48 | 9.33 | NA | 11.8 | 4.64 |
| 42 | 42.8 | 24.1 | 53.2 | 46.2 | 54.8 | 57.5 | 47.1 | 43 |
| 43 | 13.08 | NA | 8.03 | 20.23 | 9.32 | NA | 11.79 | 4.64 |
| 54 | 4.56 | 3.5 | 4.95 | 4.7 | 4.43 | 4.86 | 3.92 | 4.15 |
| 58 | 1.85 | NA | 1.38 | 2.17 | 1.35 | NA | 1.51 | 0.92 |
| 45 | 4.29 | NA | 5.4 | 4.1 | 3.62 | NA | 4.03 | NA |
| 48 | 12.7 | 11.1 | 15.3 | 12.9 | 16.3 | 15.4 | 15.5 | 13.3 |
| 52 | 19.9 | NA | 17.3 | 17 | 15 | NA | 10.7 | 11.2 |
| 53 | 4.65 | 1.58 | 4.71 | 3.99 | 6.05 | 9.16 | 2.5 | 3.42 |
| 59 | 1.2 | 1.04 | 1.21 | 1 | 1.25 | 1 | 1.66 | 1.38 |
| 61 | 54.2 | 76.3 | 54.3 | 58 | 55.8 | 58.7 | 81.2 | 82 |
| 3 | 54.9 | 22.3 | 62.7 | 52.4 | 73.2 | 83.1 | 34.7 | 54.7 |
| 7 | 19.3 | NA | 23.8 | 18.4 | 20.4 | NA | 12.9 | 21.2 |
| 12 | 0.324 | 0.144 | 0.271 | 0.301 | 0.203 | 0.163 | NA | 0.174 |
| 13 | 13.2978 | NA | 13.4241 | 14.1606 | 12.7096 | 13.5493 | 14.1042 | 12.2705 |
| 17 | 1 | 1 | 1 | 1 | 1 | 1 | 1.25 | 1 |
| 22 | 61 | 41.4 | 80.3 | 69.3 | 78.9 | 83.4 | 38.3 | 60.4 |
| 21 | 15.5 | 14.8 | 19.8 | 14.9 | 21.4 | 49.7 | 21 | 11.1 |
| 27 | 12.12 | 9.23 | 13.17 | 12.42 | 8.58 | 11.08 | 9.66 | NA |
| 28 | 15.3 | 18.7 | 18 | 15.8 | 17.9 | 17 | 15.7 | NA |
| 34 | 18.3 | 13.1 | 17.5 | 19.6 | 20.9 | 28.1 | 26.5 | 22.6 |
| 35 | 1.35 | NA | 1.39 | 1.37 | 1.28 | NA | 1.33 | 1.8 |

TABLE 267-continued

Measured parameters in Maize Inbred Field A 35K per acre (lines 81-88)

| Line/Correlation ID | Line-81 | Line-82 | Line-83 | Line-84 | Line-85 | Line-86 | Line-87 | Line-88 |
|---|---|---|---|---|---|---|---|---|
| 36 | 0.403 | 0.41 | 0.446 | 0.4 | 0.483 | 0.452 | 0.419 | 0.381 |
| 40 | 78.5 | 80.3 | 77 | 78 | 75 | 83 | 84.2 | 79 |
| 41 | 137.9 | 166.3 | 136 | 139.7 | 138.8 | 150 | 169.2 | 167.5 |
| 44 | 83.4 | 90 | 81.7 | 81.7 | 83 | 91.3 | 88 | 85.5 |
| 46 | 162.8 | 161.6 | 189.8 | 171.4 | 165 | 172.9 | 188.6 | 157.4 |
| 49 | 1.37 | 1.13 | 1.54 | 1.36 | 1.51 | 1.23 | 1.16 | 1.17 |
| 4 | 48.8 | NA | 50 | 47.8 | 33.5 | NA | NA | NA |
| 8 | 44.6 | 33.6 | 51.9 | 39.7 | 34.6 | 43.4 | 43.8 | 33.9 |
| 14 | 76.3 | NA | 111.4 | 121.1 | 83.6 | NA | 111.4 | 114.2 |
| 24 | 2973.6 | NA | 3132.9 | 3106.8 | 3246.3 | NA | 4286.9 | 3380.3 |
| 23 | 0.0704 | 0.0355 | 0.098 | 0.0821 | 0.0878 | 0.097 | 0.0789 | 0.0774 |
| 29 | 0.259 | NA | 0.252 | 0.148 | 0.207 | NA | 0.167 | 0.185 |
| 30 | 0.168 | NA | 0.135 | 0.146 | 0.212 | 0.14 | 0.128 | 0.158 |
| 37 | 1.14 | 0.54 | 1.54 | 1.2 | 1.49 | 1.46 | 0.47 | 0.74 |
| 15 | 66.3 | 24 | 93.3 | 87.5 | 85.4 | 89 | 62.5 | 57.8 |
| 16 | 1.126 | 0.489 | 1.45 | 1.441 | 1.349 | 1.415 | 1.185 | 1.376 |
| 25 | 0.141 | 0.202 | 0.144 | 0.146 | 0.193 | 0.172 | 0.243 | 0.144 |

Table 267. Provided are the values of each of the parameters (as described above) measured in maize accessions (Line). Growth conditions are specified in the experimental procedure section.

TABLE 268

Measured parameters in Maize Inbred Field A 35K per acre (lines 89-96)

| Line/Correlation ID | Line-89 | Line-90 | Line-91 | Line-92 | Line-93 | Line-94 | Line-95 | Line-96 |
|---|---|---|---|---|---|---|---|---|
| 60 | 82.6 | 97.4 | 67.1 | 76.4 | NA | 29.5 | NA | NA |
| 5 | 100 | NA | 98.3 | 77.3 | 80.8 | NA | 76.7 | 75.2 |
| 6 | 14.3 | 10 | 25.1 | 7.1 | 16.9 | NA | 5.2 | 15.9 |
| 31 | 3.54 | 4.31 | 5.06 | 6.14 | 9.33 | NA | 8.11 | 5.17 |
| 32 | 185.4 | 290.7 | 154.4 | 196.7 | 232.2 | 123.9 | 240.3 | 213.5 |
| 9 | 173 | 276.2 | 142.2 | 174.5 | 207.7 | 118 | 208.6 | 202.7 |
| 18 | 0.444 | 0.586 | 0.366 | 0.439 | 0.543 | 0.382 | 0.536 | 0.562 |
| 47 | 7.25 | 2 | 20 | 25.67 | 19 | 5.5 | 18.33 | 7.67 |
| 50 | 66.8 | 51.8 | 92.6 | 133.9 | 107.6 | 94.2 | 151 | 90.4 |
| 51 | 7.2 | 29 | 25.2 | 15.2 | 30.1 | NA | 27.7 | 13 |
| 55 | 0.37 | 4.71 | 1.24 | 1.72 | NA | 4.43 | NA | 1.13 |
| 57 | 31.7 | 30.5 | 35.2 | 21.3 | NA | 11.9 | 25.3 | 30.8 |
| 1 | 4.74 | 4.04 | 9.33 | 5.8 | NA | 7.52 | NA | 3.69 |
| 2 | 0.224 | 0.401 | 0.256 | 0.501 | 0.339 | NA | 0.629 | 0.501 |
| 56 | 11.8 | 12.3 | 14.7 | 13.9 | 12.3 | NA | 14.3 | 11.3 |
| 10 | 23.8 | 45 | 45.8 | 32.8 | NA | 41.6 | NA | 43.9 |
| 11 | 349.8 | 528.8 | 571.9 | 480.2 | NA | 666 | NA | 622.3 |
| 19 | 243.3 | 204.5 | 442.2 | 493 | 336.2 | 362.1 | 525.4 | 345.7 |
| 20 | 30.8 | 26 | 34.2 | 46 | 31.6 | 25.5 | 45.2 | 32.2 |
| 26 | 13.2 | 12.3 | 15.6 | 18.3 | 13.5 | 11.3 | 17.7 | 13.2 |
| 33 | 2.96 | 2.69 | 2.76 | 3.2 | 2.95 | 2.86 | 3.24 | 3.09 |
| 38 | 44.2 | 45.1 | 58.7 | 81 | 54.7 | 42.6 | 78.2 | 58.5 |
| 39 | 4.57 | 19.88 | 10.83 | 6.63 | NA | 8.7 | 22.79 | 6.7 |
| 42 | 41.5 | 43.4 | 54.5 | 79.8 | 53.7 | 42.6 | 76.9 | 56.1 |
| 43 | 4.57 | 19.88 | 10.83 | 6.63 | NA | 8.69 | 22.79 | 6.7 |
| 54 | 4.1 | 4.21 | 3.9 | 4.96 | 4.76 | 3.86 | 5.25 | 4.89 |
| 58 | 1.02 | 2.11 | 1.23 | 1.14 | NA | 1.37 | 2.24 | 1.2 |
| 45 | 1.83 | 8.84 | 5.21 | 3.03 | NA | NA | 6.66 | 2.45 |
| 48 | 13.6 | 13.6 | 18.9 | 20.8 | 14.6 | 14 | 18.8 | 15.2 |
| 52 | 14.7 | 11.8 | 12.5 | 14.7 | NA | 16 | NA | 14.2 |
| 53 | 4 | 3.32 | 4.92 | 7.58 | 5.87 | 4.24 | 7.14 | 4.9 |
| 59 | 1.09 | 1.94 | 1.08 | 1.29 | 1.17 | NA | 1.5 | 1.46 |
| 61 | 53 | 67.5 | 31 | 30 | 27 | NA | 36 | 41.3 |
| 3 | 56.5 | 45.2 | 74.3 | 99.6 | 83.9 | 85.2 | 108.4 | 81 |
| 7 | 15.5 | 17.4 | 24.6 | 34 | NA | 22.6 | NA | 24.4 |
| 12 | 0.195 | NA | 0.323 | NA | NA | NA | NA | 0.251 |
| 13 | 13.2001 | 13.8804 | 12.5828 | 13.1474 | 12.729 | NA | 12.4465 | 12.9323 |
| 17 | 1.25 | 1.5 | 1 | 1 | 1 | NA | 1 | 1 |
| 22 | 44.5 | 60.9 | 69.7 | 104.6 | 82.3 | 46.1 | 141.6 | 75.7 |
| 21 | 12.4 | 13.2 | 1.8 | 19 | 14.4 | 9 | 51.7 | 16.2 |
| 27 | 7.83 | 9.12 | 11.12 | 9.28 | 10.21 | NA | 10.82 | 10 |
| 28 | 18.1 | 16.1 | 17.9 | 18 | 15.4 | NA | 16.9 | 17.9 |
| 34 | 17.2 | 25.1 | 13.2 | 16.2 | 15.1 | 8.4 | 18.5 | 14.7 |
| 35 | 1.33 | 1.36 | 1.55 | 1.88 | NA | 1.58 | NA | 1.99 |
| 36 | 0.469 | NA | 0.511 | 0.339 | 0.349 | NA | 0.348 | 0.409 |
| 40 | 79.5 | 91 | 68 | 67.3 | 74 | 61.5 | 74.7 | 74 |
| 41 | 139.8 | 160.5 | 119 | 123 | 120 | NA | 129 | 123 |
| 44 | 86.8 | 93 | 88 | 93 | 93 | 67 | 93 | 81.7 |

TABLE 268-continued

Measured parameters in Maize Inbred Field A 35K per acre (lines 89-96)

| Line/Correlation ID | Line-89 | Line-90 | Line-91 | Line-92 | Line-93 | Line-94 | Line-95 | Line-96 |
|---|---|---|---|---|---|---|---|---|
| 46 | 166 | 187.6 | 153.6 | 155.2 | 135.1 | NA | 150.5 | 163.2 |
| 49 | 1.17 | 0.99 | 1.69 | 1.44 | 0.96 | 1.59 | 1.55 | 1.41 |
| 4 | 38 | NA | 48.5 | 41.2 | 43.5 | NA | 40.1 | 37 |
| 8 | 33.2 | 45.8 | 34.6 | 40.1 | 44.5 | NA | 36.5 | 29.1 |
| 14 | 54.5 | 100.9 | 142.7 | 177.6 | NA | 111.4 | NA | 103.5 |
| 24 | 3241.7 | 4886 | 3167 | 4655.7 | NA | 1836.3 | 1911.3 | 3050.1 |
| 23 | 0.0543 | 0.1053 | 0.0533 | 0.1242 | 0.0921 | NA | 0.1404 | 0.0791 |
| 29 | 0.165 | 0.168 | 0.15 | 0.258 | NA | NA | NA | 0.114 |
| 30 | 0.174 | 0.146 | 0.165 | 0.189 | 0.175 | NA | 0.177 | 0.116 |
| 37 | 0.84 | 0.9 | 2.23 | 3.37 | 3.4 | NA | 4.9 | 1.83 |
| 15 | 62.6 | 69.8 | 35.9 | 84 | 68.2 | 6.1 | 75.9 | 46.6 |
| 16 | 1.009 | 1.268 | 0.736 | 1.621 | 1.152 | 0.111 | 1.28 | 0.972 |
| 25 | 0.136 | 0.191 | 0.242 | 0.129 | 0.159 | 0.124 | 0.151 | 0.164 |

Table 268. Provided are the values of each of the parameters (as described above) measured in maize accessions (Line). Growth conditions are specified in the experimental procedure section.

TABLE 269

Measured parameters in Maize Inbred Field A 35K per acre (lines 97-104)

| Line/Correlation ID | Line-97 | Line-98 | Line-99 | Line-100 | Line-101 | Line-102 | Line-103 | Line-104 |
|---|---|---|---|---|---|---|---|---|
| 60 | 86.8 | NA | 77.6 | 82.5 | 81 | 80.5 | 76.8 | NA |
| 5 | NA | NA | 100 | 68.4 | NA | NA | 87.2 | NA |
| 6 | 15.6 | 16.4 | 19.7 | 19.1 | 7.7 | 26.6 | 19.3 | 18.6 |
| 31 | 3.29 | 3.91 | 4.61 | 6.35 | 4.94 | 4.41 | 3.88 | 4.66 |
| 32 | 179.9 | 225.8 | 128.6 | 298.8 | 249.1 | 228.7 | 145.3 | 268.8 |
| 9 | 166 | 213.9 | 112.3 | 290.5 | 231.6 | 220.2 | 140.6 | 248.1 |
| 18 | 0.418 | 0.464 | 0.295 | 0.544 | 0.479 | 0.535 | 0.365 | 0.549 |
| 47 | 5.67 | 9.33 | 17.5 | 16.25 | 11.67 | 4 | 10 | 6.75 |
| 50 | 57.7 | 91.3 | 116.1 | 36.3 | 52.9 | 76.3 | 89 | 81.9 |
| 51 | 14.8 | 15.6 | 19.2 | 13.4 | 10.3 | 21.7 | 10.7 | 15.7 |
| 55 | 0.42 | 1.38 | 2.07 | NA | 0.72 | 2.1 | NA | 3.09 |
| 57 | 33.2 | 36.7 | 31.2 | NA | 31.6 | 28.9 | NA | 29.3 |
| 1 | 4.92 | 7.11 | 4.65 | NA | 8.34 | 1.44 | NA | 5.55 |
| 2 | 0.259 | 0.25 | 0.219 | 0.347 | 0.232 | 0.203 | 0.3 | 0.426 |
| 56 | 11.6 | 15 | 13.7 | 13.3 | 10 | NA | 11.3 | 13.2 |
| 10 | 29.8 | 34.5 | NA | NA | 36.2 | 42.3 | NA | 40.3 |
| 11 | 497.2 | 551.8 | NA | NA | 468.3 | 613.6 | NA | 564.4 |
| 19 | 264.6 | 356.4 | 344.7 | 107.5 | 219.5 | 272.9 | 300.8 | 299.7 |
| 20 | 35.5 | 44.4 | 25.9 | 28.7 | 27 | 29.4 | 30.5 | 32.4 |
| 26 | 13.6 | 17.7 | 13.4 | 13 | 13.4 | 11.3 | 14 | 14 |
| 33 | 3.33 | 3.17 | 2.45 | 2.82 | 2.56 | 3.29 | 2.78 | 2.83 |
| 38 | 43.5 | 50.8 | 46.2 | 37.8 | 42.9 | 45.9 | 49.5 | 58.1 |
| 39 | 5.84 | 12.7 | 12.37 | NA | 7.73 | 12.55 | NA | 18.61 |
| 42 | 41.2 | 47.1 | 46.1 | 30.3 | 40 | 43.7 | 46.7 | 56.1 |
| 43 | 5.84 | 12.67 | 12.36 | NA | 7.72 | 12.55 | NA | 18.54 |
| 54 | 4.25 | 4.18 | 3.92 | 3.53 | 3.9 | 4.8 | 3.98 | 4.66 |
| 58 | 1.18 | 1.51 | 1.55 | NA | 1.05 | 1.71 | NA | 1.89 |
| 45 | 3.83 | 3.18 | 4.53 | NA | 2.43 | 5.59 | NA | 3.36 |
| 48 | 12.6 | 15.2 | 14.9 | 13.5 | 13.9 | 12.1 | 15.6 | 15.7 |
| 52 | 16.8 | 16 | 16.5 | NA | 12.9 | 14.5 | NA | 14.5 |
| 53 | 3.62 | 6.27 | 6.59 | 2.85 | 3.85 | 6.37 | 5 | 4.97 |
| 59 | 1.38 | 1 | 1.19 | 1.06 | 1.04 | 1.04 | 1.25 | 1.12 |
| 61 | 55 | 55.7 | 29 | 43.5 | 50.7 | 55.3 | 38 | 57.8 |
| 3 | 48.2 | 81.7 | 89.1 | 34.5 | 45.5 | 70.6 | 81.5 | 69.7 |
| 7 | 16.1 | 17.2 | 22.1 | NA | 17.1 | 19 | NA | 23.6 |
| 12 | 0.159 | 0.301 | 0.205 | 0.088 | 0.246 | 0.3 | 0.213 | 0.176 |
| 13 | 13.7464 | 14.0444 | 13.6673 | 12.9128 | 14.5337 | 12.1276 | 13.0667 | 13.0934 |
| 17 | 1 | 1 | 1 | 1 | 1 | 1.33 | 1.25 | 1.25 |
| 22 | 45.4 | 80.7 | 47 | 29.4 | 56.8 | 64 | 44.4 | 83.9 |
| 21 | 42.9 | 20.2 | 11.7 | 11.2 | 8.8 | 19.7 | 12.2 | 24.5 |
| 27 | 10.71 | 9.92 | 10.15 | 12.71 | 6.96 | 12.75 | 12.12 | 12.29 |
| 28 | 17.3 | 16.7 | 15 | 16.5 | 18.4 | 18.2 | 15.7 | 16.5 |
| 34 | 15.3 | 18.2 | 13.2 | 11.9 | 17 | 22.1 | 15 | 19.8 |
| 35 | 1.23 | 1.47 | 1.25 | NA | 1.37 | 1.09 | NA | 1.36 |
| 36 | 0.416 | 0.353 | 0.442 | 0.464 | 0.307 | 0.489 | 0.349 | 0.472 |
| 40 | 79 | 77 | 72.5 | 72 | 79.7 | 79 | 78.2 | 76.2 |
| 41 | 139.7 | 142 | 119 | 131.8 | 142 | 138.3 | 126.2 | 140.8 |
| 44 | 84.7 | 86.3 | 90 | 88.2 | 91.3 | 83 | 88.2 | 83 |
| 46 | 169.3 | 168.5 | 159.4 | 168.1 | 123.3 | NA | 154.4 | 201 |
| 49 | 1.63 | 1.32 | 1.52 | 1.39 | 1.34 | 1.37 | 1.07 | 1.93 |
| 4 | 37 | 40.3 | 47.2 | 47.6 | 43.5 | 46.3 | 42 | 45.2 |
| 8 | 29.9 | 39.6 | 42 | 45.2 | 37.2 | 45.3 | 40.7 | 38 |

TABLE 269-continued

Measured parameters in Maize Inbred Field A 35K per acre (lines 97-104)

| Line/Correlation ID | Line-97 | Line-98 | Line-99 | Line-100 | Line-101 | Line-102 | Line-103 | Line-104 |
|---|---|---|---|---|---|---|---|---|
| 14 | 70.5 | 107.1 | 120.5 | NA | 106.5 | 118.8 | NA | 89 |
| 24 | 4002.8 | 3384.9 | 2610.4 | NA | 3411.6 | 3205.5 | NA | 3312 |
| 23 | 0.0675 | 0.0549 | 0.0556 | 0.0327 | 0.0601 | 0.0674 | 0.0497 | 0.1129 |
| 29 | 0.176 | 0.149 | 0.195 | NA | 0.14 | 0.175 | NA | 0.211 |
| 30 | 0.149 | 0.134 | 0.18 | 0.107 | 0.147 | 0.168 | 0.135 | 0.17 |
| 37 | 0.82 | 1.41 | 1.71 | 0.65 | 1.13 | 1.25 | 1.2 | 1.46 |
| 15 | 32.1 | 74.5 | 28.2 | 22 | 43.8 | 71.3 | 45.9 | 72.7 |
| 16 | 0.514 | 1.364 | 0.501 | 0.36 | 0.854 | 1.16 | 0.784 | 1.182 |
| 25 | 0.364 | 0.145 | 0.183 | 0.133 | 0.123 | 0.207 | 0.146 | 0.324 |

Table 269. Provided are the values of each of the parameters (as described above) measured in maize accessions (Line). Growth conditions are specified in the experimental procedure section.

TABLE 270

Measured parameters in Maize Inbred Field A 35K per acre (lines 105-112)

| Line/Correlation ID | Line-105 | Line-106 | Line-107 | Line-108 | Line-109 | Line-110 | Line-111 | Line-112 |
|---|---|---|---|---|---|---|---|---|
| 60 | 76.2 | NA | 74.3 | 80.2 | 82.7 | NA | NA | NA |
| 5 | NA | 53.6 | 99.5 | 63 | NA | NA | NA | NA |
| 6 | 11.7 | 12.2 | 3.1 | 22.5 | 6.8 | 5.1 | 15.5 | 11.8 |
| 31 | 2.93 | 5.64 | 4.95 | 3.45 | 4.67 | 3.36 | 3.8 | NA |
| 32 | 156 | 242.6 | 202.6 | 135.1 | 251.7 | 263.8 | 226.3 | NA |
| 9 | 153.7 | 228.8 | 185.9 | 120 | 245.9 | 236.6 | 216.5 | NA |
| 18 | 0.314 | 0.517 | 0.54 | 0.262 | 0.521 | 0.53 | 0.427 | NA |
| 47 | 11.25 | 7 | 11 | 8.5 | 9.67 | 9.33 | 14 | 10.5 |
| 50 | 70.3 | 93.7 | 135.5 | 77.3 | 45.9 | 60.4 | 41.5 | NA |
| 51 | 12.9 | 15.5 | 21.7 | 12.2 | 6.4 | 14 | 13 | 9.5 |
| 55 | 1.6 | NA | NA | NA | 0.58 | 0.65 | 2.19 | 0.44 |
| 57 | 29.9 | NA | NA | NA | 29.8 | 29.6 | 22.4 | 29.9 |
| 1 | 11.91 | NA | NA | NA | 6.68 | 3.26 | 5.05 | 3.66 |
| 2 | 0.226 | 0.533 | 0.411 | 0.461 | 0.315 | 0.353 | 0.2 | 0.28 |
| 56 | 11.7 | 12.2 | 12.8 | 12.8 | 12 | 14.4 | 12.8 | 12.4 |
| 10 | 39.2 | NA | NA | NA | 36.6 | NA | NA | 28.4 |
| 11 | 548 | NA | NA | NA | 390.6 | NA | NA | 401.8 |
| 19 | 250.4 | 327.9 | 516.8 | 278.2 | 193.6 | 233.9 | 144.3 | NA |
| 20 | 34.4 | 35.1 | 40 | 27.9 | 20.6 | 32.1 | 31.1 | 35.3 |
| 26 | 17.8 | 15.3 | 15.6 | 13.4 | 11.1 | 14.6 | 14.1 | 15.4 |
| 33 | 2.46 | 2.91 | 3.25 | 2.65 | 2.35 | 2.79 | 2.75 | 2.92 |
| 38 | 49.3 | 62 | 72.7 | 39.7 | 44.9 | 53.2 | 43.1 | 38.5 |
| 39 | 11.21 | NA | NA | NA | 5.78 | 9.66 | NA | 4.97 |
| 42 | 46.7 | 60.3 | 67.4 | 39.1 | 44.1 | 45.4 | 39.1 | 32.9 |
| 43 | 11.2 | NA | NA | NA | 5.77 | 9.65 | NA | 4.97 |
| 54 | 3.41 | 4.56 | 5.29 | 3.53 | 4.02 | 4.37 | 3.69 | 3.81 |
| 58 | 1.32 | NA | NA | NA | 0.89 | 1.32 | NA | 1.01 |
| 45 | 3.19 | NA | NA | NA | 1.65 | 3.56 | 3.33 | 2.6 |
| 48 | 18.4 | 17.3 | 17.5 | 14.1 | 14.1 | 15.5 | 14.8 | 12.7 |
| 52 | 14 | NA | NA | NA | 10.8 | 11.2 | 16.2 | 14.2 |
| 53 | 6.1 | 6.02 | 8.05 | 5.77 | 2.97 | 3.27 | 2.44 | NA |
| 59 | 1.41 | 1.25 | 1.44 | 1.34 | 1 | 1 | 1 | 1 |
| 61 | 54 | 43.3 | 44.5 | 42.8 | 52.3 | 81.7 | 51.5 | 55 |
| 3 | 63.6 | 83.2 | 111.5 | 60.9 | 43.9 | 47.9 | 36.7 | NA |
| 7 | 17.3 | NA | NA | NA | 16.8 | 21.8 | 8.1 | NA |
| 12 | 0.286 | NA | NA | NA | 0.161 | 0.202 | 0.205 | 0.078 |
| 13 | 12.296 | 12.953 | 11.9592 | 12.3858 | 14.6698 | 13.0298 | 13.8831 | 13.8157 |
| 17 | 2 | 1 | 1 | 1.25 | 1 | 1 | 1 | 1 |
| 22 | 40.7 | 82.2 | 109.6 | 39.6 | 49.3 | 66.3 | 31.7 | 25.2 |
| 21 | 19.7 | 15.3 | 21.9 | 14.5 | 8.8 | 19.4 | 15 | 12.1 |
| 27 | 12.31 | 13.42 | 11.38 | 9.9 | 8.75 | 10.62 | 11.29 | 8.83 |
| 28 | 13.9 | 15.7 | 17.4 | 13.5 | 14.9 | 16 | 17.6 | 17.1 |
| 34 | 15.6 | 17.8 | 15.6 | 12.8 | 18.1 | 21.4 | 15.6 | 15.9 |
| 35 | 1.85 | NA | NA | NA | 1.7 | 1.6 | 1.24 | 1.56 |
| 36 | 0.459 | 0.428 | 0.322 | 0.427 | 0.499 | 0.322 | NA | 0.353 |
| 40 | 79 | 74 | 68 | 79.5 | 80.3 | 75.3 | 76.3 | 77.5 |
| 41 | 144.2 | 124.3 | 123.5 | 130.8 | 142.3 | 166.3 | 139.5 | 143 |
| 44 | 90.2 | 81 | 79 | 88 | 90 | 84.7 | 90.3 | 88 |
| 46 | 139.9 | 164.8 | 167 | 182 | 182.4 | 164.3 | 142.9 | 147.9 |
| 49 | 1.1 | 1.3 | 1.73 | 1.43 | 1.37 | 1.22 | 0.96 | 1.19 |
| 4 | 36.4 | 43.1 | 44.1 | 36.7 | 33.5 | 42.8 | 43 | 47.5 |
| 8 | 33 | 40.1 | 46.8 | 33.5 | 33.5 | 34 | 42 | 44.8 |
| 14 | 97.7 | NA | NA | NA | 103.1 | 63.1 | 76.5 | 139.8 |
| 24 | 3129.2 | NA | NA | NA | 3218.6 | 2656 | 2174.1 | 4366.5 |
| 23 | 0.0583 | 0.0966 | 0.1218 | 0.0473 | 0.0573 | 0.0777 | 0.0437 | 0.0327 |

TABLE 270-continued

Measured parameters in Maize Inbred Field A 35K per acre (lines 105-112)

| Line/Correlation ID | Line-105 | Line-106 | Line-107 | Line-108 | Line-109 | Line-110 | Line-111 | Line-112 |
|---|---|---|---|---|---|---|---|---|
| 29 | 0.115 | NA | NA | NA | 0.143 | 0.232 | 0.16 | 0.184 |
| 30 | 0.112 | 0.156 | 0.202 | 0.156 | 0.129 | 0.105 | 0.139 | 0.107 |
| 37 | 0.77 | 1.91 | 2.7 | 1.06 | 0.92 | 0.84 | 0.68 | NA |
| 15 | 29.2 | 66.5 | 69.8 | 28.3 | 35.7 | 80.2 | 32.1 | 33.2 |
| 16 | 0.548 | 1.064 | 1.543 | 0.44 | 0.542 | 1.495 | 0.574 | 0.586 |
| 25 | 0.226 | 0.149 | 0.198 | 0.201 | 0.181 | 0.218 | 0.172 | 0.117 |

Table 270. Provided are the values of each of the parameters (as described above) measured in maize accessions (Line). Growth conditions are specified in the experimental procedure section.

TABLE 271

Measured parameters in Maize Inbred Field A 35K per acre (lines 113-117)

| Correlation ID | Line-113 | Line-114 | Line-115 | Line-116 | Line-117 |
|---|---|---|---|---|---|
| 60 | 85.1 | 86.2 | NA | 70.6 | NA |
| 5 | NA | 92.4 | NA | 100 | 83.6 |
| 6 | NA | 3.2 | 2.8 | NA | 23.1 |
| 31 | 4.58 | 4.86 | 4.27 | 3.62 | 4.83 |
| 32 | 261 | 237.6 | 273.3 | 175.9 | 202.2 |
| 9 | 243.3 | 219.3 | 245.4 | 160.1 | 189 |
| 18 | 0.526 | 0.493 | 0.54 | 0.394 | 0.437 |
| 47 | 6.5 | 3 | 9.67 | 4.33 | 9 |
| 50 | 105.2 | 67.7 | 58.9 | 116.8 | 84.9 |
| 51 | NA | 19.7 | 19.1 | NA | 19.8 |
| 55 | NA | 1.29 | NA | 3.11 | 1.44 |
| 57 | NA | 23.2 | NA | 13.9 | 30.7 |
| 1 | NA | 2.54 | NA | 6.27 | 6.86 |
| 2 | 0.35 | 0.353 | 0.243 | 0.295 | 0.499 |
| 56 | 11.1 | 11.7 | 13.7 | 13.4 | 11.9 |
| 10 | NA | 42.2 | NA | 30.1 | 33.6 |
| 11 | NA | 522 | NA | 451.3 | 521.2 |
| 19 | 410.9 | 216.4 | 241.9 | 308.1 | 344.6 |
| 20 | 52.5 | 33.5 | 29.8 | 33.4 | 32.5 |
| 26 | 21.1 | 14.5 | 13.6 | 15.5 | 14.6 |
| 33 | 3.17 | 2.93 | 2.79 | 2.73 | 2.83 |
| 38 | 52.1 | 63.8 | 47.4 | 57.7 | 59.3 |
| 39 | NA | 12.99 | NA | 12.48 | 11.49 |
| 42 | 50.7 | 62.8 | 45.1 | 56.1 | 56.3 |
| 43 | NA | 12.99 | NA | 12.47 | 11.48 |
| 54 | 3.8 | 4.52 | 4.35 | 4.11 | 4.67 |
| 58 | NA | 1.42 | NA | 1.52 | 1.63 |
| 45 | NA | 5.27 | NA | 4.59 | 3.12 |
| 48 | 16.8 | 17.9 | 13.8 | 17.8 | 16 |
| 52 | NA | 12 | NA | 14.5 | 15.8 |
| 53 | 9.37 | 4.61 | 3.91 | 6.63 | 5.39 |
| 59 | 1 | 1 | 1 | 1.46 | 1.19 |
| 61 | 56 | 51.3 | 65.7 | 48.7 | 39.7 |
| 3 | 90.8 | 58 | 46.9 | 94.2 | 71.7 |
| 7 | NA | 10.5 | NA | 21.7 | 20.5 |
| 12 | 0.317 | 0.194 | 0.293 | NA | 0.134 |
| 13 | 13.6167 | 13.1699 | 13.7009 | 12.7458 | 13.3004 |
| 17 | 1 | 1 | 1 | 1.33 | 1.25 |
| 22 | 111.7 | 53.4 | 70.9 | 55.7 | 68.7 |
| 21 | 39.3 | 35.2 | 18.8 | 24.9 | 23.2 |
| 27 | NA | 11.42 | 12.17 | NA | 11 |
| 28 | NA | 17.8 | 16.1 | NA | 21.5 |
| 34 | 18.1 | 18 | 19.2 | 14.9 | 16.6 |
| 35 | NA | 1.27 | NA | 1.79 | 1.56 |
| 36 | NA | 0.466 | 0.384 | 0.372 | 0.436 |
| 40 | 79 | 78 | 72.7 | 63 | 73 |
| 41 | 141.5 | 132.3 | 148 | 116 | 122 |
| 44 | 85.5 | 81 | 82.3 | 67.3 | 82 |
| 46 | 141.1 | 165.3 | 156.6 | 151.5 | 141.2 |
| 49 | 1.25 | 1.18 | 1.2 | 2.08 | 1.3 |
| 4 | NA | 43.8 | 42.9 | NA | 43 |
| 8 | 48.2 | 38.5 | 37.3 | 36.9 | 44.1 |
| 14 | NA | 81.9 | NA | 170.8 | 126.5 |
| 24 | NA | 2303 | NA | 3552.7 | 3966.9 |
| 23 | 0.0681 | 0.0994 | 0.0775 | 0.0837 | 0.0872 |
| 29 | NA | 0.258 | NA | 0.178 | NA |
| 30 | 0.08 | 0.189 | 0.119 | 0.163 | 0.113 |
| 37 | 1.96 | 1.04 | 1.1 | 1.15 | 1.88 |
| 15 | 41.3 | 84.3 | 78.5 | 48.4 | 57.8 |
| 16 | 1.225 | 1.441 | 1.567 | 1.001 | 1.102 |
| 25 | 0.256 | 0.358 | 0.228 | 0.284 | 0.253 |

Table 271. Provided are the values of each of the parameters (as described above) measured in maize accessions (Line). Growth conditions are specified in the experimental procedure section.

TABLE 272

Measured parameters in Maize Inbred Field B 35K per acre (lines 1-8)

| Line/Correlation ID | Line-1 | Line-2 | Line-3 | Line-4 | Line-5 | Line-6 | Line-7 | Line-8 |
|---|---|---|---|---|---|---|---|---|
| 5 | 77.2 | 77.2 | 74.7 | 81.6 | 73.3 | NA | 89.7 | 75.3 |
| 9 | 89.5 | 100 | 87.2 | 92.9 | 98.8 | 98.8 | 95.5 | 94 |
| 10 | 24.3 | 17.5 | 9.2 | NA | 2.3 | NA | 6.8 | NA |
| 24 | 5.72 | 6.44 | 4.4 | 5.05 | 6.13 | 5.22 | 6.12 | 6.73 |
| 27 | 248.8 | 180.3 | 219.6 | 208.5 | 226.9 | 160.5 | 221.2 | 247.2 |
| 14 | 231.5 | 156.5 | 185.6 | 180.9 | 194.7 | 142.7 | 191.1 | 211.9 |
| 18 | 0.522 | 0.428 | 0.547 | 0.414 | 0.474 | 0.409 | 0.481 | 0.521 |
| 35 | 6.3 | 22 | 6 | 14 | 16 | 26 | 13.3 | 14 |
| 36 | 74.3 | 89.3 | 88.5 | 45.8 | 59.5 | 134.3 | 93.2 | 107.7 |
| 39 | 30.4 | 17.9 | 26.3 | NA | 16.1 | NA | 28.7 | NA |
| 40 | 3.46 | 4.88 | 4.23 | NA | 1.55 | 0.54 | NA | NA |
| 42 | 169.7 | 82 | 115.6 | NA | 177.3 | 205.7 | NA | NA |
| 48 | 1.97 | 7.6 | 6.64 | NA | 4.37 | 5.64 | NA | NA |
| 49 | 0.346 | 0.217 | 0.501 | 0.321 | 0.382 | 0.251 | 0.521 | 0.306 |

TABLE 272-continued

Measured parameters in Maize Inbred Field B 35K per acre (lines 1-8)

| Line/Correlation ID | Line-1 | Line-2 | Line-3 | Line-4 | Line-5 | Line-6 | Line-7 | Line-8 |
|---|---|---|---|---|---|---|---|---|
| 41 | 11.5 | 12.4 | 14.6 | 12.6 | 16.2 | 13.5 | 14.6 | 14 |
| 52 | 32.2 | 29.1 | 41.8 | NA | 38.5 | NA | NA | NA |
| 53 | 460 | 386.4 | 626.1 | NA | 587.1 | NA | NA | NA |
| 56 | 260.8 | 269.2 | 362.2 | 206.3 | 261.3 | 393.5 | 431.5 | 289.9 |
| 57 | 31.6 | 22.1 | 37.2 | 31.8 | NA | 29.2 | 35.2 | 35.6 |
| 59 | 14.49 | 9.84 | 14.56 | 13 | NA | 12.46 | 14.29 | 16.75 |
| 60 | 2.77 | 2.84 | 3.25 | 3.13 | NA | 2.96 | 3.13 | 2.7 |
| 1 | 48.1 | 38.5 | 72.9 | 52.2 | 60.6 | 50.4 | 64.5 | 59.5 |
| 2 | 22.6 | 13 | 9.8 | NA | 16.1 | 7.4 | NA | NA |
| 6 | 47.6 | 38.1 | 68.7 | 48.7 | 55.6 | 49.5 | 62.6 | 58.7 |
| 7 | 22.4 | 12.9 | 9.8 | NA | 16.1 | 7.4 | NA | NA |
| 20 | 4.41 | 4.53 | 5.41 | 4.43 | 5 | 4.7 | 5.24 | 4.23 |
| 21 | 2.28 | 2 | 1.4 | NA | 1.97 | 1.29 | NA | NA |
| 11 | 6.46 | 3 | 4.64 | NA | 3.6 | NA | NA | NA |
| 12 | 13.8 | 10.8 | 17.2 | 15 | 15.4 | 13.6 | 15.6 | 17.9 |
| 15 | 14.2 | 13.3 | 15 | NA | 15.2 | 17.2 | NA | NA |
| 19 | 4.68 | 4.39 | 4.22 | 2.27 | 2.8 | 6.75 | 6.29 | 6.33 |
| 22 | 1.17 | 1.04 | 1 | 1.06 | 1.31 | 1 | 1.46 | 1 |
| 25 | 44.3 | 28 | 50 | 41 | 37 | 31 | 38.3 | 38 |
| 26 | 63.7 | 65.2 | 61.1 | 31 | 42.6 | 104.9 | 67.4 | 73.6 |
| 28 | 18.3 | 20.3 | 24.1 | NA | 17.1 | 22.8 | NA | NA |
| 29 | 0.189 | 0.231 | 0.181 | 0.172 | NA | 0.266 | NA | 0.251 |
| 30 | 12.7979 | 13.0718 | 13.4839 | 13.3043 | 12.5988 | 12.667 | 12.4484 | 12.3725 |
| 31 | 1 | 1 | 1 | 1 | 1 | 1 | 1 | 1 |
| 33 | 67 | 52.4 | 90.2 | 47.5 | 66.3 | 66.7 | 106.3 | 76.4 |
| 32 | 14.3 | 10.4 | 10.6 | 9.4 | 24 | 12.9 | 21 | 12.9 |
| 34 | 7.62 | 9.06 | 7 | NA | NA | NA | 10.12 | NA |
| 37 | 15.5 | 16.9 | 21.3 | NA | NA | NA | 17.6 | NA |
| 38 | 15.6 | 14.6 | 16.7 | 14.6 | 15.2 | 15.5 | 15.8 | 15.5 |
| 43 | 1.23 | 1.31 | 1.58 | NA | 1.28 | 1.48 | NA | NA |
| 44 | 0.41 | 0.459 | 0.473 | 0.484 | 0.354 | 0.449 | 0.506 | 0.452 |
| 45 | 77 | 64.7 | 66 | 67 | 72 | 62 | 67.3 | 67 |
| 46 | 127.7 | 116 | 122 | 122 | 125 | 119 | 119 | 119 |
| 47 | 83.3 | 88 | 72 | 81 | 88 | 88 | 80.7 | 81 |
| 50 | 145.8 | 142.8 | 151.6 | 167.8 | 188.2 | 152.7 | 181.3 | 173.6 |
| 51 | 1.5 | 2.1 | 2.1 | 2.3 | 1.29 | 2.66 | 2.36 | 2.12 |
| 61 | 40.8 | 50.5 | 49.5 | 49 | NA | NA | 51.8 | NA |
| 3 | 41.2 | 36.3 | 50.7 | 58.6 | 45.9 | 33.7 | 54 | 42.9 |
| 4 | 122.1 | 124.1 | 150.8 | NA | 94.7 | 271.6 | NA | NA |
| 13 | 3023.7 | 2584.4 | 3518.1 | NA | 2660.1 | 6992.7 | NA | NA |
| 8 | 0.075 | 0.0565 | 0.1 | 0.0594 | 0.0879 | 0.0755 | 0.1207 | 0.0766 |
| 16 | 0.318 | 0.154 | 0.287 | NA | 0.256 | 0.175 | NA | NA |
| 17 | 0.102 | 0.17 | 0.136 | 0.144 | 0.08 | 0.172 | 0.085 | 0.234 |
| 23 | 1.51 | 1.79 | 1.81 | 1.2 | 1.79 | 2.19 | 2.95 | 2.17 |
| 54 | 53.8 | 38.8 | 69.9 | 47.2 | 54.7 | 63.8 | 101 | 77.7 |
| 55 | 0.936 | 0.704 | 1.21 | 0.794 | 1.116 | 1.003 | 1.612 | 1.33 |
| 58 | 0.183 | 0.166 | 0.089 | 0.095 | 0.217 | 0.152 | 0.187 | 0.148 |

Table 272. Provided are the values of each of the parameters (as described above) measured in maize accessions (Line). Growth conditions are specified in the experimental procedure section.

TABLE 273

Measured parameters in Maize Inbred Field B 35K per acre (lines 9-16)

| Line/Correlation ID | Line-9 | Line-10 | Line-11 | Line-12 | Line-13 | Line-14 | Line-15 | Line-16 |
|---|---|---|---|---|---|---|---|---|
| 5 | 84.3 | 82.5 | 86.3 | NA | 90.3 | 81.5 | 87.3 | 81.8 |
| 9 | NA | 100 | 100 | 95.4 | 95.6 | NA | 100 | 68.7 |
| 10 | 12.1 | 13.4 | 15.8 | NA | 4.9 | 16.3 | 14.7 | 14 |
| 24 | 4.08 | 4.12 | 4.15 | 5.39 | 5.67 | 3.44 | 3.98 | 5.16 |
| 27 | 245.6 | 255.6 | 216.6 | 175.1 | 277.8 | 285.2 | 210.3 | 202 |
| 14 | 229.6 | 254.8 | 203.2 | 159.2 | 263.2 | 261.3 | 165.4 | 187 |
| 18 | 0.561 | 0.563 | 0.508 | 0.379 | 0.493 | 0.501 | 0.323 | 0.478 |
| 35 | 9.3 | 7 | 14 | 19.5 | 10 | 12 | 10 | 8.7 |
| 36 | 93.8 | 27.7 | 109.1 | 94.9 | 46 | 33.7 | 62.2 | 121.1 |
| 39 | 24.1 | 20.1 | 31.6 | NA | 20.1 | 13.8 | 21.6 | 26.8 |
| 40 | 1.94 | 0.48 | 2.02 | NA | NA | 1.48 | 1.59 | 2.95 |
| 42 | 173.1 | 159.3 | 153.9 | NA | 160.5 | 155.5 | 161.8 | 203 |
| 48 | 4.04 | 2.25 | 2.54 | NA | NA | 4.83 | 4.28 | 2.03 |
| 49 | 0.318 | 0.288 | 0.377 | 0.372 | 0.554 | 0.335 | 0.359 | 0.605 |
| 41 | 11.2 | 12.6 | 13.4 | 12.9 | 13.5 | 14.4 | 11.5 | 13.9 |
| 52 | 42.9 | 26.1 | 41.4 | NA | NA | 44.9 | 41.9 | 41 |
| 53 | 621.7 | NA | 662 | NA | NA | 640.8 | 632.4 | 706.4 |
| 56 | 293.2 | 200.3 | 416 | 297.9 | 221 | 154.1 | 291.7 | 408.7 |

TABLE 273-continued

Measured parameters in Maize Inbred Field B 35K per acre (lines 9-16)

| Line/Correlation ID | Line-9 | Line-10 | Line-11 | Line-12 | Line-13 | Line-14 | Line-15 | Line-16 |
|---|---|---|---|---|---|---|---|---|
| 57 | 34.4 | 36 | 33.8 | 30.8 | 33.6 | 34.9 | 44.8 | 33.5 |
| 59 | 13.14 | 13.49 | 13.85 | 14.84 | 13.82 | 15.77 | 19.16 | 13.12 |
| 60 | 3.33 | 3.39 | 3.1 | 2.64 | 3.06 | 2.8 | 2.98 | 3.24 |
| 1 | 51.5 | 49.3 | 52.2 | 49 | 53.8 | 54.9 | 54.3 | 60.4 |
| 2 | 15.2 | 8 | 13.8 | NA | 12.7 | 13 | 14.2 | 19.3 |
| 6 | 50.3 | 45.6 | 51.8 | 46.6 | 43.5 | 52.3 | 49.9 | 58.6 |
| 7 | 15.2 | 8 | 13.7 | NA | 12.7 | 13 | 14.2 | 19.1 |
| 20 | 4.9 | 4.61 | 4.8 | 4.13 | 4.37 | 4.25 | 3.97 | 5.19 |
| 21 | 1.8 | 1.36 | 1.8 | NA | 1.59 | 1.51 | 1.49 | 2.19 |
| 11 | 6.05 | 2.38 | 6.59 | NA | 4.35 | 3.28 | 6.38 | 6.11 |
| 12 | 13.3 | 13.5 | 13.8 | 14.9 | 15.3 | 16.5 | 17 | 14.8 |
| 15 | 14.5 | NA | 16 | NA | NA | 14.2 | 15.1 | 17.2 |
| 19 | 6.3 | 2.59 | 8.68 | 5.71 | 2.89 | 2.79 | 3.07 | 9.57 |
| 22 | 1.04 | 1 | 1.12 | 1.12 | 1.08 | 1.06 | 1.04 | 1.17 |
| 25 | 61 | 56.3 | 52 | 32.5 | 55.7 | 69 | 62 | 39.7 |
| 26 | 81.1 | 27.5 | 95.4 | 77.6 | 40.8 | 28 | 42.7 | 102.8 |
| 28 | 19.1 | NA | 26 | NA | NA | 10.6 | 16.5 | 25 |
| 29 | 0.217 | 0.115 | 0.221 | NA | 0.11 | 0.142 | 0.161 | 0.129 |
| 30 | 13.113 | 13.0704 | 13.4898 | 12.9801 | 13.4971 | 14.237 | 14.5133 | 12.3574 |
| 31 | 1 | 1 | NA | 1 | 1 | 1 | 1 | 1 |
| 33 | 74 | 51.3 | 93.7 | 55.2 | 62.1 | 61.6 | 67.9 | 85.9 |
| 32 | 20.2 | 14.3 | 15.3 | 11.3 | 22.6 | 22.7 | 33.9 | 19.7 |
| 34 | 11.46 | 11.33 | NA | NA | 11.08 | 9.19 | 8.04 | 13.21 |
| 37 | 18 | 17.2 | 17.2 | NA | 19.7 | 16.6 | 17.8 | 17.3 |
| 38 | 19 | 14.6 | 19.8 | 12.3 | 17.4 | 15.8 | 13.5 | 17.4 |
| 43 | 1.03 | 1.38 | 1.24 | NA | 0.89 | 1.45 | 1.01 | 0.99 |
| 44 | 0.427 | 0.487 | 0.501 | 0.474 | 0.457 | 0.437 | 0.45 | 0.498 |
| 45 | 76.3 | 74 | 74 | 70 | 78 | 76 | 78 | 74.7 |
| 46 | 146.7 | 139.7 | 140 | 122 | 143.7 | 157 | 150 | 123 |
| 47 | 85.7 | 83.3 | 88 | 89.5 | 88 | 88 | 88 | 83.3 |
| 50 | 160.8 | 166.1 | 197 | 173.9 | 205.1 | 185.7 | 166 | 202.8 |
| 51 | 1.34 | 1.79 | 2.19 | 1.98 | 2.11 | 1.54 | 1.52 | 2.08 |
| 61 | 48.9 | NA | NA | 42.4 | 55.2 | 53.4 | 50.8 | NA |
| 3 | 49.3 | 47.2 | 61.3 | 47.2 | 48.6 | 57.6 | 47.1 | 57.1 |
| 4 | 76.4 | 81.8 | 95.8 | NA | NA | 117.2 | 101.8 | 109.2 |
| 13 | 2922.1 | 2583.3 | 2937.7 | NA | 3852.8 | 4273.6 | 3160.2 | 3534.9 |
| 8 | 0.093 | 0.0544 | 0.0998 | 0.0607 | 0.0635 | 0.0751 | 0.0695 | 0.0868 |
| 16 | 0.231 | 0.205 | 0.232 | NA | NA | 0.134 | 0.256 | 0.358 |
| 17 | 0.159 | 0.115 | 0.158 | 0.143 | 0.113 | 0.134 | 0.196 | 0.121 |
| 23 | 1.23 | 0.83 | 1.79 | 1.68 | 1.27 | 0.98 | 1 | 2.22 |
| 54 | 82.9 | 39.5 | 92.8 | 25.9 | 38.3 | 31.6 | 21.8 | 90.7 |
| 55 | 1.508 | 0.726 | 1.417 | 0.421 | 0.614 | 0.548 | 0.357 | 1.511 |
| 58 | 0.184 | 0.118 | 0.145 | 0.174 | 0.223 | 0.212 | 0.26 | 0.184 |

Table 273. Provided are the values of each of the parameters (as described above) measured in maize accessions (Line). Growth conditions are specified in the experimental procedure section.

TABLE 274

Measured parameters in Maize Inbred Field B 35K per acre (lines 17-24)

| Line/Correlation ID | Line-9 | Line-10 | Line-11 | Line-12 | Line-13 | Line-14 | Line-15 | Line-16 |
|---|---|---|---|---|---|---|---|---|
| 5 | 81.3 | 81.8 | 77.4 | 84.3 | 87.3 | 92.6 | 95.6 | 89 |
| 9 | 100 | 100 | 49.6 | 100 | 99.4 | NA | NA | 99.4 |
| 10 | 26.9 | 20.4 | 13 | NA | 11.4 | 15.8 | 16.2 | 24.2 |
| 24 | 4.73 | 3.9 | 7.42 | 4.79 | 4.58 | 2.74 | 3.69 | NA |
| 27 | 213.6 | 244.8 | 262.4 | 206.7 | 192.4 | 208.5 | 295.2 | NA |
| 14 | 204.6 | 225.2 | 230.2 | 200.4 | 169.8 | 193.1 | 296.2 | NA |
| 18 | 0.45 | 0.518 | 0.546 | 0.466 | 0.457 | 0.479 | 0.606 | NA |
| 35 | 7 | 10.3 | 11.7 | 18 | 6 | 5 | 6.3 | 7 |
| 36 | 49.1 | 69.8 | 68.1 | 92.3 | 98.6 | 79.4 | 45.9 | NA |
| 39 | 17 | 13.5 | 14.9 | NA | 31.7 | 13.1 | 13.3 | 9.6 |
| 40 | 2.39 | 2.16 | NA | NA | NA | 3.97 | 1.3 | 0.14 |
| 42 | 149 | 182.9 | 173 | NA | NA | 156.4 | 207.5 | 164.5 |
| 48 | 1.25 | 2.16 | NA | NA | NA | 4.97 | 3.71 | 5.54 |
| 49 | 0.282 | 0.366 | 0.575 | 0.285 | 0.356 | 0.195 | 0.541 | 0.436 |
| 41 | 13.4 | 14.4 | 13.1 | 14.3 | 14.5 | 13.8 | 11.6 | 10.6 |
| 52 | 41.5 | 32.2 | NA | NA | NA | 41.1 | NA | 21 |
| 53 | 726.5 | 444.8 | NA | NA | NA | 628.2 | NA | 306.5 |
| 56 | 259 | 257.8 | 263.9 | 333.7 | 320.8 | 256.2 | 283.6 | NA |
| 57 | 25.8 | 24 | NA | 31.1 | 25.7 | 15.3 | NA | NA |
| 59 | 10.44 | 12.01 | NA | 12.81 | 13.43 | 6.9 | NA | NA |
| 60 | 3.07 | 2.54 | NA | 3.08 | 2.42 | 2.49 | NA | NA |
| 1 | 44.3 | 43.1 | 54.6 | 48.6 | 51.5 | 36.1 | 40.7 | 32.3 |

TABLE 274-continued

Measured parameters in Maize Inbred Field B 35K per acre (lines 17-24)

| Line/Correlation ID | Line-9 | Line-10 | Line-11 | Line-12 | Line-13 | Line-14 | Line-15 | Line-16 |
|---|---|---|---|---|---|---|---|---|
| 2 | 17.6 | 16.8 | 11.9 | NA | NA | 22.5 | 13 | 3.2 |
| 6 | 42.6 | 42.2 | 51.5 | 47.3 | 50 | 34 | 34.2 | 26.1 |
| 7 | 17.5 | 16.7 | 11.9 | NA | NA | 22.4 | 13 | 3.2 |
| 20 | 4.64 | 4.18 | 4.4 | 4.24 | 4.22 | 4.02 | 3.89 | 3.5 |
| 21 | 2.08 | 1.8 | 1.53 | NA | NA | 2.28 | 1.61 | 0.92 |
| 11 | 3.9 | 3.25 | 4.55 | NA | NA | 3.11 | 2.98 | 2.93 |
| 12 | 12 | 12.9 | 14.3 | 14.4 | 15.4 | 11.1 | 12.5 | 11 |
| 15 | 17.5 | 13.7 | NA | NA | NA | 15.2 | 15.2 | 14.6 |
| 19 | 3.97 | 4.21 | 3.71 | 6.04 | 5.62 | 5.18 | 5.14 | NA |
| 22 | 1.06 | 1.04 | 1.21 | 1 | 1.19 | 1 | 1.25 | 1.04 |
| 25 | 49.5 | 65.7 | 35.5 | 44.5 | 42 | 66.7 | 80 | 49 |
| 26 | 44.4 | 59 | 51.5 | 86.5 | 74.5 | 67.7 | 46.5 | NA |
| 28 | 14.5 | 18.7 | NA | NA | NA | 19.1 | 11.6 | NA |
| 29 | 0.062 | 0.224 | NA | 0.247 | NA | 0.24 | NA | NA |
| 30 | 13.9622 | 13.4116 | 13.263 | 12.9152 | 12.5174 | 13.941 | 12.7539 | 13.4184 |
| 31 | 1 | 1 | 1 | 1 | 1 | 1 | 1 | 1 |
| 33 | 52.6 | 66.2 | 75.9 | 70.2 | 66 | 54.7 | 82.1 | NA |
| 32 | 14.1 | 14 | 31.5 | 22.7 | 12.1 | 14.4 | 24.5 | 12.6 |
| 34 | 12.56 | 11.5 | 10.96 | NA | 12.81 | 9.96 | 10.5 | 9.04 |
| 37 | 17.5 | 15.6 | 16.7 | NA | 16.4 | 14.6 | 18.5 | 15.9 |
| 38 | 18.1 | 18.4 | 16.8 | 16 | 15.3 | 20 | 27.4 | 11.5 |
| 43 | 0.78 | 1.24 | 1.13 | NA | NA | 1.3 | 0.94 | 1.15 |
| 44 | 0.43 | 0.439 | 0.38 | 0.445 | 0.446 | 0.354 | 0.351 | 0.393 |
| 45 | 77.5 | 75.3 | 74 | 70 | 68 | 90 | 84.7 | 80.3 |
| 46 | 134 | 151.3 | 123.5 | 132.5 | 116 | 161.7 | 171 | 136.7 |
| 47 | 84.5 | 85.7 | 85.7 | 88 | 74 | 95 | 91 | 88 |
| 50 | 181.3 | 174.1 | 164.3 | 159.1 | 170 | 185 | 173.2 | 160.2 |
| 51 | 1.8 | 1.82 | 1.51 | 1.64 | 2.14 | 0.99 | 1.24 | 1.31 |
| 61 | 42.6 | 49.1 | NA | NA | NA | NA | NA | 35.6 |
| 3 | 44.1 | 47.6 | 51.3 | 44.9 | NA | 45.9 | 50.2 | 29.5 |
| 4 | 99.2 | 119.5 | NA | NA | NA | 115.1 | 93.4 | 143.6 |
| 13 | 2577.9 | 3219.7 | 3114.3 | NA | NA | 3285 | 3514.4 | 3698.8 |
| 8 | 0.065 | 0.062 | 0.0756 | 0.0644 | 0.0704 | 0.0466 | 0.0467 | 0.0266 |
| 16 | 0.286 | 0.239 | NA | NA | NA | 0.082 | 0.308 | 0.366 |
| 17 | 0.159 | 0.089 | 0.13 | 0.15 | 0.192 | 0.09 | 0.119 | 0.108 |
| 23 | 0.93 | 1.09 | 2.16 | 1.62 | 1.57 | 0.72 | 1.03 | NA |
| 54 | 59.3 | 41.8 | 71.2 | 55.1 | 57.2 | 33.1 | 39.3 | 13.7 |
| 55 | 1.012 | 0.735 | 1.228 | 1.141 | 0.859 | 0.582 | 0.76 | 0.214 |
| 58 | 0.164 | 0.216 | 0.262 | 0.181 | 0.196 | 0.306 | 0.181 | NA |

Table 274. Provided are the values of each of the parameters (as described above) measured in maize accessions (Line). Growth conditions are specified in the experimental procedure section.

TABLE 275

Measured parameters in Maize Inbred Field B 35K per acre (lines 25-32)

| Line/Correlation ID | Line-25 | Line-26 | Line-27 | Line-28 | Line-29 | Line-30 | Line-31 | Line-32 |
|---|---|---|---|---|---|---|---|---|
| 5 | 89.2 | 76 | 72.3 | 89.8 | 87.7 | 78.1 | 83.2 | 89.4 |
| 9 | 99.4 | 100 | 98.6 | NA | NA | 99.6 | NA | NA |
| 10 | 26.4 | NA | NA | 5.3 | 16 | 1.3 | 19.9 | 5.7 |
| 24 | 5.29 | 6.17 | 3.89 | 3.96 | 4.04 | 7.62 | 3.36 | 4.01 |
| 27 | 259.2 | 225.1 | 204.4 | 233.7 | 295 | 303.4 | 255 | 277.2 |
| 14 | 225.6 | 212.7 | 190.4 | 232.8 | 265.1 | 258.3 | 249.9 | 315 |
| 18 | 0.58 | 0.447 | 0.466 | 0.413 | 0.55 | 0.638 | 0.566 | 0.521 |
| 35 | 6.3 | 15 | 4 | 8.5 | 5 | 14 | 10.7 | 12 |
| 36 | 128.1 | 66.2 | 47.2 | 18.4 | 40.5 | 67 | 83.6 | 50.9 |
| 39 | 30.8 | NA | NA | 5.1 | 9.8 | 29.2 | 5.9 | 10.6 |
| 40 | 5.43 | 0.44 | 1.03 | NA | NA | 1.59 | 3.83 | 0.88 |
| 42 | 141.6 | 87.5 | 177.4 | NA | NA | 229.3 | 185.2 | 162.2 |
| 48 | 3.78 | 5.1 | 5.72 | NA | NA | 6.2 | 5.34 | 3.26 |
| 49 | 0.516 | 0.354 | 0.326 | 0.491 | 0.532 | 0.556 | 0.253 | 0.411 |
| 41 | 13.6 | 12.1 | 13.3 | 9.9 | 14.1 | 13.4 | 11.8 | 14.6 |
| 52 | NA | 26.8 | 36.6 | NA | NA | NA | 45 | NA |
| 53 | NA | 405.1 | 522.1 | NA | NA | NA | 555.8 | NA |
| 56 | 419.6 | 287 | 240 | 97.3 | 233.8 | 302.6 | 152.9 | 237.7 |
| 57 | 57.9 | NA | 33.2 | NA | NA | NA | NA | NA |
| 59 | 22.49 | NA | 14.02 | NA | NA | NA | NA | NA |
| 60 | 3.28 | NA | 3.01 | NA | NA | NA | NA | NA |
| 1 | 70.2 | 53.5 | 50.9 | 35.6 | 46.4 | 66.5 | 27.1 | 40.4 |
| 2 | 25.5 | 5.8 | 10.8 | NA | NA | 11.7 | 22.5 | 11.5 |
| 6 | 68.2 | 50.5 | 46.1 | 34.8 | 45.9 | 63.9 | 25.5 | 39.6 |
| 7 | 25.5 | 5.8 | 10.8 | NA | NA | 11.7 | 22.4 | 11.5 |
| 20 | 4.7 | 4.46 | 4.49 | 3.66 | 4.23 | 5.69 | 2.75 | 3.73 |

TABLE 275-continued

Measured parameters in Maize Inbred Field B 35K per acre (lines 25-32)

| Line/Correlation ID | Line-25 | Line-26 | Line-27 | Line-28 | Line-29 | Line-30 | Line-31 | Line-32 |
|---|---|---|---|---|---|---|---|---|
| 21 | 2.36 | 1.23 | 1.6 | NA | NA | 1.6 | 1.93 | 1.42 |
| 11 | 7.38 | NA | NA | NA | NA | 7.36 | 2.01 | 2.87 |
| 12 | 18.4 | 15.1 | 14.4 | 12.1 | 13.6 | 14.8 | 11.8 | 13 |
| 15 | 16.1 | 15.2 | 14.2 | NA | NA | 15.2 | 12.5 | 15.8 |
| 19 | 8.66 | 3.5 | 2.87 | 1.47 | 2.79 | 3.87 | 6.1 | 3 |
| 22 | 1.3 | 1.25 | 1.28 | 1 | 1.19 | 1.71 | 1.08 | 1 |
| 25 | 48.7 | 39 | 53 | 67.5 | 76.5 | 46 | 74 | 71 |
| 26 | 97.2 | 57.6 | 39 | 18.3 | 34.3 | 52.7 | 80.2 | 57.2 |
| 28 | 25.5 | 18.8 | 16.9 | NA | 20.2 | 12.8 | 15.1 | |
| 29 | 0.145 | NA | NA | 0.048 | NA | NA | 0.222 | 0.156 |
| 30 | 13.3545 | 13.119 | 13.7642 | 12.7265 | 3.9067 | 12.6279 | 12.9047 | 15.0186 |
| 31 | 2 | 1 | 1.5 | 1 | 1 | 1 | 1 | 1 |
| 33 | 129.2 | 67.3 | 51.7 | 22.8 | 71.3 | 94.6 | 39.1 | 65.9 |
| 32 | 28.8 | 18.9 | 28.4 | 39.4 | 21.9 | 28 | 25.5 | 26.8 |
| 34 | 8.51 | NA | NA | 8.19 | 7.88 | 12.29 | 9.33 | 9.45 |
| 37 | 15.2 | NA | NA | 18.4 | 16.6 | 17 | 18 | 18.2 |
| 38 | 14.9 | 15.4 | 14.4 | 12.3 | 29.8 | 16.8 | 24.7 | NA |
| 43 | 0.85 | 1.49 | 1.61 | NA | NA | 1.37 | 0.93 | 1.11 |
| 44 | 0.461 | 0.472 | 0.43 | 0.332 | 0.415 | 0.343 | 0.413 | 0.432 |
| 45 | 81.7 | 62 | 62 | 88 | 89.5 | 74 | 86.3 | 81 |
| 46 | 136.7 | 116 | 119 | 164 | 171 | 134 | 171 | 164 |
| 47 | 88 | 77 | 66 | 96.5 | 94.5 | 88 | 97 | 93 |
| 50 | 192.7 | 149.7 | 145.2 | 188.1 | 213.2 | 178.9 | 161.7 | 254.2 |
| 51 | 1.55 | 3.25 | 3.25 | 2.01 | 1.59 | 1.46 | 0.94 | 2.27 |
| 61 | NA | NA | NA | NA | NA | NA | NA | NA |
| 3 | 45.7 | 47.3 | 48.9 | 35.8 | 49.6 | 52.2 | 38.8 | 48.2 |
| 4 | 80.9 | 113.3 | 222.3 | NA | NA | 100.7 | 96.7 | 82.8 |
| 13 | 2384.3 | 2888.8 | 4612.2 | NA | NA | 3495.2 | 3611.4 | 3737.6 |
| 8 | 0.1233 | 0.0841 | 0.0745 | 0.0196 | 0.0349 | 0.1305 | 0.0193 | 0.0911 |
| 16 | 0.332 | 0.221 | 0.213 | NA | NA | 0.274 | 0.169 | 0.117 |
| 17 | 0.214 | 0.147 | 0.161 | 0.068 | 0.093 | 0.14 | 0.134 | 0.145 |
| 23 | 2.64 | 1.82 | 0.99 | 0.39 | 0.98 | 1.93 | 0.52 | 0.96 |
| 54 | 41.5 | 53.2 | 49.3 | 13 | 40.9 | 86.1 | 27.6 | NA |
| 55 | 0.638 | 1.158 | 0.922 | 0.371 | 0.907 | 1.882 | 0.48 | NA |
| 58 | 0.227 | 0.171 | 0.293 | 0.453 | 0.17 | 0.198 | 0.332 | 0.197 |

Table 275. Provided are the values of each of the parameters (as described above) measured in maize accessions (Line). Growth conditions are specified in the experimental procedure section.

TABLE 276

Measured parameters in Maize Inbred Field B 35K per acre (lines 33-40)

| Line/Correlation ID | Line-33 | Line-34 | Line-35 | Line-36 | Line-37 | Line-38 | Line-39 | Line-40 |
|---|---|---|---|---|---|---|---|---|
| 5 | 69.7 | 74.8 | 74.5 | 90.9 | 74.6 | 74.5 | 86.2 | 91 |
| 9 | NA | NA | 72.7 | NA | 96.7 | 100 | NA | NA |
| 10 | 10.7 | 8.8 | 17.9 | 16.1 | NA | 19 | 13.6 | 9.1 |
| 24 | 5.08 | 3.97 | 5.22 | 2.95 | NA | 3.25 | 2.95 | NA |
| 27 | 248.5 | 218.8 | 219.7 | 223.9 | NA | 260 | 235.8 | NA |
| 14 | 228.6 | 196.1 | 204.8 | 209.3 | NA | 256.4 | 211.3 | NA |
| 18 | 0.521 | 0.431 | 0.444 | 0.481 | NA | 0.454 | 0.512 | NA |
| 35 | 9.5 | 9.5 | 11 | 3.7 | 16.3 | 3 | 7.7 | 7 |
| 36 | 36.9 | 71.3 | 48.8 | 61 | NA | 15.1 | 71.5 | NA |
| 39 | 15.2 | 13.8 | 17 | 12.5 | NA | 8.2 | 20.9 | 13.2 |
| 40 | 2.27 | NA | NA | 4.96 | 0.15 | 2.35 | 1.71 | 2.17 |
| 42 | 195.2 | 124 | 183.9 | 157.6 | 189.5 | 166.5 | 165.1 | 158.7 |
| 48 | 1.84 | NA | NA | 7.61 | 7.74 | 7.4 | 6.18 | 6.5 |
| 49 | 0.268 | 0.469 | 0.361 | 0.267 | 0.277 | 0.234 | 0.318 | 0.347 |
| 41 | 13.1 | 10.4 | 11.7 | 12.3 | 11.4 | 12 | 10.6 | 13.5 |
| 52 | 27 | NA | 28.1 | 38.5 | NA | 44.5 | NA | 31.8 |
| 53 | 330.6 | NA | 444.5 | 654.1 | NA | 611.5 | NA | 364.2 |
| 56 | 168.6 | 274.5 | 226.8 | 343.7 | NA | 146.6 | 358.3 | NA |
| 57 | 21 | 31.8 | 33.7 | NA | NA | 28.4 | NA | NA |
| 59 | 11.14 | 14.42 | 14.08 | NA | NA | 13.68 | NA | NA |
| 60 | 2.4 | 2.81 | 3.04 | NA | NA | 2.65 | NA | NA |
| 1 | 33 | 49.3 | 47.7 | 40.9 | 36.3 | 43.6 | 56.4 | 47.3 |
| 2 | 15.4 | 2.8 | 5.2 | 19.3 | 4.9 | 21.4 | 11 | 14.3 |
| 6 | 29.6 | 46.9 | 42.7 | 38.5 | 30.7 | 40.3 | 49.9 | 44.9 |
| 7 | 15.3 | 2.8 | 5.2 | 19.3 | 4.9 | 21.4 | 11 | 14.3 |
| 20 | 3.84 | 4.27 | 4.33 | 3.69 | 4.28 | 3.44 | 4.49 | 4.43 |
| 21 | 1.89 | 0.82 | 1.08 | 2.11 | 0.91 | 1.97 | 1.59 | 1.71 |
| 11 | 3.68 | 1.68 | 3.82 | 3.96 | NA | 3.6 | 5.59 | 4 |
| 12 | 10.9 | 14 | 13.7 | 14.2 | 10.5 | 14.4 | 15.7 | 13.5 |
| 15 | 12.2 | NA | 15.8 | 17 | 19 | 13.8 | 14.5 | 11.5 |

TABLE 276-continued

Measured parameters in Maize Inbred Field B 35K per acre (lines 33-40)

| Line/Correlation ID | Line-33 | Line-34 | Line-35 | Line-36 | Line-37 | Line-38 | Line-39 | Line-40 |
|---|---|---|---|---|---|---|---|---|
| 19 | 2.33 | 3.86 | 3.06 | 4 | NA | 1.61 | 4.47 | NA |
| 22 | 1.56 | 1.56 | 1.12 | 1.54 | 1 | 1 | 1.21 | 1.38 |
| 25 | 51.5 | 62 | 43.3 | 77.3 | 44.7 | 67.3 | 78.7 | 73 |
| 26 | 30.9 | 57.8 | 43.4 | 54.5 | NA | 14.8 | 58.6 | NA |
| 28 | 13.8 | NA | 17.4 | 20.8 | NA | 10.9 | 24.7 | NA |
| 29 | NA | NA | 0.195 | NA | NA | 0.212 | NA | NA |
| 30 | 13.3308 | 12.5934 | 13.341 | 12.6129 | 12.6592 | 13.8362 | 14.592 | 13.9201 |
| 31 | 1.5 | 1 | 1 | 1.67 | 2 | 1.67 | 2.33 | 1 |
| 33 | 44.3 | 64 | 53.3 | 79 | NA | 38.1 | 92.4 | NA |
| 32 | 12.4 | 20.9 | 14.1 | 19.2 | NA | 42.3 | 23.9 | 52.4 |
| 34 | 16.31 | 15.06 | 11.21 | 8.33 | NA | 10.12 | 7.88 | 7.94 |
| 37 | 15.2 | 15.6 | 16.5 | 13.3 | NA | 16.2 | 16.4 | 15.6 |
| 38 | 17.8 | 16.6 | 16.3 | 17.2 | 9.3 | 16.2 | 16.8 | 29.8 |
| 43 | NA | 1.46 | 1.66 | 1.35 | 2.09 | 1.21 | 1.36 | 1.43 |
| 44 | 0.394 | 0.393 | 0.366 | 0.327 | 0.37 | 0.401 | 0.339 | 0.384 |
| 45 | 75 | 75 | 75.7 | 90 | 62 | 88 | 84.7 | 91 |
| 46 | 136 | 146.5 | 130 | 171 | 123 | 158.3 | 171 | 171 |
| 47 | 84.5 | 84.5 | 86.7 | 93.7 | 78.3 | 91 | 92.3 | 98 |
| 50 | 168.4 | 156.6 | 140.6 | 166.4 | 123.6 | 160 | 164 | 185.9 |
| 51 | 1.9 | 1.86 | 1.26 | 0.96 | 1.61 | 1.06 | 0.96 | 1.39 |
| 61 | 42.5 | NA | NA | NA | NA | NA | NA | NA |
| 3 | 32.9 | 40 | 37.1 | 42.1 | 37.6 | 35.6 | 38.8 | 42.1 |
| 4 | 98.4 | NA | NA | 105.1 | 233.3 | 123.9 | 97.2 | 98.9 |
| 13 | 3698.2 | 992.2 | 3250.3 | 4029.6 | 6064.7 | 3718.7 | 3970.4 | 4132.6 |
| 8 | 0.0716 | 0.0772 | 0.064 | 0.037 | 0.0237 | 0.0347 | 0.0673 | 0.0717 |
| 16 | NA | NA | NA | 0.121 | 0.149 | 0.162 | 0.206 | 0.121 |
| 17 | 0.162 | 0.138 | 0.09 | 0.124 | 0.067 | 0.101 | 0.14 | 0.129 |
| 23 | 0.9 | 1.22 | 1.3 | 1.04 | NA | 0.48 | 1.16 | NA |
| 54 | 51.5 | 47.7 | 62.4 | 25.5 | 8.5 | 25.7 | 28 | 38.4 |
| 55 | 1.226 | 1.065 | 1.102 | 0.553 | 0.2 | 0.47 | 0.546 | 0.772 |
| 58 | 0.245 | 0.252 | 0.159 | 0.174 | NA | 0.229 | 0.148 | NA |

Table 276. Provided are the values of each of the parameters (as described above) measured in maize accessions (Line). Growth conditions are specified in the experimental procedure section.

TABLE 277

Measured parameters in Maize Inbred Field B 35K per acre (lines 41-48)

| Line/Correlation ID | Line-41 | Line-42 | Line-43 | Line-44 | Line-45 | Line-46 | Line-47 | Line-48 |
|---|---|---|---|---|---|---|---|---|
| 5 | 76.4 | 95.5 | 77.1 | 81.5 | 75.9 | 76.6 | 91.6 | NA |
| 9 | 97.9 | NA | 93.7 | 78.5 | 84.9 | 69.7 | 94.3 | 100 |
| 10 | 27 | 13.2 | 3 | 7.3 | 9.1 | 11 | 7.9 | 11.8 |
| 24 | 5.07 | 3.94 | 3.68 | NA | 6.27 | 5.35 | 4.73 | NA |
| 27 | 202.1 | 315.6 | 206 | 233.6 | 283.5 | 211.4 | 191 | 199.6 |
| 14 | 183.8 | 292.1 | 186.8 | 209.8 | 257.9 | 201.4 | 169.7 | 183.2 |
| 18 | 0.398 | 0.557 | 0.521 | 0.512 | 0.573 | 0.48 | 0.409 | 0.428 |
| 35 | 14 | 10 | 9.2 | NA | 12.7 | 13.7 | 9 | 14 |
| 36 | 46.8 | 28 | 96.3 | 117.6 | 78.1 | 135.4 | 124 | 76.5 |
| 39 | 16.6 | 6.3 | 24.3 | 31.8 | 14.9 | 13 | 26.5 | 20.4 |
| 40 | 0.68 | 0.39 | 2.21 | 2.93 | 1.45 | 0.94 | 2.04 | 1.34 |
| 42 | 132.3 | 209.9 | 166.9 | 102.9 | 167.4 | 137.1 | 168.2 | 154.2 |
| 48 | 5.85 | 5.75 | 7.27 | 8.47 | 2.93 | 2.9 | 3.82 | 5.32 |
| 49 | 0.372 | 0.395 | 0.345 | 0.472 | 0.372 | 0.543 | 0.458 | 0.248 |
| 41 | 11.3 | 12.6 | 10.4 | 14.1 | 12.8 | 13.7 | 13.2 | 11.9 |
| 52 | 36.8 | 27.2 | 42.5 | 38.7 | 40.1 | 34.1 | 34.4 | 29.4 |
| 53 | 579.1 | 348.4 | 731.7 | 639.2 | 440.3 | 514.3 | 507.8 | 390.8 |
| 56 | 176 | 163.3 | 356.3 | 390.1 | 274.6 | 331.7 | 356.8 | 277.2 |
| 57 | 22.1 | NA | 25.7 | 30 | 33.6 | NA | 36.8 | 27.5 |
| 59 | 10.48 | NA | 10.39 | 12.17 | 16.66 | NA | 16.06 | 12.57 |
| 60 | 2.69 | NA | 3.12 | 3 | 2.56 | NA | 2.92 | 2.78 |
| 1 | 40 | 51.1 | 53.3 | 67.4 | 60.1 | 60.3 | 63 | 39.3 |
| 2 | 7.9 | 5.5 | 14.7 | 8.9 | 15.5 | 8.6 | 13.6 | 6.7 |
| 6 | 38.1 | 48.9 | 51.2 | 66 | 58.5 | 53 | 58.6 | 35.9 |
| 7 | 7.9 | 5.5 | 14.7 | 8.9 | 15.4 | 8.5 | 13.6 | 6.7 |
| 20 | 3.89 | 4.48 | 5.31 | 5.23 | 4.25 | 4.26 | 4.5 | 3.99 |
| 21 | 1.21 | 0.97 | 1.89 | 1.34 | 1.63 | 1.17 | 1.81 | 1.21 |
| 11 | 3.64 | 1.77 | 6.58 | 6.08 | 3.88 | 3.32 | 6.56 | 3.99 |
| 12 | 12.8 | 14.3 | 12.6 | 16.4 | 17.9 | 17.7 | 17.8 | 12.5 |
| 15 | 15.8 | 12.7 | 17.2 | 16.5 | 11 | 15 | 14.8 | 13.2 |
| 19 | 2.79 | 1.58 | 5.02 | 6.07 | 6.71 | 10.59 | 8.47 | 4.24 |
| 22 | 1 | NA | 1.22 | 1.31 | 1.04 | 1.38 | 1.42 | 1.38 |
| 25 | 41.5 | 80 | 52.2 | NA | 46 | 43.7 | 41 | 48 |
| 26 | 38.8 | 25.1 | 77.8 | 94.3 | 63.2 | 122.9 | 97.9 | 63.8 |

TABLE 277-continued

Measured parameters in Maize Inbred Field B 35K per acre (lines 41-48)

| Line/Correlation ID | Line-41 | Line-42 | Line-43 | Line-44 | Line-45 | Line-46 | Line-47 | Line-48 |
|---|---|---|---|---|---|---|---|---|
| 28 | 11.2 | 13.2 | 20.7 | 23.7 | 24.6 | 20.6 | 21.3 | 19.8 |
| 29 | 0.1 | NA | 0.14 | NA | 0.299 | 0.135 | NA | NA |
| 30 | 13.0329 | 13.9737 | 12.5589 | 12.9183 | 13.8005 | 12.6498 | 13.0829 | 13.8276 |
| 31 | NA | 1 | 1 | 1.5 | 1 | 1 | 1.5 | 1 |
| 33 | 37.3 | 52.3 | 78.3 | 97.1 | 81.6 | 71.3 | 70.6 | 58.1 |
| 32 | 10.6 | 23.6 | 58.5 | 15.8 | 14 | 19.6 | 27.6 | 12.3 |
| 34 | 9.19 | 8.05 | 11 | 10 | 11.5 | 12.58 | 9.33 | 7.44 |
| 37 | 19 | 21.7 | 19.9 | 16.8 | 16.1 | 18.9 | 16.3 | 14.7 |
| 38 | 14.2 | 23.9 | 18.1 | 15.5 | 17.3 | 13.5 | 18.3 | 16.2 |
| 43 | 1.41 | 1.84 | 1.41 | 1.75 | 1.41 | 1.36 | 1.46 | 1.19 |
| 44 | 0.359 | 0.343 | 0.402 | 0.596 | 0.365 | 0.402 | 0.403 | 0.452 |
| 45 | 74 | 81 | 77 | 66 | 75.3 | 75.3 | 79 | 72.7 |
| 46 | 129.5 | 171 | 138.5 | 116 | 134 | 132.7 | 129 | 129 |
| 47 | 88 | 91 | 86.2 | NA | 88 | 89 | 88 | 88 |
| 50 | 146 | 172.9 | 148.3 | 170.1 | 166.6 | 188.2 | 180.2 | 140.6 |
| 51 | 1.42 | 1.34 | 1.65 | 2.46 | 1.44 | 1.72 | 1.68 | 1.45 |
| 61 | NA | NA | 39.2 | 48.5 | 41.2 | 47.1 | 56.2 | NA |
| 3 | 40.8 | 38.1 | 40.7 | 45.1 | 44.1 | 49.4 | 54.2 | 44.8 |
| 4 | 111.2 | 99.1 | 125.6 | 149.6 | 109.3 | 88.7 | 146.7 | 83.9 |
| 13 | 2427.6 | 4193.5 | 3677.1 | 4503.5 | 2307.6 | 2463.9 | 4651.7 | 2089.3 |
| 8 | 0.0401 | NA | 0.068 | 0.1121 | 0.0844 | 0.0597 | 0.1 | 0.0627 |
| 16 | 0.294 | 0.126 | 0.27 | 0.197 | 0.202 | 0.33 | 0.22 | 0.229 |
| 17 | 0.109 | 0.085 | 0.128 | 0.147 | 0.184 | 0.158 | 0.152 | 0.155 |
| 23 | 0.94 | 0.65 | 1.4 | NA | 1.81 | 1.84 | 2.1 | NA |
| 54 | 26.5 | 38.3 | 39 | 91.8 | 70 | 32.1 | 71.4 | 48.8 |
| 55 | 0.447 | 0.722 | 0.872 | 1.406 | 1.294 | 0.544 | 1.523 | 0.841 |
| 58 | 0.18 | 0.252 | 0.19 | 0.19 | 0.166 | 0.201 | 0.254 | 0.161 |

Table 277. Provided are the values of each of the parameters (as described above) measured in maize accessions (Line). Growth conditions are specified in the experimental procedure section.

TABLE 278

Measured parameters in Maize Inbred Field B 35K per acre (lines 49-56)

| Line/Correlation ID | Line-49 | Line-50 | Line-51 | Line-52 | Line-53 | Line-54 | Line-55 | Line-56 |
|---|---|---|---|---|---|---|---|---|
| 5 | 93.2 | 80.6 | 82.7 | 83.5 | NA | 83.6 | 86.6 | 92.6 |
| 9 | NA | 100 | 100 | 100 | 100 | NA | NA | NA |
| 10 | 29.2 | 8.2 | 17.5 | 1.8 | 11.1 | 9.7 | 16 | 13 |
| 24 | 4.95 | 5.48 | 3.85 | 6.05 | 5.39 | 2.89 | 4.27 | 3.83 |
| 27 | 281.9 | 239.8 | 211.8 | 223.8 | 276.2 | 231.5 | 180.8 | 318 |
| 14 | 267.5 | 213.3 | 204.2 | 208.8 | 264.9 | 215.6 | 157.3 | 299.4 |
| 18 | 0.533 | 0.48 | 0.458 | 0.53 | 0.538 | 0.508 | 0.372 | 0.565 |
| 35 | 7 | 4 | 14 | 14 | 14.3 | 14 | 5.7 | 7 |
| 36 | 37.8 | 69.3 | 83.9 | 69.5 | 43.7 | 44.6 | 66.2 | 61.3 |
| 39 | 10.8 | 20.7 | 18.6 | 18.7 | 18 | 5 | 17.3 | 15.2 |
| 40 | 2.76 | NA | 0.72 | 1.72 | NA | NA | 3.24 | 2.33 |
| 42 | 247.9 | NA | 149.1 | 209.9 | NA | 133.6 | 122.2 | 148.8 |
| 48 | 5.77 | NA | 3.85 | 4.57 | NA | 4.75 | 2.34 | 7.33 |
| 49 | 0.439 | 0.371 | 0.288 | 0.335 | 0.26 | 0.339 | 0.296 | 0.32 |
| 41 | 13.1 | 12.4 | 11.2 | 13.1 | 11.9 | 11.6 | NA | 9.5 |
| 52 | NA | NA | 39.2 | 40.1 | NA | NA | NA | NA |
| 53 | NA | NA | 588.8 | 592.4 | NA | NA | NA | NA |
| 56 | 131.2 | 228.7 | 226.7 | 361.4 | 164.8 | 196.8 | 287.3 | 147.1 |
| 57 | 25 | 33.1 | NA | 28.9 | 22.7 | 27.3 | 31.2 | 23.9 |
| 59 | 10.47 | 13.95 | NA | 13.51 | 9.52 | 9.58 | 13.09 | 11.83 |
| 60 | 3.02 | 3.01 | NA | 2.73 | 3.03 | 3.63 | 3.06 | 2.56 |
| 1 | 36.7 | 57.1 | 44.1 | 52.1 | 35.1 | 27.4 | 38.5 | 42.9 |
| 2 | 20.7 | NA | 7.7 | 12.5 | NA | 3.5 | 19.9 | 16 |
| 6 | 32.4 | 51.6 | 41.2 | 50.7 | 32.4 | 25.1 | 36.8 | 41.3 |
| 7 | 20.7 | NA | 7.7 | 12.5 | NA | 3.5 | 19.9 | 16 |
| 20 | 4.06 | 4.6 | 4.16 | 4.71 | 4.22 | 3.82 | 3.97 | 4.03 |
| 21 | 2.17 | NA | 1.2 | 1.65 | NA | 0.85 | 2.01 | 1.81 |
| 11 | 2.4 | NA | 3.76 | 3.89 | NA | 1.22 | 3.92 | 3.84 |
| 12 | 11.2 | 15.8 | 13.3 | 14.1 | 10.3 | 8.6 | 12 | 13.4 |
| 15 | 20.5 | NA | 15 | 14.8 | NA | NA | 18 | 10.4 |
| 19 | 3.13 | 4.03 | 4.27 | 4.42 | 3.73 | 3.79 | 3.62 | 3.83 |
| 22 | 1 | 1.12 | 1 | 1.12 | 1.05 | 1.33 | 1.21 | 1.12 |
| 25 | 57 | 44 | 53.5 | 44.5 | 51.3 | 80 | 48.3 | 83 |
| 26 | 34.1 | 53.9 | 77.9 | 60.1 | 40.9 | 40 | 51.6 | 53.8 |
| 28 | 6.5 | NA | 15.1 | 24.9 | NA | NA | 15.7 | 14.2 |
| 29 | 0.092 | 0.187 | 0.192 | 0.233 | 0.126 | NA | NA | 0.153 |
| 30 | 12.9354 | 12.3439 | 13.1444 | 13.5987 | 12.6477 | 12.662 | 14.3953 | 13.1599 |
| 31 | 2 | 1 | 1 | 2 | 1.33 | 1 | 1 | 1 |

TABLE 278-continued

Measured parameters in Maize Inbred Field B 35K per acre (lines 49-56)

| Line/Correlation ID | Line-49 | Line-50 | Line-51 | Line-52 | Line-53 | Line-54 | Line-55 | Line-56 |
|---|---|---|---|---|---|---|---|---|
| 33 | 37.8 | 58.2 | 48.5 | 79.8 | 42.7 | 46.6 | 55.7 | 47.5 |
| 32 | 20 | 15.7 | 25.3 | 17 | 13.1 | 15.1 | 14 | 9.1 |
| 34 | 8.69 | 10.38 | 9.56 | 13.19 | NA | 8.33 | 11.16 | 7.53 |
| 37 | 15.2 | 18.4 | 17.5 | 17.9 | NA | 18.2 | 17.9 | 15.3 |
| 38 | 23.1 | 15.3 | 16.3 | 17.1 | 17.5 | 23 | 17.2 | 26.4 |
| 43 | 1.15 | NA | 1.33 | 1.36 | NA | 1.14 | 0.87 | 1.33 |
| 44 | 0.446 | 0.468 | 0.408 | 0.381 | 0.35 | 0.394 | 0.411 | 0.372 |
| 45 | 81 | 68 | 74 | 74 | 71.3 | 77 | 83.3 | 81 |
| 46 | 145 | 116 | 141.5 | 132.5 | 137 | 171 | 137.3 | 171 |
| 47 | 88 | 72 | 88 | 88 | 85.7 | 91 | 89 | 88 |
| 50 | 187.4 | 153 | 158.6 | 171.6 | 138.4 | 148.3 | NA | 144.7 |
| 51 | 1.55 | 2.01 | 1.69 | 1.77 | 1.18 | 1.18 | 1.34 | 1.25 |
| 61 | NA | 53 | NA | NA | 27.8 | 31.6 | NA | NA |
| 3 | 42.9 | 53.8 | 45.9 | 47.3 | 27.9 | 30.1 | 44.3 | 42.9 |
| 4 | 98.5 | NA | 113.1 | 133.1 | NA | 102.1 | 65.1 | 82.5 |
| 13 | 4129.5 | NA | 2760.3 | 4072.1 | NA | 2673 | 2377.3 | 3194.3 |
| 8 | 0.0289 | 0.0696 | 0.0524 | 0.0887 | 0.0354 | 0.0232 | 0.0517 | 0.0517 |
| 16 | 0.144 | NA | 0.205 | 0.178 | NA | NA | 0.204 | 0.146 |
| 17 | 0.109 | 0.097 | 0.147 | 0.197 | 0.108 | 0.128 | 0.179 | 0.11 |
| 23 | 0.65 | 1.33 | 0.88 | 1.87 | 0.88 | 0.58 | 1.41 | 0.57 |
| 54 | 41.8 | 64.2 | 78.5 | 67.9 | 42 | 37.7 | 55.4 | 47 |
| 55 | 0.657 | 1.128 | 1.127 | 1.376 | 0.667 | 0.605 | 0.96 | 0.924 |
| 58 | 0.263 | 0.148 | 0.249 | 0.215 | 0.146 | 0.152 | 0.167 | 0.148 |

Table 278. Provided are the values of each of the parameters (as described above) measured in maize accessions (Line). Growth conditions are specified in the experimental procedure section.

TABLE 279

Measured parameters in Maize Inbred Field B 35K per acre (lines 57-64)

| Line/Correlation ID | Line-57 | Line-58 | Line-59 | Line-60 | Line-61 | Line-62 | Line-63 | Line-64 |
|---|---|---|---|---|---|---|---|---|
| 5 | 87.5 | 78.8 | 86.4 | 76.6 | 90.1 | 93.7 | 93.6 | 57.6 |
| 9 | 100 | NA | 100 | NA | NA | NA | NA | 100 |
| 10 | 23.8 | 19.5 | 18.9 | 17.7 | 3.7 | 10.1 | 3.9 | NA |
| 24 | 4.55 | 3.19 | 4.46 | 4.39 | 3.37 | 3.96 | 4.02 | NA |
| 27 | 226.9 | 196.8 | 216.2 | 355.8 | 232.9 | 245.4 | 316.4 | NA |
| 14 | 217.3 | 186.6 | 202.7 | 352.6 | 217.6 | 239.5 | 300.8 | NA |
| 18 | 0.511 | 0.475 | 0.451 | 0.602 | 0.449 | 0.482 | 0.581 | NA |
| 35 | 8 | 7.3 | 8.7 | 8 | 11 | 9 | 2.3 | 17 |
| 36 | 60.5 | 75.4 | 84.5 | 54.9 | 92.2 | 40.4 | 43.4 | NA |
| 39 | 15.5 | 18.2 | 17.8 | 11.6 | 16.3 | 9.6 | 22 | NA |
| 40 | 1.38 | 1.78 | 2.48 | 1.84 | 2.73 | 0.43 | 3.92 | 0.27 |
| 42 | 137.5 | 163.6 | 145.8 | 147.2 | 174.9 | 154.7 | 198.7 | 56.5 |
| 48 | 0.97 | 1.87 | 0.89 | 3.92 | 4.69 | 4.71 | 5.1 | 7.76 |
| 49 | 0.294 | 0.269 | 0.331 | 0.392 | 0.429 | 0.236 | 0.408 | 0.157 |
| 41 | 12.7 | 13.3 | 13.3 | 12.7 | 12.7 | 12.2 | 12.9 | 11.5 |
| 52 | 35.5 | 37.2 | 43.4 | NA | 35.1 | NA | 43.2 | 31 |
| 53 | 727.6 | 664.8 | 688.6 | NA | 471.6 | NA | 540.6 | 458.1 |
| 56 | 335.2 | 284.5 | 280.2 | 183.6 | 334.9 | 185.8 | 168.5 | NA |
| 57 | 42.3 | 32.3 | 22.9 | 35.1 | 36 | 27.6 | 23.3 | NA |
| 59 | 15.73 | 12.49 | 9.62 | 14.05 | 15.08 | 12.46 | 11.5 | NA |
| 60 | 3.4 | 3.28 | 3.02 | 3.17 | 3.03 | 2.78 | 2.57 | NA |
| 1 | 44.8 | 46.1 | 44 | 51.3 | 55.8 | 40.7 | 43.9 | 25.6 |
| 2 | 10.2 | 14.3 | 18.6 | 12.4 | 19.6 | 5.8 | 19 | 3.8 |
| 6 | 40.1 | 42.5 | 40.7 | 49.5 | 54.1 | 36.6 | 41.5 | 21.1 |
| 7 | 10.2 | 14.3 | 18.6 | 12.4 | 19.6 | 5.8 | 19 | 3.8 |
| 20 | 4.28 | 4.65 | 4.56 | 4.61 | 4.48 | 3.87 | 4.02 | 3.27 |
| 21 | 1.58 | 1.86 | 2.09 | 1.55 | 1.96 | 1.13 | 2.09 | 0.86 |
| 11 | 3.08 | 4.6 | 3.91 | 2.71 | 3.29 | 2.43 | 6.1 | NA |
| 12 | 13 | 12.6 | 12.1 | 14.1 | 15.7 | 13.1 | 13.8 | 9.6 |
| 15 | 20.5 | 17.8 | 15.9 | 13.8 | 13.4 | 13.5 | 12.5 | 14.8 |
| 19 | 4.34 | 5.68 | 5.83 | 4.24 | 8.09 | 2.86 | 2.54 | NA |
| 22 | 1.06 | 1 | 1 | 1.12 | 1.25 | 1.12 | 1.79 | 1.19 |
| 25 | 50.8 | 60 | 51.7 | 78 | 70.3 | 62 | 78.7 | 40 |
| 26 | 56 | 67.4 | 71.1 | 54.7 | 80.2 | 34.7 | 38.4 | NA |
| 28 | 18.6 | 15.7 | 18.5 | 10.2 | 25.1 | 13.1 | 13.6 | NA |
| 29 | 0.185 | 0.232 | 0.203 | 0.063 | 0.186 | 0.091 | NA | NA |
| 30 | 14.1447 | 13.4321 | 14.0959 | 13.5207 | 12.9353 | 13.7609 | 13.5381 | 14.008 |
| 31 | 1 | 1 | 1 | 1 | 1.33 | 1 | 1 | 2 |
| 33 | 81 | 58.1 | 61.9 | 63.8 | 81 | 43.1 | 54.8 | NA |
| 32 | 21.6 | 16.3 | 16.4 | 29.5 | 18.8 | 12.3 | 11.6 | NA |
| 34 | 13.19 | 12.58 | 12.25 | 7.44 | 8.42 | 8.38 | 8.38 | NA |

TABLE 279-continued

Measured parameters in Maize Inbred Field B 35K per acre (lines 57-64)

| Line/Correlation ID | Line-57 | Line-58 | Line-59 | Line-60 | Line-61 | Line-62 | Line-63 | Line-64 |
|---|---|---|---|---|---|---|---|---|
| 37 | 14.9 | 17 | 16.3 | 16.1 | 17.7 | 18 | 16.2 | NA |
| 38 | 19.3 | 17.7 | 20.6 | 24.4 | 22.1 | 19.6 | 28 | 8.4 |
| 43 | 0.82 | 1.14 | 1.07 | 1.11 | 1.34 | 1.29 | 1.39 | 1.65 |
| 44 | 0.435 | 0.449 | 0.473 | 0.4 | 0.428 | 0.343 | 0.4 | 0.448 |
| 45 | 78.2 | 76 | 77 | 83.3 | 77 | 79 | 90 | 62 |
| 46 | 137 | 143.3 | 137.3 | 171 | 158.3 | 150 | 171 | 119 |
| 47 | 86.2 | 83.3 | 85.7 | 91.3 | 88 | 88 | 92.3 | 79 |
| 50 | 168 | 182.1 | 179.8 | 195.7 | 163.9 | 168.4 | 197.5 | 114.1 |
| 51 | 1.75 | 1.68 | 1.63 | 1.49 | 1.51 | 1.23 | 0.85 | 1.91 |
| 61 | 43.6 | 59.4 | 49.9 | NA | 35.8 | 40.2 | NA | NA |
| 3 | 39.8 | 59.6 | 47.8 | 54.9 | 31.3 | 36.7 | 49.1 | 33.4 |
| 4 | 110.7 | 106.2 | 123.7 | 82.3 | 112.1 | 87.8 | 99.6 | 115.6 |
| 13 | 2677.4 | 3096.7 | 3073.8 | 3599.3 | 3510.9 | 3018.9 | 5260 | 1699 |
| 8 | 0.0792 | 0.0627 | 0.069 | 0.078 | 0.0927 | 0.0525 | 0.0837 | 0.0169 |
| 16 | 0.422 | 0.183 | 0.314 | 0.169 | 0.286 | 0.149 | 0.14 | 0.137 |
| 17 | 0.141 | 0.134 | 0.168 | 0.166 | 0.222 | 0.135 | 0.13 | 0.104 |
| 23 | 1.64 | 0.93 | 1.37 | 0.72 | 1.17 | 0.7 | 0.7 | NA |
| 54 | 61.4 | 62.2 | 77 | 50.2 | 88.4 | 53.7 | 56 | 4.6 |
| 55 | 1.058 | 1.057 | 1.36 | 1.253 | 1.411 | 0.923 | 0.881 | 0.087 |
| 58 | 0.176 | 0.144 | 0.202 | 0.283 | 0.18 | 0.162 | 0.188 | NA |

Table 279. Provided are the values of each of the parameters (as described above) measured in maize accessions (Line). Growth conditions are specified in the experimental procedure section.

TABLE 280

Measured parameters in Maize Inbred Field B 35K per acre (lines 65-72)

| Line/Correlation ID | Line-65 | Line-66 | Line-67 | Line-68 | Line-69 | Line-70 | Line-71 | Line-72 |
|---|---|---|---|---|---|---|---|---|
| 5 | 70.2 | 89.1 | NA | 90.8 | 86 | 88.1 | 92.3 | 79.8 |
| 9 | 93.2 | NA | 97.4 | NA | NA | NA | 100 | 88.1 |
| 10 | 20.1 | 8.2 | 16.6 | 5.8 | 26.9 | 10.4 | 16.4 | 8 |
| 24 | 4.39 | NA | 4.44 | 3.52 | 4.74 | 4.31 | 2.89 | 4.87 |
| 27 | 177.6 | NA | 124.3 | 264.9 | 214.7 | 248.7 | 168.3 | 204.5 |
| 14 | 165.5 | NA | 105.2 | 253.6 | 201.2 | 222.5 | 168.7 | 185.2 |
| 18 | 0.539 | NA | 0.291 | 0.513 | 0.487 | 0.52 | 0.327 | 0.52 |
| 35 | 8.7 | 10 | 14 | 9 | 7.7 | 10.5 | 10 | 6 |
| 36 | 107.9 | NA | 107.3 | 43.8 | 107.9 | 115.6 | 34.8 | 141 |
| 39 | 15.3 | 15.5 | 23.3 | 6.6 | 17.7 | 27.2 | 7.2 | 17.7 |
| 40 | 1.54 | 0.89 | 2.29 | 0.7 | 4.02 | 2.92 | 0.42 | NA |
| 42 | 143.1 | 178.3 | 167 | 190.5 | 185.7 | 133.6 | 174.7 | NA |
| 48 | 3.59 | 4.72 | 4.2 | 6.48 | 1.26 | 5.39 | 6.58 | NA |
| 49 | 0.357 | 0.399 | 0.224 | 0.289 | 0.253 | 0.508 | 0.172 | 0.54 |
| 41 | 10.9 | 13.9 | 14.7 | 9 | 13.9 | 14.9 | 9.6 | 12 |
| 52 | 38.1 | 33 | 32.1 | 35 | 43 | 33.9 | 27.9 | NA |
| 53 | 516.5 | 575.1 | 585.6 | 438.6 | 655.3 | 558.8 | 350 | NA |
| 56 | 315.4 | NA | 301 | 170 | 352.1 | 381.1 | 161.1 | 471 |
| 57 | 24.8 | NA | 23.7 | NA | 28.5 | 34.6 | NA | 39 |
| 59 | 11.19 | NA | 12.55 | NA | 11.41 | 15.44 | NA | 15.18 |
| 60 | 2.78 | NA | 2.4 | NA | 3.19 | 2.84 | NA | 3.26 |
| 1 | 51.4 | 42.5 | 42.1 | 44.8 | 45.9 | 62.6 | 37.2 | 71.5 |
| 2 | 11.2 | 9.2 | 17.6 | 8.5 | 22.7 | 16.2 | 5.1 | NA |
| 6 | 49.7 | 36.4 | 41.5 | 42.1 | 44.7 | 61.3 | 33 | 66.1 |
| 7 | 11.2 | 9.1 | 17.3 | 8.5 | 22.7 | 15.9 | 5.1 | NA |
| 20 | 4.83 | 4.37 | 3.86 | 4.02 | 4.51 | 4.81 | 3.02 | 5.28 |
| 21 | 1.52 | 1.46 | 1.86 | 1.12 | 2.37 | 1.79 | 0.86 | NA |
| 11 | 2.95 | 4.3 | 4.78 | 1.57 | 3.26 | 5.46 | 1.68 | NA |
| 12 | 13.4 | 12.2 | 13.8 | 14.2 | 12.7 | 16.4 | 15.4 | 17.3 |
| 15 | 13.5 | 17.5 | 18.2 | 12.5 | 15.2 | 16.5 | 12.5 | NA |
| 19 | 5.65 | NA | 6.6 | 3.39 | 6.81 | 6.85 | 3.7 | 7.91 |
| 22 | 1.17 | 1.1 | 1.12 | 1 | 1.04 | 1.25 | 1.33 | 1.19 |
| 25 | 41.3 | 58.7 | 28 | 76 | 49.3 | 59 | 58.7 | 42 |
| 26 | 92.5 | NA | 75.3 | 39.9 | 94.2 | 91.1 | 38.6 | 114.5 |
| 28 | 23.3 | NA | 16.6 | 13.8 | 25.2 | 23.2 | 4 | NA |
| 29 | 0.178 | NA | 0.226 | 0.163 | 0.342 | 0.18 | NA | NA |
| 30 | 12.0589 | 15.2702 | 13.21 | 12.1509 | 13.366 | 13.943 | 12.5159 | 12.1911 |
| 31 | 1 | 1 | 1 | 1.5 | 1 | 1 | 1 | 1 |
| 33 | 57.7 | NA | 40.5 | 45.7 | 78.6 | 101 | 26.7 | 101.5 |
| 32 | 11.1 | NA | 10.3 | 17 | 30.2 | 19 | 16.8 | 23.1 |
| 34 | 9.62 | 9.96 | 9.31 | 7.25 | 10.96 | 10.94 | 11.83 | 9.62 |
| 37 | 16.9 | 18.5 | 13 | 16.4 | 16.6 | 16.9 | 11.2 | 17.7 |
| 38 | 14.6 | 17.3 | 15.2 | 18.2 | 23.7 | 20.4 | 8.9 | 15.7 |

TABLE 280-continued

Measured parameters in Maize Inbred Field B 35K per acre (lines 65-72)

| Line/<br>Correlation ID | Line-65 | Line-66 | Line-67 | Line-68 | Line-69 | Line-70 | Line-71 | Line-72 |
|---|---|---|---|---|---|---|---|---|
| 43 | 1.15 | 1.28 | 1.25 | 1.44 | 1.19 | 1.42 | 1.12 | NA |
| 44 | 0.37 | 0.461 | 0.476 | 0.346 | 0.464 | 0.531 | 0.43 | 0.356 |
| 45 | 74.7 | 78 | 74 | 79 | 78 | 74 | 79 | 68 |
| 46 | 124.7 | 146.7 | 116 | 164 | 135 | 143.5 | 147.7 | 116 |
| 47 | 83.3 | 88 | 88 | 88 | 85.7 | 84.5 | 89 | 74 |
| 50 | 155.9 | 190.8 | 173 | 116.4 | 174.5 | 222.3 | 115.9 | 171 |
| 51 | 1.53 | 1.52 | 1.89 | 1.25 | 1.73 | 2.51 | 1.06 | 1.89 |
| 61 | NA | 39.9 | NA | 46.6 | 49.2 | NA | 27.4 | 44.5 |
| 3 | 32.8 | 34.1 | 41.5 | 38.9 | 41.9 | 50.5 | 25.6 | 46 |
| 4 | 111.9 | 86.3 | 118.7 | 166.6 | 75.6 | 60.5 | 131.6 | NA |
| 13 | 2801 | 3269.6 | 2196.5 | 4430 | 2426.2 | 2805.4 | 3069 | NA |
| 8 | 0.0609 | 0.0599 | 0.0488 | 0.063 | 0.0638 | 0.1321 | 0.0369 | 0.1186 |
| 16 | 0.28 | 0.165 | 0.2 | 0.195 | 0.134 | 0.157 | 0.203 | NA |
| 17 | 0.145 | 0.141 | 0.139 | 0.168 | 0.167 | 0.174 | 0.108 | 0.138 |
| 23 | 1.45 | NA | 1.45 | 0.59 | 1.75 | 1.76 | 0.48 | 2.42 |
| 54 | 43.7 | 36.8 | 45.6 | 46.7 | 83 | 88.8 | 9.4 | 84.3 |
| 55 | 0.774 | 0.57 | 0.742 | 0.993 | 1.333 | 1.44 | 0.158 | 1.974 |
| 58 | 0.162 | NA | 0.182 | 0.223 | 0.185 | 0.196 | 0.181 | 0.182 |

Table 280. Provided are the values of each of the parameters (as described above) measured in maize accessions (Line). Growth conditions are specified in the experimental procedure section.

TABLE 281

Measured parameters in Maize Inbred Field B 35K per acre (lines 73-80)

| Line/<br>Correlation ID | Line-73 | Line-74 | Line-75 | Line-76 | Line-77 | Line-78 | Line-79 | Line-80 |
|---|---|---|---|---|---|---|---|---|
| 5 | 85.1 | 75.5 | 75.9 | 93.3 | 94.2 | 75.2 | 78.3 | 83.4 |
| 9 | NA | NA | 100 | NA | 74.2 | NA | 100 | 89.8 |
| 10 | 18.7 | 4.3 | 6.5 | 16.3 | 5.9 | 4.3 | NA | 23.8 |
| 24 | 5.47 | 3.16 | 4.08 | 3.77 | 4.99 | 3.02 | 5.43 | 5.42 |
| 27 | 250.2 | 238.7 | 224.2 | 273.4 | 244.7 | 260.6 | 169.8 | 189.1 |
| 14 | 238.1 | 222 | 213.8 | 262.2 | 208.8 | 238.8 | 160.9 | 184 |
| 18 | 0.49 | 0.477 | 0.44 | 0.551 | 0.486 | 0.525 | 0.387 | 0.409 |
| 35 | 6 | 12.7 | 14 | 9 | 9 | 10.5 | 21.3 | 15.3 |
| 36 | 41 | 76 | 83 | 15.6 | 103.4 | 77.8 | 90.1 | 57 |
| 39 | 11 | 12.9 | 18.7 | 8.1 | 19.6 | NA | NA | 11.5 |
| 40 | 0.9 | 1.15 | 0.9 | 0.18 | 1.51 | 1.14 | 0.29 | 0.75 |
| 42 | 141.4 | 204 | 239.2 | 153.1 | 137.9 | 175 | 205 | 184.8 |
| 48 | 3.38 | 2.72 | 5.56 | 2.58 | 2.15 | 5.12 | 7.39 | 5.86 |
| 49 | 0.347 | 0.341 | 0.271 | 0.253 | 0.448 | 0.286 | 0.284 | 0.551 |
| 41 | 12.2 | 14.4 | 15.7 | 12.8 | 11.5 | 15 | 14.2 | 11 |
| 52 | 33.1 | 39.8 | 32.1 | 28.2 | 41.8 | 36.4 | 28.6 | NA |
| 53 | 303.8 | 430.8 | NA | 448 | 511.1 | 505.3 | 422.8 | NA |
| 56 | 184.4 | 279.1 | 335.8 | 57.9 | 460.4 | 268.8 | 248.5 | 236.9 |
| 57 | 25.8 | 31.4 | 39.4 | 31.4 | NA | 24.2 | 24.9 | 31.3 |
| 59 | 13.24 | 14.81 | 16.69 | 13.82 | NA | 11.78 | 12.53 | 14.42 |
| 60 | 2.47 | 2.68 | 3.01 | 2.9 | NA | 2.61 | 2.5 | 2.77 |
| 1 | 34.9 | 56.6 | 56.2 | 31.8 | 66.3 | 50 | 42.8 | 51.8 |
| 2 | 9.8 | 12.5 | 8.7 | 4.4 | 15.9 | 11.7 | 6 | 12.9 |
| 6 | 33.6 | 54.1 | 52.4 | 27.4 | 62.9 | 48.3 | 39.2 | 46.5 |
| 7 | 9.7 | 12.5 | 8.6 | 4.4 | 15.8 | 11.6 | 6 | 12.9 |
| 20 | 3.4 | 4.41 | 4.14 | 3.21 | 4.48 | 4.48 | 3.8 | 4.2 |
| 21 | 1.29 | 1.49 | 1.29 | 0.91 | 1.51 | 1.3 | 0.97 | 1.7 |
| 11 | 3.72 | 3.35 | 4.08 | 2.44 | 4.83 | 7.29 | NA | 1.58 |
| 12 | 12.6 | 16.3 | 17.2 | 12.2 | 18.8 | 14.1 | 14.1 | 15.5 |
| 15 | 9.2 | 10.8 | 16.5 | 15.5 | 12.2 | 14 | 14.8 | 16.2 |
| 19 | 2.51 | 3.77 | 5.48 | 1.21 | 5.58 | 5.42 | 5.71 | 3.96 |
| 22 | 1 | 1.05 | 1 | 1 | 1 | 1 | 1.17 | 1.29 |
| 25 | 55.3 | 78.3 | 55 | 83 | 43 | 86.5 | 32.7 | 35 |
| 26 | 36.7 | 65.5 | 75.3 | 13.8 | 73.1 | 63.7 | 80 | 53.7 |
| 28 | 14.3 | 26 | 20.3 | 5.3 | 36.8 | 19.1 | 18.9 | 13.9 |
| 29 | 0.139 | 0.192 | 0.353 | 0.066 | 0.246 | 0.253 | NA | 0.067 |
| 30 | 14.6974 | 13.615 | 13.4348 | 13.7331 | 12.6121 | 15.3985 | 12.8171 | 13.6652 |
| 31 | 1.67 | 1 | 1.5 | 1 | 1.5 | 1 | 1 | 1 |
| 33 | 48.5 | 69.4 | 77.3 | 16.6 | 127.1 | 73.3 | 43.1 | 46.3 |
| 32 | 21.2 | 16.7 | 18.1 | 14.5 | 65 | 15.5 | 14.1 | 14.1 |
| 34 | 9.21 | 11.5 | 11.25 | 7.71 | 10.88 | 10.44 | NA | 10.56 |
| 37 | 12.9 | 16.4 | 18.8 | 17.1 | 15.7 | 16 | NA | 17.3 |
| 38 | 13.3 | 22.1 | 16.3 | 15.8 | 19.8 | 20.1 | 13.1 | 14.9 |
| 43 | 0.78 | 1.53 | 0.67 | 1.29 | 1.3 | 1.55 | 1.84 | 1.48 |
| 44 | 0.41 | 0.363 | 0.388 | 0.394 | 0.336 | 0.336 | 0.464 | 0.439 |

TABLE 281-continued

Measured parameters in Maize Inbred Field B 35K per acre (lines 73-80)

| Line/ Correlation ID | Line-73 | Line-74 | Line-75 | Line-76 | Line-77 | Line-78 | Line-79 | Line-80 |
|---|---|---|---|---|---|---|---|---|
| 45 | 86.3 | 75.3 | 74 | 79 | 79 | 74 | 62 | 72.7 |
| 46 | 147.7 | 166.3 | 143 | 171 | 131 | 171 | 116 | 123 |
| 47 | 92.3 | 88 | 88 | 88 | 88 | 84.5 | 83.3 | 88 |
| 50 | 182.5 | 166.3 | 171 | 158.3 | 172.3 | 168.8 | 155.1 | 143.5 |
| 51 | 1.41 | 1.47 | 1.32 | 1.4 | 1.17 | 1.52 | 2.09 | 1.46 |
| 61 | NA | 43.2 | NA | 46.4 | 41.8 | NA | NA | NA |
| 3 | 26.4 | 43.6 | 55.2 | 44 | 38.7 | 39.6 | 27.8 | 47.6 |
| 4 | 109.6 | 131.2 | 149.8 | 99.4 | 133.3 | 91.5 | 281 | 108.6 |
| 13 | 2970.7 | 3671.9 | 4255 | 2573.7 | 3613.5 | 2581.9 | 6432 | 2965.3 |
| 8 | 0.0365 | 0.0824 | 0.0757 | 0.0266 | 0.0999 | 0.0879 | 0.0518 | 0.0585 |
| 16 | 0.311 | 0.191 | 0.382 | 0.233 | 0.304 | 0.194 | 0.135 | 0.371 |
| 17 | 0.113 | 0.136 | 0.138 | 0.146 | 0.15 | 0.128 | 0.154 | 0.108 |
| 23 | 0.91 | 0.92 | 1.41 | 0.28 | 2.59 | 0.84 | 1.38 | 1.34 |
| 54 | 17.9 | 74.6 | 72.7 | 26.4 | 78.5 | 62.2 | 27.9 | 40.9 |
| 55 | 0.285 | 1.493 | 1.274 | 0.445 | 1.318 | 1.318 | 0.491 | 0.648 |
| 58 | 0.262 | 0.198 | 0.153 | 0.189 | 0.448 | 0.186 | 0.232 | 0.195 |

Table 281. Provided are the values of each of the parameters (as described above) measured in maize accessions (Line). Growth conditions are specified in the experimental procedure section.

TABLE 282

Correlation between the expression level of selected genes and the phenotypic performance across maize varieties grown in Field A 35K per acre (expression set 1-6)

| Gene Name | R | P value | Exp. set | Corr. Set ID | Gene Name | R | P value | Exp. set | Corr. Set ID |
|---|---|---|---|---|---|---|---|---|---|
| LBY244 | 0.77 | 1.24E−03 | 2 | 22 | LBY245 | 0.73 | 4.40E−03 | 1 | 27 |
| LBY245 | 0.74 | 2.66E−03 | 4 | 30 | LBY245 | 0.75 | 3.15E−02 | 6 | 60 |
| LBY245 | 0.87 | 2.60E−02 | 2 | 60 | LBY268 | 0.77 | 3.19E−03 | 5 | 33 |
| LBY268 | 0.77 | 1.42E−02 | 1 | 12 | LBY268 | 0.75 | 1.90E−03 | 3 | 1 |
| LBY268 | 0.84 | 1.54E−04 | 2 | 34 | LBY301 | 0.87 | 2.42E−05 | 6 | 24 |
| LBY301 | 0.81 | 2.34E−04 | 6 | 14 | LBY302 | 0.81 | 2.58E−03 | 5 | 53 |
| LBY302 | 0.78 | 4.22E−03 | 5 | 3 | LBY302 | 0.74 | 6.06E−03 | 5 | 54 |
| LBY302 | 0.80 | 6.20E−04 | 4 | 3 | LBY302 | 0.81 | 4.43E−04 | 4 | 50 |
| LBY302 | 0.78 | 6.86E−02 | 4 | 5 | LBY302 | 0.71 | 4.10E−03 | 3 | 7 |
| LBY302 | 0.71 | 4.45E−03 | 3 | 19 | LBY302 | 0.85 | 4.45E−04 | 2 | 10 |
| LBY302 | 0.76 | 1.61E−03 | 2 | 42 | LBY302 | 0.75 | 2.06E−03 | 2 | 38 |
| LBY323 | 0.74 | 6.44E−03 | 5 | 55 | LBY323 | 0.71 | 4.58E−03 | 3 | 1 |
| LBY323 | 0.76 | 1.50E−03 | 2 | 25 | LBY324 | 0.73 | 2.80E−03 | 3 | 26 |
| LBY324 | 0.70 | 4.88E−03 | 3 | 42 | LBY324 | 0.74 | 2.50E−03 | 3 | 48 |
| LBY325 | 0.79 | 3.86E−03 | 5 | 18 | LBY325 | 0.70 | 1.09E−02 | 4 | 4 |
| LBY325 | 0.79 | 8.18E−04 | 4 | 37 | LBY325 | 0.72 | 4.02E−03 | 4 | 47 |
| LBY325 | 0.73 | 3.34E−03 | 3 | 52 | LBY325 | 0.88 | 3.96E−05 | 3 | 17 |
| LBY325 | 0.80 | 5.64E−04 | 3 | 34 | LBY325 | 0.72 | 3.63E−03 | 3 | 25 |
| LBY325 | 0.72 | 3.86E−03 | 2 | 55 | LBY326 | 0.73 | 1.86E−03 | 6 | 48 |
| LBY327 | 0.75 | 7.47E−03 | 5 | 39 | LBY327 | 0.75 | 7.55E−03 | 5 | 43 |
| LBY327 | 0.80 | 1.80E−03 | 5 | 55 | LBY327 | 0.72 | 5.22E−03 | 1 | 53 |
| LBY327 | 0.79 | 1.38E−03 | 1 | 54 | LBY327 | 0.80 | 5.66E−04 | 4 | 55 |
| LBY327 | 0.78 | 8.93E−04 | 3 | 2 | LBY328 | 0.70 | 5.24E−02 | 6 | 60 |
| LBY328 | 0.72 | 3.65E−03 | 2 | 17 | LBY373 | 0.74 | 2.24E−03 | 4 | 61 |
| LBY373 | 0.71 | 4.63E−03 | 4 | 41 | LBY373 | 0.71 | 3.07E−03 | 6 | 51 |
| LBY374 | 0.76 | 7.08E−03 | 4 | 10 | LBY374 | 0.70 | 5.18E−03 | 4 | 50 |
| LBY374 | 0.76 | 1.55E−03 | 3 | 21 | LBY374 | 0.82 | 7.24E−03 | 3 | 11 |
| LBY375 | 0.70 | 1.12E−02 | 5 | 46 | LBY423 | 0.81 | 8.47E−04 | 1 | 31 |
| LBY423 | 0.77 | 2.16E−03 | 1 | 37 | LBY423 | 0.84 | 3.47E−04 | 1 | 47 |
| LBY423 | 0.86 | 2.76E−02 | 4 | 5 | LBY423 | 0.85 | 3.33E−02 | 2 | 60 |
| LBY423 | 0.71 | 4.63E−03 | 2 | 34 | LBY423 | 0.74 | 2.62E−03 | 2 | 40 |
| LBY423 | 0.74 | 2.56E−03 | 2 | 25 | LBY424 | 0.72 | 1.18E−02 | 5 | 58 |
| LBY424 | 0.74 | 1.48E−03 | 6 | 34 | LBY424 | 0.80 | 1.04E−02 | 3 | 10 |
| LBY427 | 0.71 | 4.75E−02 | 5 | 60 | LBY427 | 0.73 | 4.68E−03 | 1 | 41 |
| LGA10 | 0.82 | 3.53E−04 | 3 | 37 | LGA10 | 0.71 | 4.84E−03 | 3 | 47 |
| LGA10 | 0.72 | 3.87E−03 | 2 | 59 | LYD959 | 0.73 | 3.25E−03 | 4 | 2 |
| LYD959 | 0.70 | 3.40E−03 | 6 | 24 | | | | | |

Table 282. Provided are the correlations (R) between the genes expression levels in various tissues and the phenotypic performance.
"Corr. ID"—correlation set ID according to the correlated parameters specified in Table 255.
"Exp. Set"—Expression set specified in Table 253.
"R" = Pearson correlation coefficient;
"P" = p value

TABLE 283

Correlation between the expression level of selected genes and the phenotypic performance across maize varieties grown in Field A 35K per acre (expression set 7)

| Gene Name | R | P value | Exp. set | Corr. Set ID | Gene Name | R | P value | Exp. set | Corr. Set ID |
|---|---|---|---|---|---|---|---|---|---|
| LBY268 | 0.77 | 5.49E−04 | 1 | 29 | LBY302 | 0.72 | 4.56E−04 | 1 | 22 |
| LBY302 | 0.73 | 6.48E−04 | 1 | 36 | LBY302 | 0.70 | 8.02E−04 | 1 | 15 |
| LBY424 | 0.74 | 3.19E−04 | 1 | 25 | | | | | |

Table 283. Provided are the correlations (R) between the genes expression levels in various tissues and the phenotypic performance.
"Corr. ID"—correlation set ID according to the correlated parameters specified in Table 255.
"Exp. Set"—Expression set specified in Table 253.
"R" = Pearson correlation coefficient;
"P" = p value

TABLE 284

Correlation between the expression level of selected genes and the phenotypic performance across maize varieties grown in Field B 35K per acre

| Gene Name | R | P value | Exp. set | Corr. Set ID | Gene Name | R | P value | Exp. set | Corr. Set ID |
|---|---|---|---|---|---|---|---|---|---|
| LBY244 | 0.85 | 3.46E−03 | 2 | 8 | LBY244 | 0.78 | 1.26E−02 | 2 | 4 |
| LBY244 | 0.76 | 4.70E−02 | 2 | 52 | LBY244 | 0.91 | 1.99E−03 | 2 | 33 |
| LBY244 | 0.71 | 3.31E−02 | 2 | 30 | LBY244 | 0.91 | 7.47E−04 | 2 | 6 |
| LBY244 | 0.89 | 1.17E−03 | 2 | 55 | LBY244 | 0.82 | 6.72E−03 | 2 | 54 |
| LBY244 | 0.81 | 7.87E−03 | 2 | 1 | LBY244 | 0.87 | 4.80E−03 | 2 | 23 |
| LBY244 | 0.91 | 1.96E−03 | 2 | 56 | LBY244 | 0.89 | 2.75E−03 | 2 | 28 |
| LBY244 | 0.71 | 1.14E−01 | 1 | 33 | LBY244 | 0.72 | 1.06E−01 | 1 | 12 |
| LBY244 | 0.86 | 2.77E−02 | 1 | 22 | LBY244 | 0.86 | 2.68E−02 | 1 | 56 |
| LBY244 | 0.79 | 1.18E−02 | 3 | 24 | LBY244 | 0.83 | 5.19E−03 | 3 | 32 |
| LBY244 | 0.76 | 1.71E−02 | 3 | 23 | LBY244 | 0.72 | 3.42E−03 | 5 | 24 |
| LBY244 | 0.81 | 8.55E−03 | 5 | 61 | LBY245 | 0.79 | 5.94E−02 | 2 | 60 |
| LBY245 | 0.76 | 4.82E−02 | 2 | 53 | LBY245 | 0.80 | 9.91E−03 | 2 | 3 |
| LBY245 | 0.74 | 9.35E−02 | 2 | 61 | LBY245 | 0.77 | 1.43E−02 | 2 | 34 |
| LBY245 | 0.76 | 7.65E−02 | 1 | 19 | LBY245 | 0.71 | 1.16E−01 | 1 | 26 |
| LBY245 | 0.79 | 6.10E−02 | 1 | 17 | LBY245 | 0.75 | 8.77E−02 | 1 | 25 |
| LBY245 | 0.73 | 6.91E−03 | 4 | 50 | LBY268 | 0.76 | 1.83E−02 | 2 | 47 |
| LBY268 | 0.75 | 2.03E−02 | 2 | 48 | LBY268 | 0.87 | 2.05E−03 | 2 | 37 |
| LBY268 | 0.78 | 4.83E−03 | 6 | 40 | LBY268 | 0.77 | 7.58E−02 | 1 | 47 |
| LBY268 | 0.73 | 1.03E−01 | 1 | 44 | LBY268 | 0.78 | 6.81E−02 | 1 | 35 |
| LBY268 | 0.72 | 4.51E−02 | 3 | 60 | LBY268 | 0.76 | 8.18E−02 | 3 | 28 |
| LBY301 | 0.89 | 3.74E−05 | 6 | 32 | LBY301 | 0.87 | 9.31E−05 | 6 | 58 |
| LBY301 | 0.74 | 9.32E−02 | 1 | 42 | LBY301 | 0.71 | 1.16E−01 | 1 | 50 |
| LBY301 | 0.74 | 9.10E−02 | 1 | 31 | LBY301 | 0.84 | 3.86E−02 | 1 | 49 |
| LBY301 | 0.72 | 1.06E−01 | 1 | 58 | LBY301 | 0.95 | 3.18E−03 | 1 | 41 |
| LBY301 | 0.72 | 1.10E−01 | 1 | 27 | LBY301 | 0.87 | 4.92E−04 | 5 | 15 |
| LBY301 | 0.88 | 4.26E−03 | 5 | 53 | LBY301 | 0.74 | 9.54E−03 | 5 | 40 |
| LBY302 | 0.79 | 3.61E−02 | 2 | 53 | LBY302 | 0.77 | 1.36E−03 | 6 | 49 |
| LBY302 | 0.72 | 1.07E−01 | 1 | 33 | LBY302 | 0.71 | 1.17E−01 | 1 | 49 |
| LBY302 | 0.74 | 9.29E−02 | 1 | 20 | LBY302 | 0.84 | 3.62E−02 | 1 | 18 |
| LBY302 | 0.77 | 7.13E−02 | 1 | 27 | LBY302 | 0.71 | 2.27E−02 | 3 | 6 |
| LBY302 | 0.74 | 1.52E−02 | 3 | 12 | LBY302 | 0.77 | 2.62E−02 | 4 | 9 |
| LBY323 | 0.78 | 1.37E−02 | 2 | 47 | LBY323 | 0.81 | 7.63E−03 | 2 | 5 |
| LBY323 | 0.79 | 1.21E−02 | 2 | 43 | LBY323 | 0.84 | 9.39E−03 | 2 | 58 |
| LBY323 | 0.89 | 5.41E−05 | 6 | 32 | LBY323 | 0.90 | 2.55E−05 | 6 | 58 |
| LBY323 | 0.76 | 8.01E−02 | 1 | 11 | LBY323 | 0.85 | 3.18E−02 | 1 | 22 |
| LBY323 | 0.82 | 4.72E−02 | 1 | 39 | LBY323 | 0.82 | 4.65E−02 | 1 | 35 |
| LBY323 | 0.74 | 5.81E−02 | 3 | 15 | LBY323 | 0.71 | 4.26E−03 | 5 | 58 |
| LBY324 | 0.86 | 2.66E−02 | 1 | 25 | LBY324 | 0.75 | 8.92E−02 | 1 | 20 |
| LBY324 | 0.90 | 1.52E−02 | 1 | 46 | LBY324 | 0.73 | 1.56E−02 | 3 | 51 |
| LBY324 | 0.80 | 9.49E−03 | 3 | 26 | LBY324 | 0.81 | 7.73E−03 | 3 | 36 |
| LBY324 | 0.77 | 9.69E−03 | 3 | 55 | LBY324 | 0.70 | 2.33E−02 | 3 | 3 |
| LBY324 | 0.83 | 3.04E−03 | 3 | 34 | LBY324 | 0.78 | 1.41E−02 | 3 | 56 |
| LBY324 | 0.71 | 1.15E−01 | 3 | 28 | LBY324 | 0.78 | 5.86E−04 | 5 | 51 |
| LBY324 | 0.78 | 5.47E−04 | 5 | 34 | LBY324 | 0.78 | 1.83E−03 | 4 | 20 |
| LBY324 | 0.71 | 6.10E−03 | 4 | 39 | LBY324 | 0.74 | 2.23E−02 | 2 | 8 |
| LBY325 | 0.84 | 4.48E−03 | 2 | 11 | LBY325 | 0.81 | 7.65E−03 | 2 | 4 |
| LBY325 | 0.80 | 1.00E−02 | 2 | 39 | LBY325 | 0.92 | 9.70E−03 | 1 | 22 |
| LBY325 | 0.78 | 6.72E−02 | 1 | 56 | LBY325 | 0.72 | 1.10E−01 | 1 | 35 |
| LBY325 | 0.75 | 1.91E−02 | 3 | 41 | LBY326 | 0.81 | 1.50E−02 | 2 | 58 |
| LBY326 | 0.76 | 7.92E−02 | 1 | 49 | LBY327 | 0.82 | 6.53E−03 | 2 | 2 |
| LBY327 | 0.82 | 6.97E−03 | 2 | 7 | LBY327 | 0.90 | 1.10E−03 | 2 | 21 |
| LBY327 | 0.87 | 2.20E−03 | 2 | 40 | LBY327 | 0.74 | 2.53E−03 | 6 | 43 |
| LBY327 | 0.71 | 1.13E−01 | 1 | 2 | LBY327 | 0.71 | 1.15E−01 | 1 | 7 |
| LBY327 | 0.77 | 9.64E−03 | 3 | 30 | LBY327 | 0.79 | 6.46E−03 | 3 | 3 |

TABLE 284-continued

Correlation between the expression level of selected genes and the phenotypic performance across maize varieties grown in Field B 35K per acre

| Gene Name | R | P value | Exp. set | Corr. Set ID | Gene Name | R | P value | Exp. set | Corr. Set ID |
|---|---|---|---|---|---|---|---|---|---|
| LBY327 | 0.77 | 4.46E−02 | 3 | 40 | LBY327 | 0.88 | 4.00E−03 | 4 | 9 |
| LBY328 | 0.98 | 5.72E−04 | 1 | 22 | LBY328 | 0.75 | 1.99E−02 | 3 | 27 |
| LBY329 | 0.82 | 7.13E−03 | 2 | 43 | LBY329 | 0.72 | 2.96E−02 | 2 | 22 |
| LBY329 | 0.89 | 1.28E−03 | 2 | 35 | LBY329 | 0.90 | 2.35E−05 | 6 | 32 |
| LBY329 | 0.84 | 2.79E−04 | 6 | 58 | LBY373 | 0.80 | 5.54E−02 | 1 | 11 |
| LBY373 | 0.79 | 5.97E−02 | 1 | 19 | LBY373 | 0.92 | 9.91E−03 | 1 | 39 |
| LBY373 | 0.80 | 5.14E−03 | 3 | 42 | LBY373 | 0.78 | 3.70E−02 | 3 | 15 |
| LBY373 | 0.74 | 1.41E−02 | 3 | 5 | LBY373 | 0.74 | 1.47E−02 | 3 | 2 |
| LBY373 | 0.76 | 9.96E−03 | 3 | 44 | LBY373 | 0.74 | 1.49E−02 | 3 | 7 |
| LBY373 | 0.77 | 8.93E−03 | 3 | 21 | LBY374 | 0.75 | 8.40E−02 | 1 | 22 |
| LBY374 | 0.82 | 4.75E−02 | 1 | 56 | LBY374 | 0.74 | 3.63E−03 | 4 | 31 |
| LBY374 | 0.71 | 2.23E−02 | 4 | 28 | LBY375 | 0.73 | 1.00E−01 | 2 | 57 |
| LBY375 | 0.71 | 3.28E−02 | 2 | 39 | LBY375 | 0.78 | 6.68E−02 | 1 | 8 |
| LBY375 | 0.75 | 8.84E−02 | 1 | 26 | LBY375 | 0.75 | 8.72E−02 | 1 | 33 |
| LBY375 | 0.87 | 2.53E−02 | 1 | 36 | LBY375 | 0.78 | 7.01E−02 | 1 | 55 |
| LBY375 | 0.80 | 5.75E−02 | 1 | 12 | LBY375 | 0.75 | 8.57E−02 | 1 | 54 |
| LBY375 | 0.90 | 1.58E−02 | 1 | 56 | LBY375 | 0.76 | 4.75E−02 | 4 | 61 |
| LBY423 | 0.73 | 2.63E−02 | 2 | 22 | LBY423 | 0.83 | 3.89E−02 | 1 | 42 |
| LBY423 | 0.72 | 1.04E−01 | 1 | 50 | LBY423 | 0.87 | 2.54E−02 | 1 | 31 |
| LBY423 | 0.72 | 1.04E−01 | 1 | 44 | LBY423 | 0.94 | 5.91E−03 | 1 | 38 |
| LBY423 | 0.71 | 1.11E−01 | 1 | 45 | LBY423 | 0.73 | 1.66E−02 | 3 | 42 |
| LBY423 | 0.76 | 4.58E−02 | 3 | 15 | LBY423 | 0.71 | 2.04E−02 | 3 | 3 |
| LBY423 | 0.76 | 2.87E−02 | 5 | 9 | LBY424 | 0.74 | 3.43E−02 | 2 | 14 |
| LBY424 | 0.82 | 6.20E−03 | 2 | 45 | LBY424 | 0.74 | 2.23E−02 | 2 | 46 |
| LBY424 | 0.84 | 9.10E−03 | 2 | 18 | LBY424 | 0.80 | 1.73E−02 | 2 | 27 |
| LBY424 | 0.93 | 6.38E−03 | 1 | 47 | LBY424 | 0.74 | 9.58E−02 | 1 | 42 |
| LBY424 | 0.71 | 1.11E−01 | 1 | 50 | LBY424 | 0.75 | 8.69E−02 | 1 | 31 |
| LBY424 | 0.87 | 2.45E−02 | 1 | 38 | LBY424 | 0.77 | 1.49E−02 | 3 | 41 |
| LBY426 | 0.80 | 1.73E−02 | 2 | 19 | LBY426 | 0.72 | 4.26E−02 | 2 | 26 |
| LBY426 | 0.72 | 2.76E−02 | 2 | 3 | LBY426 | 0.76 | 8.07E−02 | 2 | 61 |
| LBY426 | 0.74 | 4.10E−03 | 6 | 32 | LBY426 | 0.96 | 2.14E−03 | 1 | 10 |
| LBY426 | 0.83 | 3.87E−02 | 1 | 13 | LBY426 | 0.87 | 2.59E−02 | 1 | 42 |
| LBY426 | 0.70 | 1.18E−01 | 1 | 2 | LBY426 | 0.90 | 1.40E−02 | 1 | 31 |
| LBY426 | 0.73 | 1.03E−01 | 1 | 38 | LBY426 | 0.76 | 7.88E−02 | 1 | 14 |
| LBY426 | 0.91 | 1.19E−02 | 1 | 45 | LBY426 | 0.71 | 1.16E−01 | 1 | 7 |
| LBY426 | 0.79 | 2.10E−02 | 3 | 60 | LBY426 | 0.76 | 7.68E−02 | 3 | 28 |
| LBY426 | 0.75 | 5.23E−02 | 3 | 40 | LBY427 | 0.81 | 1.44E−02 | 2 | 32 |
| LGA10 | 0.89 | 1.79E−02 | 1 | 13 | LGA10 | 0.83 | 4.16E−02 | 1 | 26 |
| LGA10 | 0.75 | 8.46E−02 | 1 | 42 | LGA10 | 0.89 | 1.90E−02 | 1 | 17 |
| LGA10 | 0.74 | 8.97E−02 | 1 | 50 | LGA10 | 0.75 | 8.56E−02 | 1 | 36 |
| LGA10 | 0.87 | 2.40E−02 | 1 | 49 | LGA10 | 0.90 | 1.52E−02 | 1 | 14 |
| LGA10 | 0.74 | 9.19E−02 | 1 | 41 | LGA10 | 0.73 | 1.02E−01 | 1 | 18 |
| LGA10 | 0.96 | 2.89E−03 | 1 | 27 | LGA10 | 0.87 | 4.84E−03 | 5 | 52 |
| LYD959 | 0.85 | 2.60E−04 | 6 | 32 | LYD959 | 0.82 | 5.29E−04 | 6 | 58 |
| LYD959 | 0.82 | 4.44E−02 | 1 | 22 | LYD959 | 0.79 | 6.24E−02 | 1 | 39 |
| LYD959 | 0.75 | 8.88E−02 | 1 | 56 | LYD959 | 0.70 | 7.65E−03 | 5 | 60 |
| MGP50 | 0.70 | 7.26E−03 | 6 | 19 | MGP50 | 0.70 | 1.20E−01 | 1 | 20 |
| MGP50 | 0.70 | 1.20E−01 | 1 | 21 | | | | | |

Table 284. Provided correlations (R) between the genes expression levels in various tissues and the phenotypic performance.
"Corr. ID"—correlation set ID according to the correlated parameters specified in Table 256.
"Exp. Set"—Expression set specified in Table 254.
"R" = Pearson correlation coefficient;
"P" = p value Example 23

Identifying Genes which Improve Yield and Agronomical Important Traits in Plants The present inventors have identified polynucleotides which expression thereof in plants can increase yield, fiber yield, fiber quality, growth rate, vigor, biomass, oil content, abiotic stress tolerance (ABST), fertilizer use efficiency (FUE) such as nitrogen use efficiency (NUE), and water use efficiency (WUE) of a plant, as follows.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated.

Major databases used include:

Genomes

*Arabidopsis* genome [TAIR genome version 6 (*arabidopsis* (dot) org/)];

Rice genome [IRGSP build 4.0 (rgp (dot) dna (dot) affrc (dot) go (dot) jp/IRGSP/)];

Poplar [*Populus trichocarpa* release 1.1 from JGI (assembly release v1.0) (genome (dot) jgi-psf (dot) org/)];

*Brachypodium* [JGI 4× assembly, brachpodium (dot) org)];

Soybean [DOE-JGI SCP, version GlymaO (phytozome (dot) net/)];

Grape [French-Italian Public Consortium for Grapevine Genome Characterization grapevine genome (genoscope (dot) cns (dot) fr/)];

Castobean [TIGR/J Craig Venter Institute 4× assembly [msc (dot) jcvi (dot) org/r communis];

Sorghum [DOE-JGI SCP, version Sbi1 [phytozome (dot) net/)];

Maize "B73" [DOE-JGI SCP, version AGPv2 [phytozome (dot) net/)];

Expressed EST and mRNA sequences were extracted from the following databases:

GenBank ncbi (dot) nlm (dot) nih (dot) gov/dbEST;
RefSeq (ncbi (dot) nlm (dot) nih (dot) gov/RefSeq/);
TAIR (arabidopsis (dot) org/);
Protein and pathway databases
Uniprot [uniprot (dot) org/];
AraCyc [arabidopsis (dot) org/biocyc/index (dot) jsp];
ENZYME [expasy (dot) org/enzyme/];
Microarray datasets were downloaded from:
GEO (ncbi (dot) nlm (dot) nih (dot) gov/geo/);
TAIR (Arabidopsis (dot) org/);
Proprietary microarray data (WO2008/122980);
QTL and SNPs information
Gramene [gramene (dot) org/qtl/];
Panzea [panzea (dot) org/index (dot) html];

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, and understand various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (Arabidopsis, rice, castorbean, grape, Brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

BLAST™ search [blast (dot) ncbi (dot) nlm (dot) nih (dot) gov/Blast (dot) cgi] against all plant UniProt [uniprot (dot) org/] sequences was performed. Open reading frames (ORFs) of each putative transcript were analyzed and longest ORF with highest number of homologues was selected as a predicted protein of the transcript. The predicted proteins were analyzed by InterPro [ebi (dot) ac (dot) uk/interpro/].

BLAST™ against proteins from AraCyc and ENZYME databases was used to map the predicted transcripts to AraCyc pathways.

Predicted proteins from different species were compared using BLAST™ algorithm [ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the expressed sequence tag (EST) sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomeic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [icugi (dot) org/] confirmed the accuracy of the sequencing and assembly. Expression patterns of selected genes fitted well their qRT-PCR data.

The genes listed in Table 285 below were identified to have a major impact on plant yield, fiber yield, fiber quality, growth rate, photosynthetic capacity, vigor, biomass, growth rate, oil content, abiotic stress tolerance, nitrogen use efficiency, water use efficiency and/or fertilizer use efficiency when expression thereof is increased in plants. The identified genes, their curated polynucleotide and polypeptide sequences, their updated sequences according to GenBank database and the sequences of the cloned genes and proteins are summarized in Table 285, herein below.

TABLE 285

Identified genes for increasing yield, growth rate, vigor, biomass, oil content, fiber yield, fiber quality, photosynthetic capacity, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| CT4 | cotton\|11v1\|BE053180 | cotton | 40 | 15824 |
| LBY235 | barley\|12v1\|AJ462011 | barley | 41 | 15825 |
| LBY236 | barley\|12v1\|AJ476274 | barley | 42 | 15826 |
| LBY237 | barley\|12v1\|AV833308 | barley | 11141 | 25610 |
| LBY238 | barley\|12v1\|BE060638 | barley | 43 | 15827 |
| LBY240 | barley\|12v1\|BI948517 | barley | 44 | 15828 |
| LBY242 | barley\|12v1\|BQ658069 | barley | 45 | 15829 |
| LBY243 | foxtail_millet\|14v1\|JK602708 | foxtail_millet | 46 | 15830 |
| LBY244 | maize\|13v2\|AI665908 | maize | 11142 | 25611 |
| LBY245 | maize\|13v2\|AW191119 | maize | 47 | 15831 |
| LBY246 | rice\|13v2\|AA750560 | rice | 48 | 15832 |
| LBY247 | rice\|13v2\|AA753389 | rice | 49 | 15833 |
| LBY248 | rice\|13v2\|AA754659 | rice | 50 | 15834 |
| LBY249 | rice\|13v2\|AU062716 | rice | 51 | 15835 |
| LBY250 | rice\|13v2\|AU068856 | rice | 52 | 15836 |
| LBY252 | rice\|13v2\|BE039642 | rice | 53 | 15837 |
| LBY253 | rice\|13v2\|BE229796 | rice | 54 | 15838 |
| LBY254 | rice\|13v2\|BI796293 | rice | 55 | 15839 |
| LBY255 | rice\|13v2\|BI804892 | rice | 56 | 15840 |
| LBY257 | *sorghum*\|13v2\|BF481585 | *sorghum* | 57 | 15841 |
| LBY258 | *sorghum*\|13v2\|BG049701 | *sorghum* | 58 | 15842 |
| LBY259 | *sorghum*\|13v2\|CN143093 | *sorghum* | 59 | 15843 |
| LBY260 | *sorghum*\|13v2\|XM_002453517 | *sorghum* | 60 | 15844 |
| LBY261 | barley\|12v1\|AJ484638 | barley | 61 | 15845 |
| LBY262 | barley\|12v1\|BF263219 | barley | 62 | 15846 |
| LBY263 | barley\|12v1\|BI960469 | barley | 63 | 15847 |
| LBY264 | bean\|13v1\|CA899645 | bean | 64 | 15848 |
| LBY266 | foxtail_millet\|14v1\|JK573702 | foxtail_millet | 65 | 15849 |
| LBY267 | foxtail_millet\|14v1\|XM_004979279 | foxtail_millet | 66 | 15850 |
| LBY268 | maize\|13v2\|AI987266 | maize | 67 | 15851 |
| LBY269 | rice\|13v2\|AA750068 | rice | 68 | 15852 |
| LBY270 | rice\|13v2\|AA752719 | rice | 69 | 15853 |
| LBY271 | rice\|13v2\|AU225160 | rice | 70 | 15854 |
| LBY272 | rice\|13v2\|BI797474 | rice | 71 | 15855 |
| LBY274 | rice\|13v2\|CA753935 | rice | 72 | 15856 |
| LBY275 | rice\|13v2\|CA755416 | rice | 73 | 15857 |
| LBY277 | rice\|13v2\|CI030150 | rice | 74 | 15858 |
| LBY278 | *sorghum*\|13v2\|AW283660 | *sorghum* | 75 | 15859 |
| LBY279 | *sorghum*\|13v2\|AW283746 | *sorghum* | 76 | 15860 |
| LBY280 | *sorghum*\|13v2\|BG947019 | *sorghum* | 77 | 15861 |
| LBY281 | *sorghum*\|13v2\|XM_002444577 | *sorghum* | 78 | 15862 |
| LBY282 | sunflower\|12v1\|CD851503 | sunflower | 79 | 15863 |
| LBY283 | sunflower\|12v1\|CD851889 | sunflower | 80 | 15864 |
| LBY286 | tomato\|13v1\|BG139684 | tomato | 81 | 15865 |
| LBY287 | wheat\|12v3\|BF482302 | wheat | 82 | 15866 |
| LBY288 | wheat\|12v3\|BU100413 | wheat | 83 | 15867 |
| LBY289 | barley\|12v1\|AV916879 | barley | 84 | 15868 |
| LBY290 | foxtail_millet\|14v1\|EC612636 | foxtail_millet | 85 | 15869 |
| LBY291 | foxtail_millet\|14v1\|EC613252 | foxtail_millet | 86 | 15870 |
| LBY292 | foxtail_millet\|14v1\|JK559081 | foxtail_millet | 87 | 15871 |
| LBY293 | foxtail_millet\|14v1\|JK580738 | foxtail_millet | 88 | 15872 |
| LBY294 | foxtail_millet\|14v1\|JK588337 | foxtail_millet | 89 | 15873 |
| LBY295 | foxtail_millet\|14v1\|JK605292 | foxtail_millet | 90 | 15874 |
| LBY296 | foxtail_millet\|14v1\|XM_004961542 | foxtail_millet | 91 | 15875 |
| LBY297 | foxtail_millet\|14v1\|XM_004970153 | foxtail_millet | 92 | 15876 |
| LBY298 | foxtail_millet\|14v1\|XM_004978767 | foxtail_millet | 93 | 15877 |
| LBY299 | foxtail_millet\|14v1\|XM_004979600 | foxtail_millet | 94 | 15878 |
| LBY300 | foxtail_millet\|14v1\|XM_004986270 | foxtail_millet | 95 | 15879 |
| LBY301 | maize\|13v2\|BE638641 | maize | 96 | 15880 |
| LBY302 | maize\|13v2\|W21644 | maize | 97 | 15881 |
| LBY303 | rice\|13v2\|AU092356 | rice | 98 | 15882 |
| LBY304 | rice\|13v2\|BX900598 | rice | 99 | 15883 |
| LBY305 | *sorghum*\|13v2\|BE355687 | *sorghum* | 100 | 15884 |
| LBY306 | *sorghum*\|13v2\|BE361087 | *sorghum* | 101 | 15885 |
| LBY307 | *sorghum*\|13v2\|BI211887 | *sorghum* | 102 | 15886 |
| LBY308 | *sorghum*\|13v2\|CD207978 | *sorghum* | 103 | 15887 |
| LBY309 | *sorghum*\|13v2\|CN125922 | *sorghum* | 104 | 15888 |
| LBY310 | tomato\|13v1\|BG128731 | tomato | 105 | 15889 |
| LBY311 | *arabidopsis*\|13v2\|AT3G50830 | *arabidopsis* | 106 | 15890 |
| LBY312 | barley\|12v1\|BE412795 | barley | 107 | 15891 |

TABLE 285-continued

Identified genes for increasing yield, growth rate, vigor, biomass, oil content, fiber yield, fiber quality, photosynthetic capacity, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LBY317 | foxtail_millet\|14v1\|JK553669 | foxtail_millet | 108 | 15892 |
| LBY318 | foxtail_millet\|14v1\|JK553924 | foxtail_millet | 109 | 15893 |
| LBY319 | foxtail_millet\|14v1\|JK589442 | foxtail_millet | 110 | 15894 |
| LBY320 | foxtail_millet\|14v1\|XM_004957430 | foxtail_millet | 111 | 15895 |
| LBY321 | foxtail_millet\|14v1\|XM_004963003 | foxtail_millet | 112 | 15896 |
| LBY322 | foxtail_millet\|14v1\|XM_004976944 | foxtail_millet | 113 | 15897 |
| LBY323 | maize\|13v2\|AA979903 | maize | 114 | 15898 |
| LBY324 | maize\|13v2\|AI600752 | maize | 115 | 15899 |
| LBY325 | maize\|13v2\|AI861278 | maize | 116 | 15900 |
| LBY326 | maize\|13v2\|AW225035 | maize | 117 | 15901 |
| LBY327 | maize\|13v2\|AW282379 | maize | 118 | 15902 |
| LBY328 | maize\|13v2\|CB603969 | maize | 119 | 15903 |
| LBY329 | maize\|13v2\|CB833980 | maize | 120 | 15904 |
| LBY330 | rice\|13v2\|AU069889 | rice | 121 | 15905 |
| LBY331 | rice\|13v2\|BE229018 | rice | 122 | 15906 |
| LBY332 | rice\|13v2\|BI799164 | rice | 123 | 15907 |
| LBY335 | rice\|13v2\|CB213982 | rice | 124 | 15908 |
| LBY336 | rice\|13v2\|CF955116 | rice | 125 | 15909 |
| LBY338 | sorghum\|13v2\|AI724143 | sorghum | 126 | 15910 |
| LBY339 | sorghum\|13v2\|AW283732 | sorghum | 127 | 15911 |
| LBY340 | sorghum\|13v2\|AW284284 | sorghum | 128 | 15912 |
| LBY341 | sorghum\|13v2\|AW285511 | sorghum | 129 | 15913 |
| LBY342 | sorghum\|13v2\|AW672316 | sorghum | 130 | 15914 |
| LBY343 | sorghum\|13v2\|AW746362 | sorghum | 131 | 15915 |
| LBY344 | sorghum\|13v2\|AW922257 | sorghum | 132 | 15916 |
| LBY346 | sorghum\|13v2\|BF422042 | sorghum | 133 | 15917 |
| LBY348 | sorghum\|13v2\|BG356747 | sorghum | 134 | 15918 |
| LBY349 | sorghum\|13v2\|BG462895 | sorghum | 135 | 15919 |
| LBY350 | sorghum\|13v2\|BG465007 | sorghum | 136 | 15920 |
| LBY352 | sorghum\|13v2\|CB928238 | sorghum | 137 | 15921 |
| LBY353 | sorghum\|13v2\|CF428020 | sorghum | 138 | 15922 |
| LBY354 | sorghum\|13v2\|CF483233 | sorghum | 139 | 15923 |
| LBY355 | wheat\|12v3\|BE413715 | wheat | 140 | 15924 |
| LBY356 | wheat\|12v3\|BE415294 | wheat | 141 | 15925 |
| LBY357 | wheat\|12v3\|BE426455 | wheat | 142 | 15926 |
| LBY358 | wheat\|12v3\|CA623138 | wheat | 11143 | 23574 |
| LBY359 | wheat\|12v3\|CD453459 | wheat | 143 | 15927 |
| LBY362 | arabidopsis\|13v2\|AT3G25100 | arabidopsis | 144 | 15928 |
| LBY363 | barley\|12v1\|BF625578 | barley | 11144 | 23575 |
| LBY364 | barley\|12v1\|BQ764284 | barley | 145 | 15929 |
| LBY366 | brachypodium\|14v1\|GT803301 | brachypodium | 146 | 15930 |
| LBY368 | foxtail_millet\|14v1\|JK550519 | foxtail_millet | 11145 | 23576 |
| LBY369 | foxtail_millet\|14v1\|JK558576 | foxtail_millet | 147 | 15931 |
| LBY371 | foxtail_millet\|14v1\|XM_004953852 | foxtail_millet | 11146 | 23577 |
| LBY373 | maize\|13v2\|CA400965 | maize | 148 | 15932 |
| LBY374 | maize\|13v2\|CF048378 | maize | 149 | 15933 |
| LBY375 | maize\|13v2\|SRR014549X146659 | maize | 11147 | 23578 |
| LBY376 | rice\|13v2\|AU166317 | rice | 150 | 15934 |
| LBY377 | rice\|13v2\|BE229579 | rice | 151 | 15935 |
| LBY378 | rice\|13v2\|BI809352 | rice | 11148 | 23579 |
| LBY379 | rice\|13v2\|CA766396 | rice | 152 | 15936 |
| LBY380 | rice\|13v2\|CF307015 | rice | 153 | 15937 |
| LBY382 | sorghum\|13v2\|AW283017 | sorghum | 154 | 15938 |
| LBY383 | sorghum\|13v2\|AW284853 | sorghum | 155 | 15939 |
| LBY384 | sorghum\|13v2\|AW286415 | sorghum | 156 | 15940 |
| LBY385 | sorghum\|13v2\|BE364054 | sorghum | 157 | 15941 |
| LBY387 | sorghum\|13v2\|BG322840 | sorghum | 158 | 15942 |
| LBY388 | sorghum\|13v2\|BG412574 | sorghum | 159 | 15943 |
| LBY389 | sorghum\|13v2\|BG560090 | sorghum | 160 | 15944 |
| LBY392 | sorghum\|13v2\|DR831433 | sorghum | 161 | 15945 |
| LBY393 | sorghum\|13v2\|XM_002449979 | sorghum | 11149 | 23580 |
| LBY394 | sorghum\|13v2\|XM_002456612 | sorghum | 162 | 15946 |
| LBY396 | sorghum\|13v2\|XM_002463545 | sorghum | 163 | 15947 |
| LBY398 | soybean\|13v2\|GLYMA08G05070 | soybean | 164 | 15948 |
| LBY400 | soybean\|13v2\|GLYMA11G11651 | soybean | 165 | 15949 |
| LBY401 | soybean\|13v2\|GLYMA19G45290T2 | soybean | 166 | 15950 |
| LBY402 | sunflower\|12v1\|CD852931 | sunflower | 167 | 15951 |
| LBY404 | tomato\|13v1\|BG128054 | tomato | 168 | 15952 |
| LBY405 | tomato\|13v1\|BG628602 | tomato | 169 | 15953 |
| LBY406 | tomato\|13v1\|BG734763 | tomato | 170 | 15954 |
| LBY407 | tomato\|13v1\|SRR027939.169954 | tomato | 171 | 15955 |
| LBY408 | barley\|12v1\|AV833691 | barley | 172 | 15956 |
| LBY409 | barley\|12v1\|BI948054 | barley | 173 | 15957 |

TABLE 285-continued

Identified genes for increasing yield, growth rate, vigor, biomass, oil content, fiber yield, fiber quality, photosynthetic capacity, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
| --- | --- | --- | --- | --- |
| LBY410 | bean|13v1|CA896567 | bean | 174 | 15958 |
| LBY412 | bean|13v1|CB542598 | bean | 175 | 15959 |
| LBY413 | cotton|11v1|CO107097XX1 | cotton | 11150 | 23581 |
| LBY414 | foxtail_millet|14v1|EC612103 | foxtail_millet | 176 | 15960 |
| LBY417 | foxtail_millet|14v1|JK581960 | foxtail_millet | 177 | 15961 |
| LBY418 | foxtail_millet|14v1|JK594177 | foxtail_millet | 178 | 15962 |
| LBY419 | foxtail_millet|14v1|XM_004955132 | foxtail_millet | 179 | 15963 |
| LBY421 | foxtail_millet|14v1|XM_004960769 | foxtail_millet | 180 | 15964 |
| LBY422 | gossypium_raimondii|13v1|DT561666 | gossypium_raimondii | 181 | 15965 |
| LBY423 | maize|13v2|AF256229 | maize | 182 | 15966 |
| LBY424 | maize|13v2|AI745800 | maize | 183 | 15967 |
| LBY426 | maize|13v2|BM378818 | maize | 184 | 15968 |
| LBY427 | maize|13v2|CD944714 | maize | 185 | 15969 |
| LBY428 | maize|13v2|DW973621 | maize | 186 | 15970 |
| LBY430 | rice|13v2|AA752226 | rice | 187 | 15971 |
| LBY431 | rice|13v2|AA753587 | rice | 188 | 15972 |
| LBY432 | rice|13v2|AF264730 | rice | 189 | 15973 |
| LBY433 | rice|13v2|AU070794 | rice | 190 | 15974 |
| LBY434 | rice|13v2|AU093299 | rice | 191 | 15975 |
| LBY435 | rice|13v2|BI118786 | rice | 192 | 15976 |
| LBY437 | rice|13v2|BI799994 | rice | 193 | 15977 |
| LBY438 | rice|13v2|BI805065 | rice | 194 | 15978 |
| LBY439 | rice|13v2|BI805212 | rice | 195 | 15979 |
| LBY440 | rice|13v2|CA767143 | rice | 196 | 15980 |
| LBY441 | rice|13v2|CF291351 | rice | 197 | 15981 |
| LBY442 | rice|13v2|CX119011 | rice | 198 | 15982 |
| LBY443 | rice|13v2|GFXAC113433X7 | rice | 199 | 15983 |
| LBY444 | rice|13v2|GFXAC133860X5 | rice | 200 | 15984 |
| LBY445 | rice|13v2|GFXAC145327X7 | rice | 201 | 15985 |
| LBY446 | sorghum|13v2|AW565139 | sorghum | 202 | 15986 |
| LBY447 | sorghum|13v2|BG239811 | sorghum | 11151 | 23582 |
| LBY449 | sorghum|13v2|CD432182 | sorghum | 203 | 15987 |
| LBY450 | sorghum|13v2|JGIV2SB13025338 | sorghum | 204 | 15988 |
| LBY451 | soybean|13v2|GLYMA04G00230 | soybean | 205 | 15989 |
| LBY452 | soybean|13v2|GLYMA10G35450 | soybean | 206 | 15990 |
| LBY453 | sunflower|12v1|BQ970789 | sunflower | 207 | 15991 |
| LBY454 | sunflower|12v1|CD849764 | sunflower | 208 | 15992 |
| LBY455 | sunflower|12v1|DY936896 | sunflower | 209 | 15993 |
| LBY456 | tomato|13v1|BG123156 | tomato | 210 | 15994 |
| LBY457 | tomato|13v1|BG123439 | tomato | 211 | 15995 |
| LBY458 | tomato|13v1|BG124807 | tomato | 212 | 15996 |
| LBY460 | wheat|12v3|BE423530 | wheat | 213 | 15997 |
| LBY461 | wheat|12v3|BE604053 | wheat | 214 | 15998 |
| LBY261_H1 | rice|13v2|CA854299 | rice | 215 | 15999 |
| LBY293_H1 | maize|13v2|BM032454 | maize | 216 | 16000 |
| LBY299_H1 | maize|13v2|BU037734 | maize | 217 | 16001 |
| LBY335_H3 | brachypodium|14v1|GT761083 | brachypodium | 218 | 16002 |
| LBY359_H13 | rice|15v1|AU069419 | rice | 219 | 16003 |
| LBY374_H15 | barley|15v2|AV914580 | barley | 220 | 16004 |
| LBY393_H1 | sorghum|13v2|XM_002449980 | sorghum | 11152 | 23583 |
| LGA3 | barley|12v1|BQ754002 | barley | 221 | 16005 |
| LGA10 | maize|13v2|AI619329 | maize | 11153 | 23584 |
| LGA14 | maize|13v2|BQ442014 | maize | 222 | 16006 |
| LGA15 | sorghum|13v2|AW282848 | sorghum | 223 | 16007 |
| LGA23 | sorghum|13v2|AW287192 | sorghum | 224 | 16008 |
| LGA27 | soybean|13v2|GLYMA12G04010 | soybean | 225 | 16009 |
| LGD27 | b_juncea|12v1|E6ANDIZ02JCZXW | b_juncea | 226 | 16010 |
| LGD28 | bean|12v1|CA896836 | bean | 227 | 16011 |
| LGD30 | soybean|13v2|GLYMA10G35320T2 | soybean | 228 | 16012 |
| LYD934 | medicago|13v1|BE319850 | medicago | 229 | 16013 |
| LYD935 | medicago|13v1|BQ122721 | medicago | 230 | 16014 |
| LYD936 | medicago|13v1|GFXAY553212X1 | medicago | 231 | 16015 |
| LYD937 | rice|13v2|BI306381 | rice | 232 | 16016 |
| LYD938 | rice|13v2|BI795102 | rice | 233 | 16017 |
| LYD939 | rice|13v2|BI806976 | rice | 234 | 16018 |
| LYD940 | rice|13v2|BQ909033 | rice | 235 | 16019 |
| LYD941 | rice|13v2|CK045377 | rice | 236 | 16020 |
| LYD942 | soybean|13v2|GLYMA01G39720 | soybean | 237 | 16021 |
| LYD943 | soybean|13v2|GLYMA03G31820 | soybean | 238 | 16022 |
| LYD944 | soybean|13v2|GLYMA11G18401 | soybean | 239 | 16023 |
| LYD945 | soybean|13v2|GLYMA14G10090 | soybean | 240 | 16024 |
| LYD946 | soybean|13v2|GLYMA16G02240 | soybean | 241 | 16025 |
| LYD947 | soybean|13v2|GLYMA18G36071 | soybean | 242 | 16026 |

TABLE 285-continued

Identified genes for increasing yield, growth rate, vigor, biomass, oil content, fiber yield, fiber quality, photosynthetic capacity, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYD948 | soybean\|13v2\|GLYMA19G34621 | soybean | 243 | 16027 |
| LYD949 | soybean\|13v2\|GLYMA20G34060 | soybean | 244 | 16028 |
| LYD950 | tomato\|13v1\|AI896174 | tomato | 245 | 16029 |
| LYD951 | tomato\|13v1\|BG130130 | tomato | 246 | 16030 |
| LYD952 | tomato\|13v1\|BG130808 | tomato | 247 | 16031 |
| LYD953 | tomato\|13v1\|BG642990 | tomato | 248 | 16032 |
| LYD954 | tomato\|13v1\|BI208315 | tomato | 249 | 16033 |
| LYD955 | tomato\|13v1\|SRR015436.284418 | tomato | 250 | 16034 |
| LYD956 | bean\|13v1\|CA897236 | bean | 251 | 16035 |
| LYD957 | bean\|13v1\|CA916364 | bean | 252 | 16036 |
| LYD958 | bean\|13v1\|SRR001334X115758 | bean | 253 | 16037 |
| LYD959 | maize\|13v2\|BE511599 | maize | 254 | 16038 |
| LYD960 | *medicago*\|13v1\|AA660617 | *medicago* | 255 | 16039 |
| LYD961 | *medicago*\|13v1\|AL374790 | *medicago* | 256 | 16040 |
| LYD962 | *medicago*\|13v1\|AL382060 | *medicago* | 257 | 16041 |
| LYD963 | *medicago*\|13v1\|AW329079 | *medicago* | 11154 | 23585 |
| LYD964 | *medicago*\|13v1\|AW685482 | *medicago* | 258 | 16042 |
| LYD965 | *medicago*\|13v1\|XM_003604682 | *medicago* | 259 | 16043 |
| LYD966 | rice\|13v2\|BE230448 | rice | 260 | 16044 |
| LYD967 | rice\|13v2\|BI795401 | rice | 261 | 16045 |
| LYD968 | rice\|13v2\|BI812289 | rice | 262 | 16046 |
| LYD969 | rice\|13v2\|CB684481 | rice | 263 | 16047 |
| LYD970 | rice\|13v2\|U38022 | rice | 264 | 16048 |
| LYD971 | soybean\|13v2\|GLYMA01G05540 | soybean | 265 | 16049 |
| LYD972 | soybean\|13v2\|GLYMA04G36150 | soybean | 266 | 16050 |
| LYD973 | soybean\|13v2\|GLYMA04G40530 | soybean | 267 | 16051 |
| LYD974 | soybean\|13v2\|GLYMA06G46480 | soybean | 268 | 16052 |
| LYD975 | soybean\|13v2\|GLYMA07G00400T3 | soybean | 269 | 16053 |
| LYD976 | soybean\|13v2\|GLYMA07G10790 | soybean | 270 | 16054 |
| LYD977 | soybean\|13v2\|GLYMA09G38320 | soybean | 271 | 16055 |
| LYD978 | soybean\|13v2\|GLYMA10G02290 | soybean | 272 | 16056 |
| LYD979 | soybean\|13v2\|GLYMA10G32490 | soybean | 273 | 16057 |
| LYD980 | soybean\|13v2\|GLYMA12G32050T2 | soybean | 274 | 16058 |
| LYD981 | soybean\|13v2\|GLYMA13G13040 | soybean | 275 | 16059 |
| LYD982 | soybean\|13v2\|GLYMA14G17270 | soybean | 276 | 16060 |
| LYD983 | soybean\|13v2\|GLYMA15G02180 | soybean | 277 | 16061 |
| LYD984 | soybean\|13v2\|GLYMA17G01870 | soybean | 278 | 16062 |
| LYD985 | soybean\|13v2\|GLYMA17G09070 | soybean | 279 | 16063 |
| LYD986 | soybean\|13v2\|GLYMA20G31460 | soybean | 280 | 16064 |
| LYD987 | soybean\|13v2\|GLYMA20G33160 | soybean | 281 | 16065 |
| LYD988 | tomato\|13v1\|AF243524S1 | tomato | 11155 | 23586 |
| LYD989 | tomato\|13v1\|AW624349 | tomato | 282 | 16066 |
| LYD991 | tomato\|13v1\|BG123444 | tomato | 283 | 16067 |
| LYD992 | tomato\|13v1\|BG123723 | tomato | 284 | 16068 |
| LYD993 | tomato\|13v1\|BG123938 | tomato | 285 | 16069 |
| LYD995 | tomato\|13v1\|BG124909 | tomato | 286 | 16070 |
| LYD996 | tomato\|13v1\|BG126822 | tomato | 287 | 16071 |
| LYD997 | tomato\|13v1\|BG628071 | tomato | 288 | 16072 |
| LYD998 | tomato\|13v1\|BG643159 | tomato | 289 | 16073 |
| LYD999 | tomato\|13v1\|GFXDQ423113X1 | tomato | 290 | 16074 |
| LYD965_H1 | *medicago*\|13v1\|AW329210 | *medicago* | 291 | 16075 |
| LYM402 | rice\|gb170\|OS03G53660 | rice | 11156 | 23587 |
| MGP32 | *sorghum*\|13v2\|CD229946 | *sorghum* | 292 | 16076 |
| MGP36 | *sorghum*\|13v2\|BI099251 | *sorghum* | 11157 | 25612 |
| MGP43 | tomato\|gb164\|BG130774 | tomato | 11158 | 25613 |
| MGP44 | sunflower\|12v1\|BG874308 | sunflower | 293 | 16077 |
| MGP45 | barley\|12v1\|AV834260 | barley | 294 | 16078 |
| MGP46 | barley\|12v1\|BF259918 | barley | 295 | 16079 |
| MGP47 | barley\|12v1\|BM098125 | barley | 296 | 16080 |
| MGP48 | foxtail_millet\|4v1\|JK597363 | foxtail_millet | 297 | 16081 |
| MGP49 | foxtail_millet\|4v1\|XM_004963161 | foxtail_millet | 298 | 16082 |
| MGP50 | maize\|13v2\|CD950059 | maize | 299 | 16083 |
| MGP51 | rice\|13v2\|GFXAC105734X9 | rice | 300 | 16084 |
| MGP52 | *sorghum*\|13v2\|CD227098 | *sorghum* | 301 | 16085 |
| MGP53 | soybean\|13v2\|GLYMA08G10340 | soybean | 302 | 16086 |
| MGP54 | soybean\|13v2\|GLYMA10G05510 | soybean | 303 | 16087 |
| MGP58 | soybean\|13v2\|GLYMA16G27060 | soybean | 304 | 16088 |
| MGP59 | *sorghum*\|13v2\|XM_002458669 | *sorghum* | 305 | 16089 |
| MGP62 | barley\|12v1\|BG416202 | barley | 306 | 16090 |
| MGP63 | bean\|13v1\|CB539165 | bean | 307 | 16091 |
| MGP66 | foxtail_millet\|14v1\|JK588880 | foxtail_millet | 308 | 16092 |
| MGP67 | foxtail_millet\|14v1\|PHY7SI021461M | foxtail_millet | 309 | 16093 |
| MGP79 | rice\|13v2\|CB211925 | rice | 310 | 16094 |

TABLE 285-continued

Identified genes for increasing yield, growth rate, vigor, biomass, oil content, fiber yield, fiber quality, photosynthetic capacity, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
| --- | --- | --- | --- | --- |
| MGP82 | soybean\|13v2\|GLYMA13G01040T2 | soybean | 311 | 16095 |
| MGP91 | barley\|12v1\|BE411306 | barley | 312 | 16096 |
| MGP92 | arabidopsis\|13v2\|AT5G65590 | arabidopsis | 11159 | 25614 |
| NUE510 | poplar\|13v1\|CN192592 | poplar | 313 | 16097 |
| NUE543 | rice\|gb157.2\|AK063415 | rice | 11160 | 25615 |
| LBY274 | rice\|13v2\|CA753935 | rice | 314 | 16098 |
| LBY300 | foxtail_millet\|14v1\|XM_004986270 | foxtail_millet | 315 | 16099 |
| LBY307 | sorghum\|13v2\|BI211887 | sorghum | 316 | 16100 |
| LBY322 | foxtail_millet\|14v1\|XM_004976944 | foxtail_millet | 317 | 15897 |
| LBY327 | maize\|13v2\|AW282379 | maize | 318 | 15902 |
| LBY329 | maize\|13v2\|CB833980 | maize | 319 | 16101 |
| LBY335 | rice\|13v2\|CB213982 | rice | 320 | 15908 |
| LBY336 | rice\|13v2\|CF955116 | rice | 321 | 16102 |
| LBY341 | sorghum\|13v2\|AW285511 | sorghum | 322 | 15913 |
| LBY350 | sorghum\|13v2\|BG465007 | sorghum | 323 | 15920 |
| LBY354 | sorghum\|13v2\|CF483233 | sorghum | 324 | 16103 |
| LBY359 | wheat\|12v3\|CD453459 | wheat | 325 | 15927 |
| LBY373 | maize\|13v2\|CA400965 | maize | 326 | 16104 |
| LBY374 | maize\|13v2\|CF048378 | maize | 327 | 16105 |
| LBY375 | maize\|13v2\|SRR014549X146659 | maize | 328 | 16106 |
| LBY387 | sorghum\|13v2\|BG322840 | sorghum | 329 | 16107 |
| LBY389 | sorghum\|13v2\|BG560090 | sorghum | 330 | 16108 |
| LBY402 | sunflower\|12v1\|CD852931 | sunflower | 331 | 16109 |
| LBY433 | rice\|13v2\|AU070794 | rice | 332 | 15974 |
| LBY437 | rice\|13v2\|BI799994 | rice | 333 | 16110 |
| LBY440 | rice\|13v2\|CA767143 | rice | 334 | 16111 |
| LBY443 | rice\|13v2\|GFXAC113433X7 | rice | 335 | 15983 |
| LBY445 | rice\|13v2\|GFXAC145327X7 | rice | 336 | 16112 |
| LBY452 | soybean\|13v2\|GLYMA10G35450 | soybean | 337 | 15990 |
| LBY453 | sunflower\|12v1\|BQ970789 | sunflower | 338 | 16113 |
| LBY458 | tomato\|13v1\|BG124807 | tomato | 339 | 16114 |
| LBY460 | wheat\|12v3\|BE423530 | wheat | 340 | 15997 |
| LBY261_H1 | rice\|13v2\|CA854299 | rice | 215 | 16115 |
| LBY293_H1 | maize\|13v2\|BM032454 | maize | 341 | 16116 |
| LBY299_H1 | maize\|13v2\|BU037734 | maize | 342 | 16001 |
| LBY335_H3 | brachypodium\|14v1\|GT761083 | brachypodium | 218 | 16117 |
| LBY359_H13 | rice\|13v2\|AU069419 | rice | 343 | 16118 |
| LYD959 | maize\|13v2\|BE511599 | maize | 344 | 16038 |
| LYD966 | rice\|13v2\|BE230448 | rice | 345 | 16119 |
| LYD992 | tomato\|13v1\|BG123723 | tomato | 346 | 16120 |
| MGP79 | rice\|13v2\|CB211925 | rice | 347 | 16121 |

Table 285: Provided are the identified genes, their annotation, organism, polynucleotide and polypeptide sequence identifiers. "polyn." = polynucleotide; "polyp." = polypeptide.

Example 24

Identification of Homologous (e.g., Orthologous) Sequences that Increase Yield, Fiber Yield, Fiber Quality, Photosynthetic Capacity, Growth Rate, Biomass, Oil Content, Vigor, ABST, and/or NUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes affecting plant yield, fiber yield, fiber quality, oil yield, photosynthetic capacity, oil content, seed yield, growth rate, vigor, biomass, abiotic stress tolerance, and fertilizer use efficiency (FUE) and/or nitrogen use efficiency of a plant, all sequences were aligned using the BLAST™ (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases such as the DNA Database of Japan (DDBJ), GenBank, and the European Molecular Biology Laboratory Nucleic Acid Sequence Database (EMBL) or versions thereof or the MIPS database. A number of different search algorithms have been developed, including but not limited to the suite of programs referred to as BLAST™ programs. There are five implementations of BLAST™, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST™ algorithm calculates percent sequence identity and performs a statistical analysis of the similarity between the two sequences. The software for performing BLAST™ analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), and Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem (dot) ucl (dot) ac (dot) uk/bsm/dbbrowser/protocol/prodomqry (dot) html), PIR (pir (dot) Georgetown (dot) edu/) or Pfam (sanger (dot) ac (dot) uk/Software/Pfam/) databases. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break α-helical structures or β-sheet structures). Conservative substitution Tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 285 (Example 23) were identified from the databases using BLAST™ software with the Blastp and tBlastn algorithms as filters for the first stage, and the needle (EMBOSS package) or Frame+ algorithm alignment for the second stage. Local identity (BLAST™ alignments) was defined with a very permissive cutoff—60% Identity on a span of 60% of the sequences lengths because it is used only as a filter for the global alignment stage. The default filtering of the BLAST™ package was not utilized (by setting the parameter "-F F").

In the second stage, homologs were defined based on a global identity of at least 80% to the core gene polypeptide sequence. Two distinct forms for finding the optimal global alignment for protein or nucleotide sequences were used in this application:

1. Between two proteins (following the BLASTP filter): EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the TBLASTN filter):
GenCore 6.0 OneModel application utilizing the Frame+ algorithm with the following parameters: model=frame+_p2n.model mode=qglobal -q=protein. sequence -db=nucleotide. sequence. The rest of the parameters are unchanged from the default options described hereinabove.

The query polypeptide sequences were the sequences listed in Table 285 (Example 23), and the identified orthologous and homologous sequences having at least 80% global sequence identity to said sequences are provided in Table 286, below. These homologous genes are expected to increase plant yield, seed yield, oil yield, oil content, growth rate, photosynthetic capacity, fiber yield, fiber quality, biomass, vigor, ABST and/or NUE of a plant.

Lengthy table referenced here

US10766935-20200908-T00001

Please refer to the end of the specification for access instructions.

The output of the functional genomics approach described herein is a set of genes highly predicted to improve yield and/or other agronomic important traits such as growth rate, photosynthetic capacity, vigor, oil content, fiber yield and/or quality, biomass, growth rate, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 25

Gene Cloning and Generation of Binary Vectors for Plant Expression

To validate their role in improving yield, selected genes were over-expressed in plants, as follows.

Cloning Strategy

Selected genes from those presented in Examples 1-24 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal, limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York) which are well known to those skilled in the art. PCR products were purified using PCR purification kit (Qiagen).

Usually, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc.) according to the sites designed in the primers. Each digested/undigested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase was needed.

Sequencing of the inserted genes was performed using the ABI 377 sequencer (Applied Biosystems). In some cases, after confirming the sequences of the cloned genes, the cloned cDNA was introduced into a modified pGI binary vector containing the At6669 promoter (SEQ ID NO: 25), such as the pQFNc or pQsFN vectors, and the NOS terminator (SEQ ID NO: 36) via digestion with appropriate restriction endonucleases.

Several DNA sequences of the selected genes were synthesized by GeneArt™ (Life Technologies, Grand Island, N.Y., USA). Synthetic DNA was designed in silico. Suitable restriction enzymes sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

Figure 11:
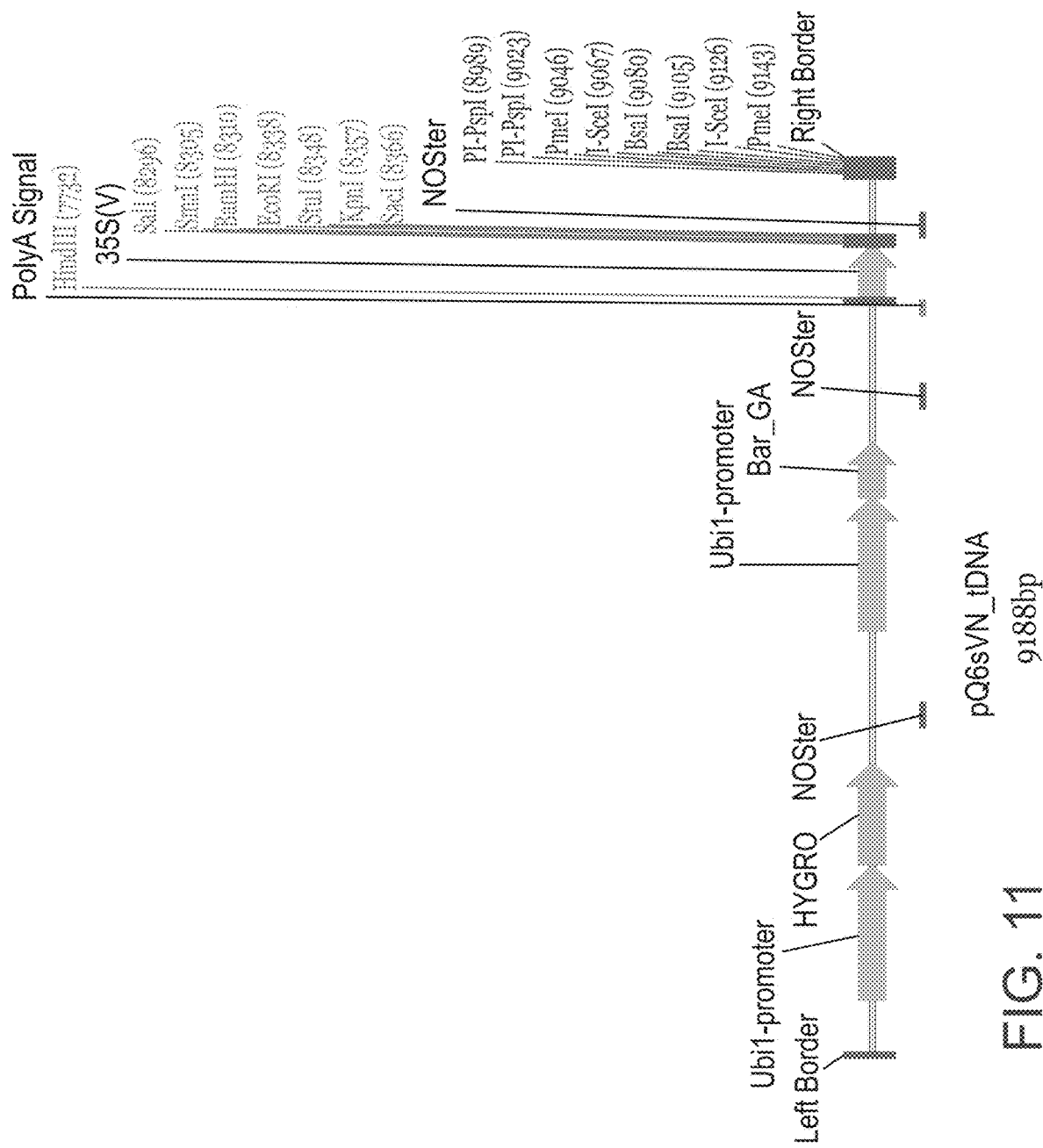
FIG. 11 is a schematic illustration of the pQ6sVN plasmid. pQ6sVN was used for expression of the isolated polynucleotide sequences of some embodiments of the invention in *Brachypodium*. "35S(V)"=35S promoter (SEQ ID NO:37); "NOS ter"=nopaline synthase terminator; "Bar_GA"=BAR open reading frame optimized for expression in *Brachypodium* (SEQ ID NO: 39); "Hygro"=Hygromycin resistance gene. "Ubi1 promoter"=SEQ ID NO:11; The isolated polynucleotide sequences of some embodiments of the invention were cloned into the Multiple cloning site of the vector (downstream of the "35S(V)" promoter) using one or more of the indicated restriction enzyme sites.
Figure 12:
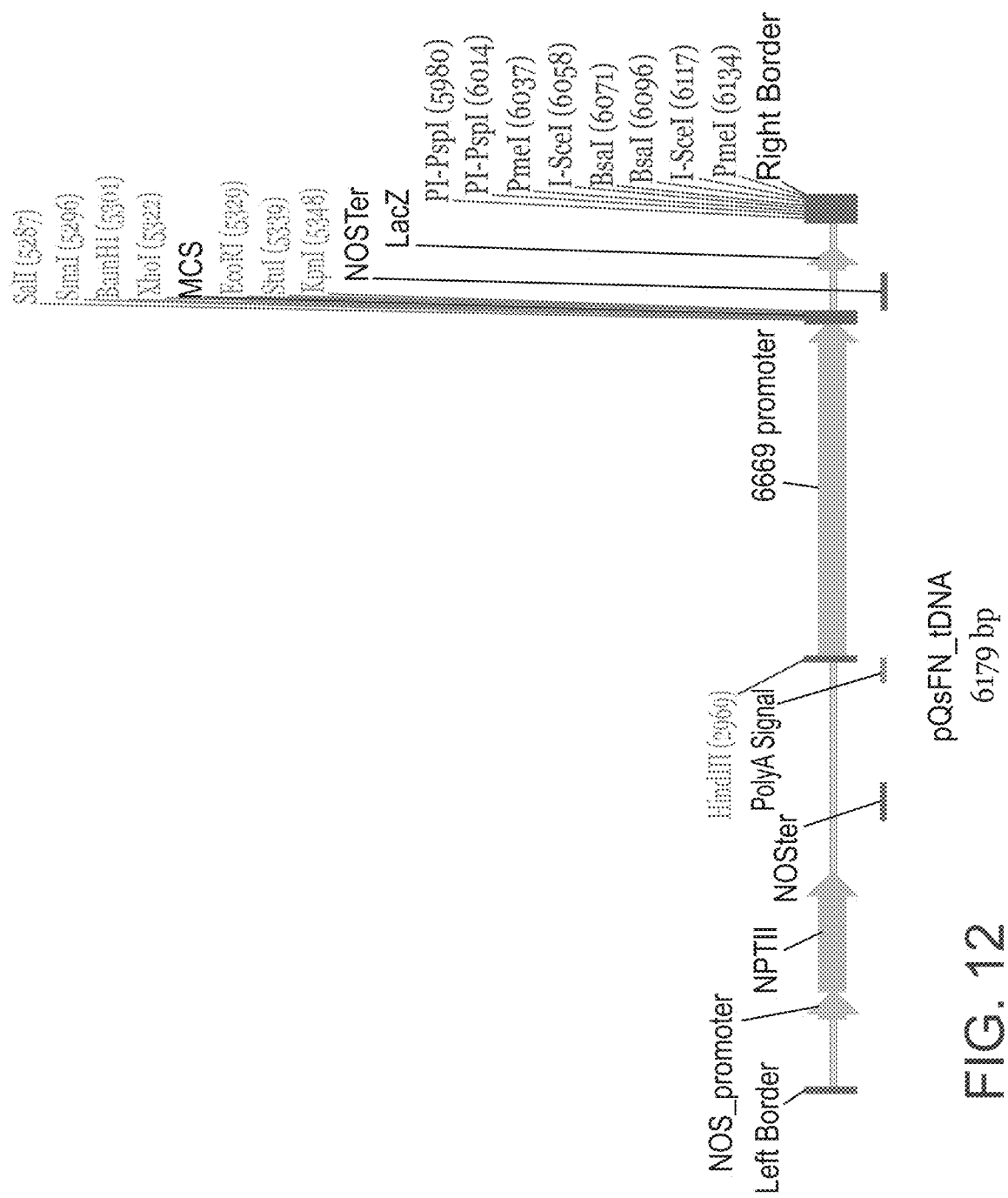
FIG. 12 is a schematic illustration of the pQsFN plasmid containing the new At6669 promoter (SEQ ID NO: 25) used for expression the isolated polynucleotide sequences of the invention in *Arabidopsis*. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 13:
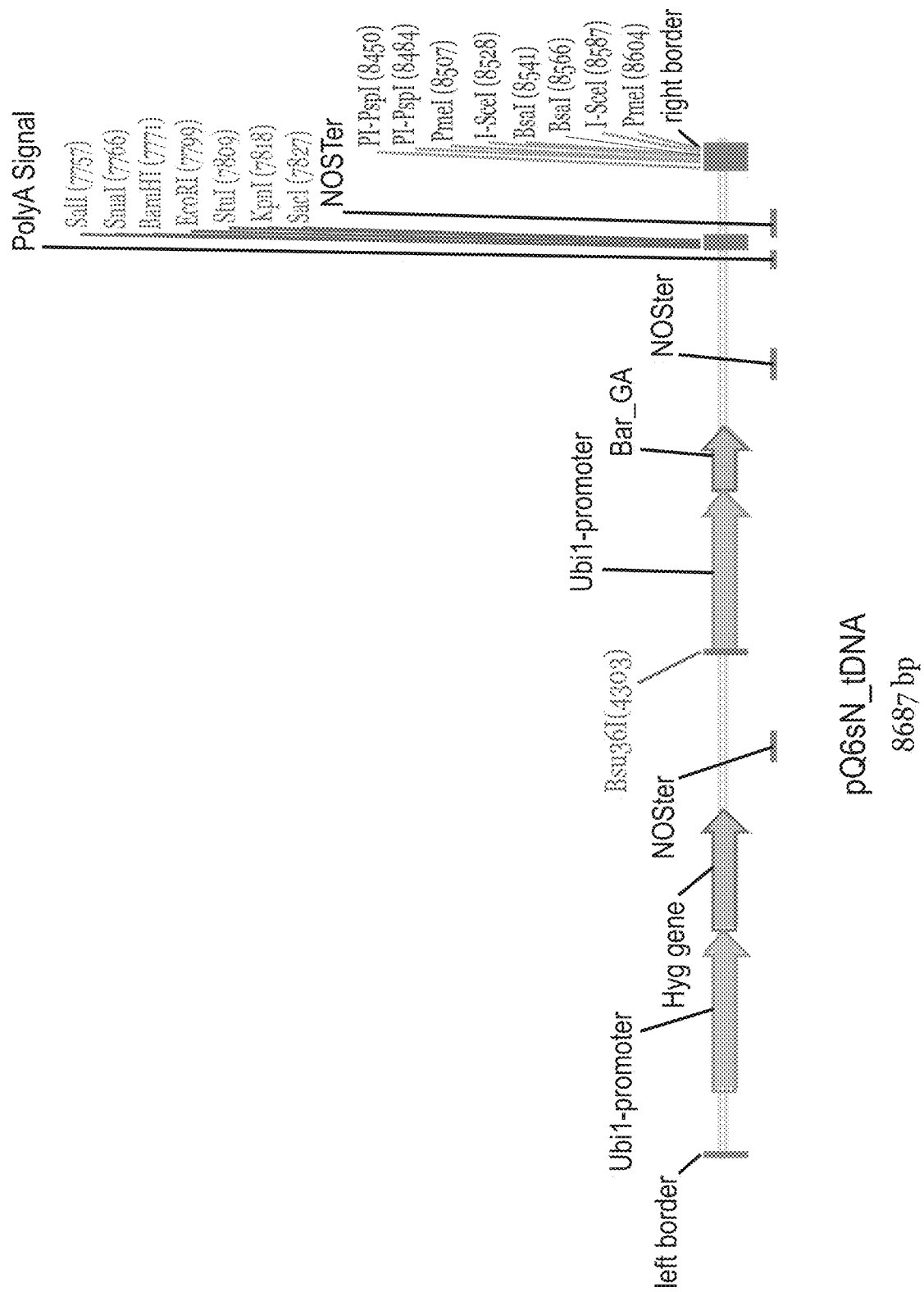
FIG. 13 is schematic illustration pQ6sN plasmid, which is used as a negative control ("empty vector") of the experiments performed when the plants were transformed with the pQ6sVN vector. "Ubi1" promoter (SEQ ID NO: 11); NOS ter=nopaline synthase terminator; "Bar_GA"=BAR open reading frame optimized for expression in *Brachypodium* (SEQ ID NO:39).

The modified pGI vector (e.g., pQFN, pQFNc, pQFNd, pQYN_6669, pQNa_RP, pQFYN, pQXNc, pQ6sVN (FIG. 11) or pQsFN (FIG. 12)) is a modified version of the pGI vector in which the cassette is inverted between the left and right borders so the gene and its corresponding promoter are close to the right border and the NPTII gene is close to the left border.

In case of *Arabidopsis* transformation the pQFN, pQFNc, pQFNd, pQYN_6669, pQNa_RP, pQFYN, pQXNc, or pQsFN were used.

At6669, the new *Arabidopsis thaliana* promoter sequence (SEQ ID NO: 25) was inserted in the modified pGI binary vector, upstream to the cloned genes, followed by DNA ligation and binary plasmid extraction from positive *E. coli* colonies, as described above. Colonies were analyzed by PCR using the primers covering the insert which were designed to span the introduced promoter and gene. Positive plasmids were identified, isolated and sequenced.

In case of *Brachypodium* transformation, after confirming the sequences of the cloned genes, the cloned cDNAs were introduced into pQ6sVN (FIG. 11) containing 35S promoter (SEQ ID NO:37) and the NOS terminator (SEQ ID NO:36) via digestion with appropriate restriction endonucleases. The genes were cloned downstream to the 35S promoter and upstream to the NOS terminator. In the pQ6sVN vector the Hygromycin resistance gene cassette and the Bar_GA resistance gene cassette replaced the NPTII resistance gene cassette. pQ6sVN contains the 35S promoter (SEQ ID NO:

37). Bar_GA resistance gene (SEQ ID NO: 39) is an optimized sequence of the BAR gene for expression in *Brachypodium* plants (ordered from GeneArt™).

Figure 9A:
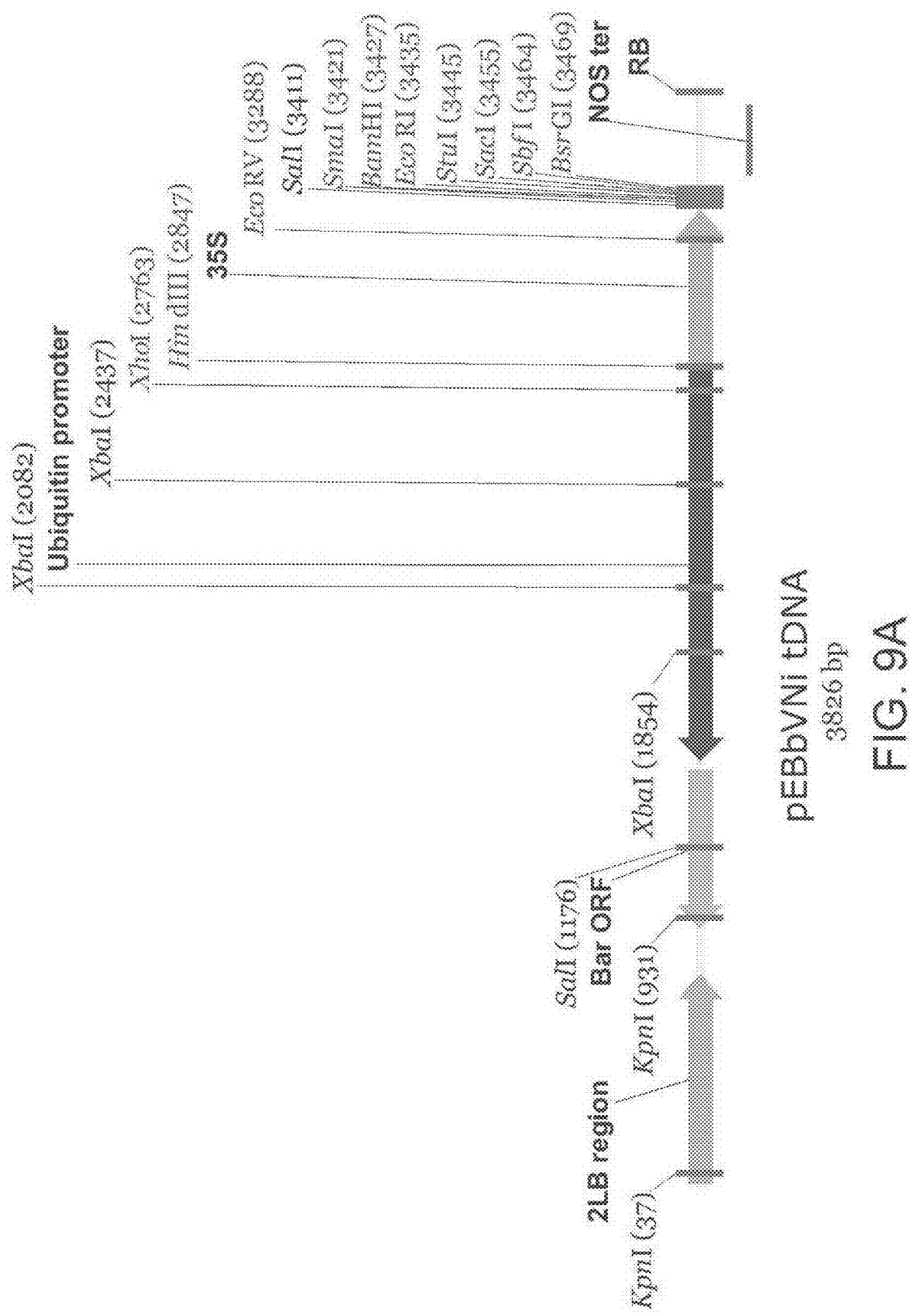
FIGS. 9A-B are schematic illustrations of the pEBbVNi tDNA (FIG. 9A) and the pEBbNi tDNA (FIG. 9B) plasmids used in the *Brachypodium* experiments. pEBbVNi tDNA (FIG. 9A) was used for expression of the isolated polynucleotide sequences of some embodiments of the invention in *Brachypodium*. pEBbNi tDNA (FIG. 9B) was used for transformation into *Brachypodium* as a negative control. "RB"=right border; "2LBregion"=2 repeats of left border; "35S"=35S promoter (SEQ ID NO: 37 in FIG. 9A); "Ubiquitin promoter (SEQ ID NO: 11 in both of FIGS. 9A and 9B; "NOS ter"=nopaline synthase terminator; "Bar ORF"—BAR open reading frame (GenBank Accession No. JQ293091.1; SEQ ID NO: 38); The isolated polynucleotide sequences of some embodiments of the invention were cloned into the Multiple cloning site of the vector using one or more of the indicated restriction enzyme sites.
Figure 9B:
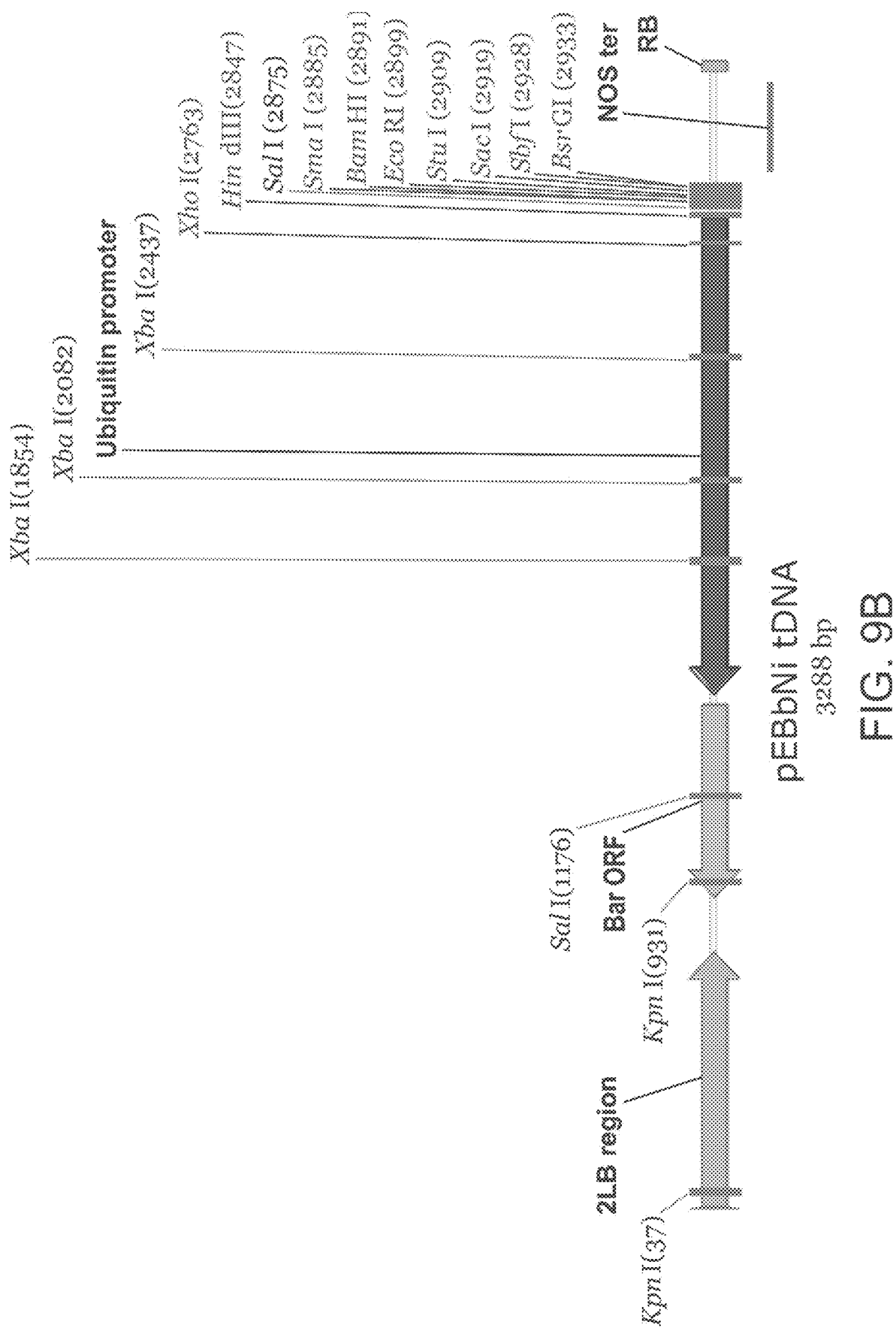

Additionally or alternatively, *Brachypodium* transformation was performed using the pEBbVNi vector. pEBbVNi (FIG. 9A) is a modified version of pJJ2LB in which the Hygromycin resistance gene was replaced with the BAR gene which confers resistance to the BASTA herbicide [BAR gene coding sequence is provided in GenBank Accession No. JQ293091.1 (SEQ ID NO: 38); further description is provided in Akama K, et al. "*Efficient Agrobacterium-mediated transformation of Arabidopsis thaliana using the bar gene as selectable marker*", Plant Cell Rep. 1995, 14(7):450-4; Christiansen P, et al. "*A rapid and efficient transformation protocol for the grass Brachypodium distachyon*", Plant Cell Rep. 2005 March; 23(10-11):751-8. Epub 2004 Oct. 19; and Păcurar D I, et al. "*A high-throughput Agrobacterium-mediated transformation system for the grass model species Brachypodium distachyon L*", Transgenic Res. 2008 17(5):965-75; each of which is fully incorporated herein by reference in its entirety]. The pEBbVNi construct contains the 35S promoter (SEQ ID NO: 37). pJJ2LB is a modified version of pCambia0305.2 (Cambia).

In case genomic DNA was cloned, the genes were amplified by direct PCR on genomic DNA extracted from leaf tissue using the DNAeasy kit (Qiagen Cat. No. 69104).

TABLE 287

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| CT4 | pUCsFN_CT4 | cotton | 26652, 26262, 26653, 26266 | 348 | 15824 |
| LBY236 | pUC57_LBY236_GA | | | 349 | 15826 |
| LBY237 | pMA-T_LBY237_GA | | | 11161 | 25610 |
| LBY238 | pQsFN_LBY238 | BARLEY *Hordeum vulgare* L. | 26546, 26302, 26546, 26302 | 350 | 15827 |
| LBY240 | pQsFN_LBY240 | BARLEY *Hordeum vulgare* L. | 26509, 26310, 26509, 26310 | 351 | 15828 |
| LBY242 | TopoB_LBY242 | BARLEY *Hordeum vulgare* L. | 26534, 26271, 26579, 26334 | 352 | 15829 |
| LBY243 | pMA-RQ_LBY243_GA | | | 353 | 15830 |
| LBY244 | pQsFN_LBY244 | MAIZE *Zea mays* L. | 26526, 26274, 26511, 26281 | 11162 | 25611 |
| LBY245 | TopoB_LBY245 | MAIZE *Zea mays* L. | 26679, 26392, 26679, 26405 | 354 | 16122 |
| LBY246 | TopoB_LBY246 | RICE *Oryza sativa* L. | 26553, 26707, 26553, 26707 | 355 | 15832 |
| LBY247 | pQsFN_LBY247 | RICE *Oryza sativa* L. | 26506, 26375, 26604, 26431 | 356 | 15833 |
| LBY248 | pQsFN_LBY248 | RICE *Oryza sativa* L. | 26319, 26371, 26319, 26411 | 357 | 15834 |
| LBY249 | pQsFN_LBY249 | RICE *Oryza sativa* L. | 26453, 26703, 26455, 26694 | 358 | 15835 |
| LBY250 | TopoB_LBY250 | RICE *Oryza sativa* L. | 26503, 26280, 26503, 26280 | 359 | 16123 |
| LBY252 | pQsFN_LBY252 | RICE *Oryza sativa* L. | 26532, 26287, 26540, 26304 | 360 | 15837 |
| LBY253 | pMA-RQ_LBY253_GA | | | 361 | 15838 |
| LBY254 | pQsFN_LBY254 | RICE *Oryza sativa* L. | 26527, 26327, 26516, 26261 | 362 | 15839 |
| LBY255 | pUC57_LBY255_GA | | | 363 | 15840 |
| LBY257 | pUC57_LBY257_GA | | | 364 | 15841 |
| LBY258 | pMA-RQ_LBY258_GA | | | 365 | 15842 |
| LBY259 | pQsFN_LBY259 | SORGHUM *Sorghum bicolor* | 26662, 26417, 26669, 26407 | 366 | 15843 |
| LBY260 | pMA-RQ_LBY260_GA | | | 367 | 15844 |
| LBY261_H1 | pUC57_LBY261_H1_GA | | | 508 | 15999 |
| LBY262 | pQsFN_LBY262 | BARLEY *Hordeum vulgare* L. | | 368 | 16124 |
| LBY263 | pMA-RQ_LBY263_GA | | | 369 | 15847 |
| LBY264 | pQsFN_LBY264 | BEAN *Phaseolus vulgaris* | 26569, 26427, 26552, 26393 | 370 | 16125 |
| LBY266 | pQsFN_LBY266 | FOXTAIL *Setaria italica* | 26358, 26383, 26263, 26420 | 371 | 16126 |
| LBY267 | pMA-T_LBY267_GA | | | 372 | 15850 |
| LBY268 | pQsFN_LBY268 | MAIZE *Zea mays* L. | 26493, 26268, 26493, 26291 | 373 | 15851 |
| LBY269 | pQsFN_LBY269 | RICE *Oryza sativa* L. | 26381, 26424, 26401, 26415 | 374 | 15852 |
| LBY270 | pMA-RQ_LBY270_GA | | | 375 | 15853 |
| LBY271 | TopoB_LBY271 | RICE *Oryza sativa* L. | 26582, 26698, 26582, 26698 | 376 | 15854 |
| LBY272 | pQsFN_LBY272 | RICE *Oryza sativa* L. | 26520, 26285, 26556, 26269 | 377 | 15855 |
| LBY274 | pQsFN_LBY274 | RICE *Oryza sativa* L. | 26547, 26335, 26563, 26349 | 378 | 16127 |
| LBY275 | pMA-RQ_LBY275_GA | | | 379 | 15857 |
| LBY277 | pMA-RQ_LBY277_GA | | | 74 | 15858 |
| LBY278 | pQsFN_LBY278 | SORGHUM *Sorghum bicolor* | 26482, 26713, 26482, 26713 | 380 | 15859 |
| LBY279 | pMA-RQ_LBY279_GA | | | 381 | 15860 |
| LBY280 | pQsFN_LBY280 | SORGHUM *Sorghum bicolor* | 26555, 26270, 26596, 26309 | 382 | 15861 |
| LBY281 | pQsFN_LBY281 | SORGHUM *Sorghum bicolor* | 26457, 26621, 26681, 26494 | 383 | 15862 |
| LBY282 | pQsFN_LBY282 | SUNFLOWER *Helianthus annuus* | 26551, 26373, 26601, 26433 | 384 | 16128 |
| LBY283 | pQsFN_LBY283 | SUNFLOWER *Helianthus annuus* | 26545, 26416, 26502, 26408 | 385 | 16129 |
| LBY286 | pMA-T_LBY286_GA | | | 386 | 15865 |
| LBY287 | TopoB_LBY287 | WHEAT *Triticum aestivum* L. | 26515, 26702, 26515, 26702 | 387 | 16130 |
| LBY288 | pQsFN_LBY288 | WHEAT *Triticum aestivum* L. | | 388 | 16131 |
| LBY289 | pMA-RQ_LBY289_GA | | | 389 | 15868 |
| LBY290 | pMA-RQ_LBY290_GA | | | 390 | 15869 |
| LBY291 | TopoB_LBY291 | FOXTAIL *Setaria italica* | 26513, 26704, 26501, 26712 | 391 | 15870 |
| LBY292 | pMA-RQ_LBY292_GA | | | 392 | 15871 |
| LBY293_H1 | pUC57_LBY293_H1_GA | | | 509 | 16000 |
| LBY294 | pUC57_LBY294_GA | | | 393 | 15873 |
| LBY295 | pQsFN_LBY295 | FOXTAIL *Setaria italica* | 26660, 26706, 26657, 26711 | 394 | 16132 |
| LBY296 | pQsFN_LBY296 | FOXTAIL *Setaria italica* | 26436, 26418, 26421, 26400 | 395 | 16133 |
| LBY297 | pUC57_LBY297_GA | | | 396 | 15876 |
| LBY298 | pQsFN_LBY298 | FOXTAIL *Setaria italica* | 26454, 26627, 26466, 26623 | 397 | 16134 |
| LBY299_H1 | pUC57_LBY299_H1_GA | | | 510 | 16001 |
| LBY300 | pUC57_LBY300_GA | | | 398 | 15879 |

TABLE 287-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LBY301 | pQsFN_LBY301 | MAIZE Zea mays L. | 26353, 26406, 26353, 26406 | 399 | 15880 |
| LBY302 | pQsFN_LBY302 | MAIZE Zea mays L. | 26505, 26288, 26505, 26288 | 400 | 16135 |
| LBY303 | pQsFN_LBY303 | RICE Oryza sativa L. | 26297, 26378, 26338, 26430 | 401 | 15882 |
| LBY304 | TopoB_LBY304 | RICE Oryza sativa L. | 26449, 26720, 26448, 26719 | 402 | 16136 |
| LBY305 | pQsFN_LBY305 | SORGHUM Sorghum bicolor | 26541, 26278, 26606, 26282 | 403 | 15884 |
| LBY306 | pMA-RQ_LBY306_GA | | | 404 | 15885 |
| LBY307 | pUC57_LBY307_GA | | | 405 | 15886 |
| LBY308 | pQsFN_LBY308 | SORGHUM Sorghum bicolor | 26438, 26631, 26470, 26626 | 406 | 15887 |
| LBY310 | pMA-RQ_LBY310_GA | | | 407 | 15889 |
| LBY311 | pUC57_LBY311_GA | | | 408 | 15890 |
| LBY312 | pQsFN_LBY312 | BARLEY Hordeum vulgare L. | 26260, 26372, 26286, 26370 | 409 | 15891 |
| LBY317 | pUC57_LBY317_GA | | | 410 | 15892 |
| LBY318 | pUC57_LBY318_GA | | | 411 | 15893 |
| LBY319 | pUC57_LBY319_GA | | | 412 | 15894 |
| LBY320 | pUC57_LBY320_GA | | | 413 | 15895 |
| LBY321 | pUC57_LBY321_GA | | | 414 | 15896 |
| LBY322 | pQsFN_LBY322_GA | | | 415 | 15897 |
| LBY323 | pQsFN_LBY323_GA | | | 416 | 15898 |
| LBY324 | pUC57_LBY324_GA | | | 417 | 15899 |
| LBY325 | pUC57_LBY325_GA | | | 418 | 15900 |
| LBY326 | pUC57_LBY326_GA | | | 419 | 15901 |
| LBY327 | pQsFN_LBY327 | MAIZE Zea mays L. | 26554, 26697, 26554, 26697 | 420 | 15902 |
| LBY328 | pUC57_LBY328_GA | | | 421 | 15903 |
| LBY330 | pUC57_LBY330_GA | | | 422 | 15905 |
| LBY331 | TopoB_LBY331 | RICE Oryza sativa L. | 26637, 26640, 26637, 26640 | 423 | 16137 |
| LBY332 | pUC57_LBY332_GA | | | 424 | 15907 |
| LBY335_H3 | pQsFN_LBY335_H3_GA | | | 511 | 16002 |
| LBY336 | TopoB_LBY336 | RICE Oryza sativa L. | 26530, 26480, 26530, 26480 | 425 | 16138 |
| LBY338 | pUC57_LBY338_GA | | | 426 | 15910 |
| LBY339 | pUC57_LBY339_GA | | | 427 | 15911 |
| LBY340 | pQsFN_LBY340 | SORGHUM Sorghum bicolor | 26351, 26425, 26351, 26425 | 428 | 15912 |
| LBY341 | TopoB_LBY341 | SORGHUM Sorghum bicolor | 26362, 26361, 26362, 26361 | 429 | 16139 |
| LBY342 | pUC57_LBY342_GA | | | 430 | 15914 |
| LBY344 | pQsFN_LBY344 | SORGHUM Sorghum bicolor | 26468, 26329, 26468, 26329 | 431 | 15916 |
| LBY346 | pQsFN_LBY346_GA | | | 432 | 15917 |
| LBY348 | pQsFN_LBY348_GA | | | 433 | 15918 |
| LBY349 | pUC57_LBY349_GA | | | 434 | 15919 |
| LBY350 | pQsFN_LBY350 | SORGHUM Sorghum bicolor | 26574, 26339, 26574, 26313 | 435 | 15920 |
| LBY352 | pUC57_LBY352_GA | | | 436 | 15921 |
| LBY353 | pUC57_LBY353_GA | | | 437 | 15922 |
| LBY355 | pQsFN_LBY355 | WHEAT Triticum aestivum L. | 26332, 26419, 26283, 26387 | 438 | 16140 |
| LBY356 | pUC57_LBY356_GA | | | 439 | 15925 |
| LBY357 | pQsFN_LBY357 | WHEAT Triticum aestivum L. | 26292, 26394, 26333, 26398 | 440 | 16141 |
| LBY358 | pQsFN_LBY358 | WHEAT Triticum aestivum L. | 26473, 26696, 26473, 26696 | 11163 | 23588 |
| LBY359_H13 | pQsFN_LBY359_H13_GA | | | 512 | 16003 |
| LBY362 | pUC57_LBY362_GA | | | 441 | 15928 |
| LBY363 | pQsFN_LBY363 | BARLEY Hordeum vulgare L. | 26550, 26721, 26573, 26722 | 11164 | 23589 |
| LBY364 | TopoB_LBY364 | BARLEY Hordeum vulgare L. | 26682, 26477, 26682, 26477 | 442 | 16142 |
| LBY366 | pUC57_LBY366_GA | | | 443 | 15930 |
| LBY368 | pQsFN_LBY368_GA | | | 11165 | 23576 |
| LBY369 | pUC57_LBY369_GA | | | 444 | 15931 |
| LBY371 | pQsFN_LBY371 | FOXTAIL Setaria italica | 26559, 26343, 26559, 26343 | 11166 | 23590 |
| LBY373 | TopoB_LBY373 | MAIZE Zea mays L. | 26603, 26312, 26600, 26305 | 445 | 15932 |
| LBY374_H15 | pQsFN_LBY374_H15_GA | | | 513 | 16004 |
| LBY375 | pQsFN_LBY375 | MAIZE Zea mays L. | 26543, 26264, 26508, 26336 | 11167 | 23591 |
| LBY376 | pUC57_LBY376_GA | | | 446 | 15934 |
| LBY377 | pUC57_LBY377_GA | | | 447 | 15935 |
| LBY378 | pQsFN_LBY378 | RICE Oryza sativa L. | 26504, 26699, 26504, 26699 | 11168 | 23592 |
| LBY379 | pUC57_LBY379_GA | | | 448 | 15936 |
| LBY380 | pQsFN_LBY380 | RICE Oryza sativa L. | 26458, 26629, 26443, 26628 | 449 | 16143 |
| LBY382 | pQsFN_LBY382_GA | | | 450 | 15938 |
| LBY383 | pUC57_LBY383_GA | | | 451 | 15939 |
| LBY384 | pQsFN_LBY384 | SORGHUM Sorghum bicolor | 26564, 26678, 26564, 26678 | 452 | 16144 |
| LBY385 | pQsFN_LBY385_GA | | | 453 | 15941 |
| LBY387 | pQsFN_LBY387 | SORGHUM Sorghum bicolor | 26307, 26388, 26265, 26390 | 454 | 16145 |
| LBY388 | pUC57_LBY388_GA | | | 455 | 15943 |
| LBY389 | pQsFN_LBY389_GA | | | 456 | 15944 |
| LBY392 | pQsFN_LBY392 | SORGHUM Sorghum bicolor | 26522, 26267, 26512, 26301 | 457 | 15945 |
| LBY393_H1 | pQsFN_LBY393_H1_GA | | | 11171 | 23583 |
| LBY394 | pUC57_LBY394_GA | | | 458 | 15946 |
| LBY396 | pUC57_LBY396_GA | | | 459 | 15947 |
| LBY398 | pUC57_LBY398_GA | | | 460 | 15948 |
| LBY401 | pQsFN_LBY401 | SOYBEAN Glycine max | 26671, 26422, 26661, 26386 | 461 | 15950 |
| LBY402 | TopoB_LBY402 | SUNFLOWER Helianthus annuus | 26437, 26290, 26464, 26479 | 462 | 16146 |
| LBY404 | pQsFN_LBY404 | TOMATO Lycopersicum ND | 26654, 26377, 26670, 26374 | 463 | 16147 |

TABLE 287-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LBY405 | pQsFN_LBY405 | TOMATO *Lycopersicum* ND | 26456, 26354, 26439, 26276 | 464 | 15953 |
| LBY406 | pUC57_LBY406_GA | | | 465 | 15954 |
| LBY407 | pQsFN_LBY407 | TOMATO *Lycopersicum* ND | 26613, 26717, 26613, 26717 | 466 | 15955 |
| LBY408 | pQsFN_LBY408 | BARLEY *Hordeum vulgare* L. | 26459, 26273, 26459, 26294 | 467 | 15956 |
| LBY409 | pQsFN_LBY409 | BARLEY *Hordeum vulgare* L. | 26572, 26344, 26572, 26357 | 468 | 15957 |
| LBY410 | pQsFN_LBY410 | BEAN *Phaseolus vulgaris* | 26565, 26348, 26565, 26348 | 469 | 16148 |
| LBY412 | pQsFN_LBY412 | BEAN *Phaseolus vulgaris* | 26557, 26428, 26581, 26432 | 470 | 15959 |
| LBY413 | pQsFN_LBY413 | COTTON *Gossypium* ND | 26356, 26429, 26356, 26404 | 11169 | 23593 |
| LBY414 | pUC57_LBY414_GA | | | 471 | 15960 |
| LBY417 | pUC57_LBY417_GA | | | 472 | 15961 |
| LBY418 | pUC57_LBY418_GA | | | 473 | 15962 |
| LBY419 | pQsFN_LBY419 | FOXTAIL *Setaria italica* | 26672, 26647, 26672, 26647 | 474 | 16149 |
| LBY421 | pUC57_LBY421_GA | | | 475 | 15964 |
| LBY422 | pQsFN_LBY422 | COTTON *Gossypium* ND | 26602, 26298, 26616, 26326 | 476 | 16150 |
| LBY423 | pQsFN_LBY423 | MAIZE *Zea mays* L. | 26590, 26321, 26590, 26321 | 477 | 16151 |
| LBY424 | pQsFN_LBY424 | MAIZE *Zea mays* L. | 26591, 26642, 26591, 26643 | 478 | 16152 |
| LBY426 | pUCsVN_LBY426_GA | | | 479 | 15968 |
| LBY427 | pQsFN_LBY427 | MAIZE *Zea mays* L. | 26585, 26710, 26585, 26710 | 480 | 16153 |
| LBY428 | TopoB_LBY428 | MAIZE *Zea mays* L. | 26537, 26340, 26580, 26359 | 481 | 16154 |
| LBY430 | pUC57_LBY430_GA | | | 482 | 15971 |
| LBY431 | pUC57_LBY431_GA | | | 483 | 15972 |
| LBY432 | pUC57_LBY432_GA | | | 484 | 15973 |
| LBY433 | pQsFN_LBY433_GA | | | 485 | 15974 |
| LBY434 | pUC57_LBY434_GA | | | 486 | 15975 |
| LBY435 | pQsFN_LBY435 | RICE *Oryza sativa* L. | 26499, 26379, 26499, 26379 | 487 | 16155 |
| LBY438 | pUC57_LBY438_GA | | | 488 | 15978 |
| LBY439 | pUC57_LBY439_GA | | | 489 | 15979 |
| LBY440 | TopoB_LBY440 | RICE *Oryza sativa* L. | 26673, 26685, 26663, 26683 | 490 | 16156 |
| LBY441 | pUC57_LBY441_GA | | | 491 | 15981 |
| LBY442 | pQsFN_LBY442 | RICE *Oryza sativa* L. | 26323, 26409, 26323, 26409 | 492 | 15982 |
| LBY443 | pUCsVN_LBY443_GA | | | 493 | 15983 |
| LBY444 | pUC57_LBY444_GA | | | 494 | 15984 |
| LBY445 | pQsFN_LBY445_GA | | | 495 | 15985 |
| LBY446 | pUC57_LBY446_GA | | | 496 | 15986 |
| LBY447 | pQsFN_LBY447_GA | | | 11170 | 23582 |
| LBY449 | TopoB_LBY449 | SORGHUM *Sorghum bicolor* | 26535, 26705, 26535, 26705 | 497 | 15987 |
| LBY451 | pQsFN_LBY451 | SOYBEAN *Glycine max* | 26549, 26397, 26549, 26403 | 498 | 16157 |
| LBY452 | pQsFN_LBY452_GA | | | 499 | 15990 |
| LBY453 | pQsFN_LBY453 | SUNFLOWER *Helianthus annuus* | 26566, 26365, 26483, 26395 | 500 | 16158 |
| LBY454 | pQsFN_LBY454 | SUNFLOWER *Helianthus annuus* | 26609, 26624, 26539, 26718 | 501 | 15992 |
| LBY455 | TopoB_LBY455 | SUNFLOWER *Helianthus annuus* | 26446, 26497, 26446, 26612 | 502 | 16159 |
| LBY456 | pQsFN_LBY456 | TOMATO *Lycopersicum* ND | 26531, 26314, 26593, 26296 | 503 | 16160 |
| LBY457 | pQsFN_LBY457 | TOMATO *Lycopersicum* ND | 26514, 26426, 26583, 26384 | 504 | 16161 |
| LBY458 | pUCsVN_LBY458_GA | | | 505 | 15996 |
| LBY460 | pQsFN_LBY460 | WHEAT *Triticum aestivum* L. | 26597, 26633, 26611, 26638 | 506 | 16162 |
| LBY461 | pQsFN_LBY461 | WHEAT *Triticum aestivum* L. | 26586, 26708, 26586, 26708 | 507 | 16163 |
| LGA10 | pUCsFN_LGA10 | *Zea mays* | 26500, 26318, 26595, 26317 | 11172 | 23594 |
| LGA14 | pUCsFN_LGA14 | *Zea mays* | 26484, 26253, 26484, 26253 | 515 | 16006 |
| LGA15 | pUCsFN_LGA15 | *sorghum bicolor* | 26490, 26248, 26571, 26245 | 516 | 16007 |
| LGA23 | pUCsFN_LGA23 | *sorghum bicolor* | 26462, 26690, 26452, 26692 | 517 | 16008 |
| LGA27 | pQsFN_LGA27 | *Glycine max* | 26492, 26256, 26492, 26256 | 518 | 16009 |
| LGA3 | pUCsFN_LGA3 | *Hordeum vulgare* subsp. *Vulgare* | 26560, 26249, 26560, 26249 | 514 | 16005 |
| LGD27 | pQsFN_LYD999 | *Brassica juncea* | 26486, 26246, 26523, 26246 | 519 | 16164 |
| LGD28 | pQsFN_LYD999 | *Phaseolus vulgaris* | 26519, 26255, 26716, 26254 | 520 | 16011 |
| LGD30 | pQsFN_LGD30 | *Glycine max* | 26544, 26252, 26584, 26251 | 521 | 16012 |
| LYD934 | pMA-RQ_LYD934_GA | | | 522 | 16013 |
| LYD935 | pQsFN_LYD935 | *Medicago* | 26295, 26402, 26320, 26368 | 523 | 16165 |
| LYD936 | pQsFN_LYD936 | *Medicago* | 26488, 26366, 26618, 26423 | 524 | 16015 |
| LYD937 | pQsFN_LYD937 | RICE *Oryza sativa* L. | 26315, 26385, 26293, 26380 | 525 | 16166 |
| LYD938 | pQsFN_LYD938 | RICE *Oryza sativa* L. | 26299, 26396, 26299, 26396 | 526 | 16017 |
| LYD939 | pUC57_LYD939_GA | | | 527 | 16018 |
| LYD940 | pQsFN_LYD940 | RICE *Oryza sativa* L. | 26576, 26328, 26536, 26311 | 528 | 16167 |
| LYD941 | pQsFN_LYD941 | RICE *Oryza sativa* L. | 26363, 26472, 26363, 26472 | 529 | 16168 |
| LYD942 | pQsFN_LYD942 | SOYBEAN *Glycine max* | 26568, 26350, 26498, 26345 | 530 | 16021 |
| LYD943 | pQsFN_LYD943 | SOYBEAN *Glycine max* | 26587, 26412, 26587, 26412 | 531 | 16169 |
| LYD944 | pMA-RQ_LYD944_GA | | | 532 | 16023 |
| LYD945 | pQsFN_LYD945 | SOYBEAN *Glycine max* | 26528, 26284, 26528, 26284 | 533 | 16024 |
| LYD946 | pQsFN_LYD946 | SOYBEAN *Glycine max* | 26664, 26475, 26724, 26684 | 534 | 16025 |
| LYD947 | pQsFN_LYD947 | SOYBEAN *Glycine max* | 26676, 26413, 26675, 26680 | 535 | 16026 |
| LYD948 | pQsFN_LYD948 | SOYBEAN *Glycine max* | 26619, 26342, 26594, 26316 | 536 | 16027 |
| LYD949 | pQsFN_LYD949 | SOYBEAN *Glycine max* | 26655, 26463, 26674, 26687 | 537 | 16028 |
| LYD950 | pQsFN_LYD950 | TOMATO *Lycopersicum* ND | 26577, 26389, 26610, 26414 | 538 | 16170 |
| LYD951 | pQsFN_LYD951 | TOMATO *Lycopersicum* ND | 26450, 26630, 26686, 26634 | 539 | 16171 |
| LYD952 | pQsFN_LYD952 | TOMATO *Lycopersicum* ND | 26558, 26347, 26558, 26347 | 540 | 16031 |
| LYD953 | pQsFN_LYD953 | TOMATO *Lycopersicum* ND | 26659, 26367, 26666, 26376 | 541 | 16172 |

TABLE 287-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LYD954 | pQsFN_LYD954 | TOMATO Lycopersicum ND | 26441, 26714, 26461, 26598 | 542 | 16033 |
| LYD955 | pQsFN_LYD955 | TOMATO Lycopersicum ND | 26562, 26382, 26529, 26369 | 543 | 16034 |
| LYD956 | pUCsFN_LYD956 | Phaseolus vulgaris | 26525, 26259, 26518, 26289 | 544 | 16035 |
| LYD957 | pQsFN_LYD957 | Phaseolus vulgaris | 26474, 26639, 26476, 26622 | 545 | 16036 |
| LYD958 | pQsFN_LYD958 | Phaseolus vulgaris | 26445, 26524, 26447, 26548 | 546 | 16173 |
| LYD959 | pQsFN_LYD959 | | | 547 | 16038 |
| LYD960 | pUC57_LYD960_GA | | | 548 | 16039 |
| LYD961 | pUC57_LYD961_GA | | | 549 | 16040 |
| LYD962 | pUC57_LYD962_GA | | | 550 | 16041 |
| LYD963 | pUC57_LYD963_GA | | | 11173 | 23585 |
| LYD964 | pUC57_LYD964_GA | | | 551 | 16042 |
| LYD965_H1 | pQsFN_LYD965_H1_GA | | | 583 | 16075 |
| LYD966 | pQsFN_LYD966_GA | | | 552 | 16044 |
| LYD967 | pUC57_LYD967_GA | | | 553 | 16045 |
| LYD968 | pQsFN_LYD968 | RICE Oryza sativa L. | 26467, 26324, 26451, 26331 | 554 | 16174 |
| LYD969 | pUC57_LYD969_GA | | | 555 | 16047 |
| LYD970 | pUC57_LYD970_GA | | | 556 | 16048 |
| LYD971 | pUC57_LYD971_GA | | | 557 | 16049 |
| LYD972 | pUC57_LYD972_GA | | | 558 | 16050 |
| LYD973 | pUC57_LYD973_GA | | | 559 | 16051 |
| LYD974 | pQsFN_LYD974 | SOYBEAN Glycine max | 26352, 26434, 26322, 26434 | 560 | 16052 |
| LYD975 | pUC57_LYD975_GA | | | 561 | 16053 |
| LYD976 | pUC57_LYD976_GA | | | 562 | 16054 |
| LYD977 | TopoB_LYD977 | SOYBEAN Glycine max | 26487, 26646, 26542, 26635 | 563 | 16055 |
| LYD978 | pUC57_LYD978_GA | | | 564 | 16056 |
| LYD979 | pUC57_LYD979_GA | | | 565 | 16057 |
| LYD980 | pUC57_LYD980_GA | | | 566 | 16058 |
| LYD981 | TopoB_LYD981 | SOYBEAN Glycine max | 26496, 26325, 26607, 26337 | 567 | 16059 |
| LYD982 | pQsFN_LYD982 | SOYBEAN Glycine max | 26469, 26701, 26465, 26695 | 568 | 16060 |
| LYD983 | pUC57_LYD983_GA | | | 569 | 16061 |
| LYD984 | pUC57_LYD984_GA | | | 570 | 16062 |
| LYD985 | pUC57_LYD985_GA | | | 571 | 16063 |
| LYD986 | pQsFN_LYD986 | SOYBEAN Glycine max | 26485, 26636, 26517, 26632 | 572 | 16064 |
| LYD987 | pUC57_LYD987_GA | | | 573 | 16065 |
| LYD988 | pQsFN_LYD988 | TOMATO Lycopersicum ND | 26567, 26364, 26489, 26391 | 11174 | 23595 |
| LYD989 | pUC57_LYD989_GA | | | 574 | 16066 |
| LYD991 | pUCsFN_LYD991 | TOMATO Lycopersicum ND | 26614, 26330, 26605, 26700 | 575 | 16175 |
| LYD992 | pQsFN_LYD992_GA | | | 576 | 16068 |
| LYD993 | pUC57_LYD993_GA | | | 577 | 16069 |
| LYD995 | pQsFN_LYD995 | TOMATO Lycopersicum ND | 26665, 26308, 26665, 26303 | 578 | 16070 |
| LYD996 | pQsFN_LYD996 | TOMATO Lycopersicum ND | 26649, 26440, 26658, 26460 | 579 | 16176 |
| LYD997 | pUCsFN_LYD997 | TOMATO Lycopersicum ND | 26617, 26306, 26578, 26300 | 580 | 16072 |
| LYD998 | pQsFN_LYD998 | TOMATO Lycopersicum ND | 26495, 26644, 26615, 26641 | 581 | 16073 |
| LYD999 | pQsFN_LYD999 | | | 582 | 16074 |
| LYM402new | pUCsFN_LYM402new | RICE Oryza sativa L. | 26444, 26625, 26444, 26625 | 11175 | 23596 |
| MGP32 | pQsFN_MGP32 | SORGHUM Sorghum bicolor | 26656, 26589, 26656, 26589 | 584 | 16177 |
| MGP36 | pUCsFN_MGP36 | sorghum | 26533, 26247, 26588, 26725 | 11176 | 25612 |
| MGP43 | pUCsFN_MGP43 | tomato | 26620, 26258, 26620, 26244 | 11177 | 25613 |
| MGP44 | pQsFN_MGP44 | Helianthus annuus | 26651, 26399, 26651, 26410 | 585 | 16178 |
| MGP45 | TopoB_MGP45 | BARLEY Hordeum vulgare L. | | 586 | 16078 |
| MGP46 | pQsFN_MGP46 | BARLEY Hordeum vulgare L. | 26491, 26691, 26592, 26689 | 587 | 16079 |
| MGP48 | pQsFN_MGP48 | FOXTAIL Setaria italica | 26507, 26250, 26507, 26250 | 588 | 16179 |
| MGP49 | TopoB_MGP49 | FOXTAIL Setaria italica | 26360, 26272, 26481, 26355 | 589 | 16180 |
| MGP50 | pMA-RQ_MGP50_GA | | | 590 | 16083 |
| MGP51 | TopoB_MGP51 | RICE Oryza sativa L. | 26575, 26645, 26575, 26645 | 591 | 16084 |
| MGP52 | pQsFN_MGP52 | SORGHUM Sorghum bicolor | 26521, 26688, 26521, 26688 | 592 | 16181 |
| MGP53 | pQsFN_MGP53 | SOYBEAN Glycine max | 26648, 26435, 26648, 26677 | 593 | 16086 |
| MGP54 | pUCsFN_MGP54 | SOYBEAN Glycine max | 26538, 26257, 26561, 26257 | 594 | 16182 |
| MGP58 | pUCsFN_MGP58 | SOYBEAN Glycine max | 26510, 26726, 26510, 26726 | 595 | 16183 |
| MGP59 | pQsFN_MGP59 | SORGHUM Sorghum bicolor | 26650, 26277, 26723, 26693 | 596 | 16089 |
| MGP62 | pQsFN_MGP62 | barley | 26715, 26727, 26570, 26728 | 597 | 16090 |
| MGP63 | pUCsFN_MGP63 | bean | 26608, 26341, 26599, 26279 | 598 | 16091 |
| MGP66 | pUC57_MGP66_GA | | | 599 | 16092 |
| MGP67 | pUC57_MGP67_GA | | | 600 | 16093 |
| MGP79 | pQsFN_MGP79_GA | | | 601 | 16094 |
| MGP82 | pUC57_MGP82_GA | | | 602 | 16095 |
| MGP91 | pUC57_MGP91_GA | | | 603 | 16096 |
| MGP92 | pUC57_MGP92_GA | | | 11178 | 25614 |
| NUE510 | pUCsFN_NUE510 | poplar | 26667, 26478, 26667, 26478 | 604 | 16184 |
| NUE543 | pMK-RQ_NUE543_GA | | | 15347 | 25615 |

Table 287. Cloned genes. Provided are the gene names, organisms from which they were derived, and polynucleotide and polypeptide sequence identifiers of selected genes of some embodiments of the invention.
"GA"—GeneArt ™ (synthetically prepared gene sequence).

Example 26

Transforming *Agrobacterium tumefaciens* Cells with Binary Vectors Harboring Putative Genes The above described binary vectors were used to transform *Agrobacterium* cells. Two additional binary constructs, having only the At6669 or the 35S promoter, or no additional promoter were used as negative controls.

The binary vectors were introduced to *Agrobacterium tumefaciens* GV301 or LB4404 (for *Arabidopsis*) or AGL1 (for *Brachypodium*) competent cells (about $10^9$ cells/mL) by electroporation. The electroporation was performed using a MicroPulser electroporator (Biorad), 0.2 cm cuvettes (Biorad) and EC-1 electroporation program (Biorad). The treated cells were cultured in S.O.C liquid medium (S1797 SIGMA-ALDRICH®) with gentamycin (for *Arabidopsis;* 50 mg/L; for *Agrobacterium* strains GV301) or streptomycin (for *Arabidopsis;* 300 mg/L; for *Agrobacterium* strain LB4404); or with Carbenicillin (for *Brachypodium;* 50 mg/L) at 28° C. for 3 hours, then plated over LB agar supplemented with gentamycin (for *Arabidopsis;* 50 mg/L; for *Agrobacterium* strains GV301) or streptomycin (for *Arabidopsis;* 300 mg/L; for *Agrobacterium* strain LB4404); or with Carbenicillin (for *Brachypodium;* 50 mg/L) and kanamycin (for *Arabidopsis* and *Brachypodium;* 50 mg/L) at 28° C. for 48 hours. Abrobacterium colonies, which were developed on the selective media, were further analyzed by PCR using the primers designed to span the inserted sequence in the pPI plasmid.

Example 27

Producing Transgenic *Arabidopsis* Plants Expressing Selected Genes According to Some Embodiments of the Invention Materials and Experimental Methods Plant transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues were the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the genes of some embodiments of the invention were cultured in YEBS medium (Yeast extract 1 gr/L, Beef extract 5 gr/L, MgSO4*7H$_2$O, Bacto peptone 5 gr/L) supplemented with kanamycin (50 mg/L) and gentamycin (50 mg/L). The cultures were incubated at 28° C. for 48 hours under vigorous shaking to desired optical density at 600 nm of 0.85 to 1.1. Before transformation into plants, 60 µl of Silwet L-77 was added into 300 ml of the *Agrobacterium* suspension.

Transformation of $T_0$ plants was performed by inverting each plant into an *Agrobacterium* suspension such that the above ground plant tissue was submerged for 1 minute. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes of some embodiments of the invention, seeds collected from transgenic $T_0$ plants were surface-sterilized by exposing to chlorine fumes (6% sodium hypochlorite with 1.3% HCl) for 100 minutes. The surface-sterilized seeds were sown on culture plates containing half-strength Murashig-Skoog (Duchefa); 2% sucrose; 0.5% plant agar; 50 mg/L kanamycin; and 200 mg/L carbenicylin (Duchefa). The culture plates were incubated at 4° C. for 48 hours and then were transferred to a growth room at 25° C. for three weeks. Following incubation, the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 28

Transformation of *Brachypodium* Distachyon Plants with the Polynucleotides of the Invention Similar to the *Arabidopsis* model plant, *Brachypodium distachyon* has several features that recommend it as a model plant for functional genomic studies, especially in the grasses. Traits that make it an ideal model include its small genome (~160 Mbp for a diploid genome and 355 Mbp for a polyploidy genome), small physical stature, a short life-cycle, and few growth requirements. *Brachypodium* is related to the major cereal grain species but is understood to be more closely related to the Triticeae (wheat, barley) than to the other cereals. *Brachypodium*, with its polyploidy accessions, can serve as an ideal model for these grains (whose genomics size and complexity is a major barrier to biotechnological improvement).

*Brachypodium distachyon* embryogenic calli are transformed using the procedure described by Vogel and Hill (2008) [High-efficiency *Agrobacterium*-mediated transformation of *Brachypodium distachyon* inbred line Bd21-3. Plant Cell Rep 27:471-478], Vain et al (2008) [*Agrobacterium*-mediated transformation of the temperate grass *Brachypodium distachyon* (genotype Bd21) for T-DNA insertional mutagenesis. Plant Biotechnology J 6: 236-245], and Vogel J, et al. (2006) [*Agrobacterium* mediated transformation and inbred line development in the model grass *Brachypodium distachyon*. Plant Cell Tiss Org. Cult. 85:199-211], each of which is fully incorporated herein by reference, with some minor modifications, which are briefly summarized herein below.

Callus initiation—Immature spikes (about 2 months after seeding) are harvested at the very beginning of seeds filling. Spikes are then husked and surface sterilized with 3% NaClO containing 0.1% Tween 20, shaken on a gyratory shaker at low speed for 20 minutes. Following three rinses with sterile distilled water, embryos are excised under a dissecting microscope in a laminar flow hood using fine forceps.

Excised embryos (size ~0.3 mm, bell shaped) are placed on callus induction medium (CIM) [LS salts (Linsmaier, E. M. & Skoog, F. 1965. Physiol. *Plantarum* 18, 100) and vitamins plus 3% sucrose, 6 mg/L $CuSO_4$, 2.5 mg/l 2,4-Dichlorophenoxyacetic Acid, pH 5.8 and 0.25% phytagel (Sigma)] scutellar side down, 50 or 100 embryos on a plate, and incubated at 28° C. in the dark. One week later, the embryonic calli is cleaned from emerging shoots and somatic calli, and subcultured onto fresh CIM medium. During culture, yellowish embryogenic calli (EC) appear and are further selected (e.g., picked and transferred) for further incubation in the same conditions for additional 2 weeks. Twenty-five pieces of sub-cultured calli are then separately placed on 90×15 mm petri plates, and incubated as before for three additional weeks.

Transformation—As described in Vogel and Hill (2008, Supra), *Agrobacterium* is scraped off 2-day-old MGL plates (plates with the MGL medium which contains: Tryptone 5 gr/L, Yeast Extract 2.5 gr/L, NaCl 5 gr/L, D-Mannitol 5 g/l, $MgSO_4*7H_2O$ 0.204 gr/L, $K_2HPO_4$ 0.25 gr/L, Glutamic Acid 1.2 gr/L, Plant Agar 7.5 gr/L) and resuspended in liquid MS medium supplemented with 200 µM acetosyringone to an optic density (OD) at 600 nm ($OD_{600}$) of 0.6 to 1.0. Once the desired OD was attained, 1 ml of 10% Synperonic PE/F68 (Sigma) per 100 ml of inoculation medium is added.

To begin inoculation, 300 callus pieces are placed in approximately 12 plates (25 callus pieces in each plate) and covered with the *Agrobacterium* suspension (8-10 ml). The callus is incubated in the *Agrobacterium* suspension for 5 to 20 minutes. After incubation, the *Agrobacterium* suspension is aspirated off and the calli are then transferred into co-cultivation plates, prepared by placing a sterile 7-cm diameter filter paper in an empty 90×15 mm petri plate. The calli pieces are then gently distributed on the filter paper. One co-cultivation plate is used for two starting callus plates (50 initial calli pieces). The co-cultivation plates are then sealed with Parafilm M® or a plastic wrap [e.g., Saran™ wrap (Dow Chemical Company)] and incubated at 24° C. in the dark for 3 days.

The callus pieces are then individually transferred into CIM medium as described above, which is further supplemented with 200 mg/L Ticarcillin (to kill the *Agrobacterium*) and Bialaphos (5 mg/L) or Hygromycin B (40 mg/L) (for selection of the transformed resistant embryogenic calli sections), and incubated at 28° C. in the dark for 14 days.

The calli pieces are then transferred to shoot induction media (SIM; LS salts and vitamins plus 3% Maltose monohydrate) supplemented with 400 mg/L Ticarcillin, Bialaphos (5 mg/L) or Hygromycin B (40 mg/L), Indol-3-acetic acid (IAA) (0.25 mg/L), and 6-Benzylaminopurine (BAP) (1 mg/L), and are cultivated in conditions as described below. After 10-15 days calli are sub-cultured on the same fresh media for additional 10-15 days (total of 20-30 days). At each sub-culture all the pieces from a single callus are kept together to maintain their independence and are incubated under the following conditions: light to a level of 60 lE $m^{-2}$ $s^{-1}$, a 16-hours light, 8-hours dark photoperiod and a constant 24° C. temperature. During the period of 20 to 30 days from the beginning of cultivation of calli on shoot induction media (SIM) plantlets start to emerge from the transformed calli.

When plantlets are large enough to handle without damage, they are transferred to plates containing the above mentioned shoot induction media (SIM) with Bialaphos or Hygromycin B. Each plantlet is considered as a different event. After two weeks of growth, the plantlets are transferred to 2-cm height Petri plates (De Groot, Catalog No. 60-664160) containing MSnoH media (MS salts 4.4 gr/L, sucrose 30 gr/L, supplemented with Hygromycine B (40 mg/L) and Ticarcillin (400 mg/L). Roots usually appear within 2 weeks. Rooted and non-rooted plants are transferred to a fresh MSnoH media supplemented with Hygromycin B and Ticarcillin as described above. In case roots do not appear in the non-rooted plants after two weeks on the MSnoH media (which is supplemented with Hygromycin B and Ticarcillin), then the non-rooted plants are further transferred to the rooting induction medium [RIM; MS salts and vitamins 4.4 gr/L, sucrose 30 gr/L with Ticarcillin 400 mg/L, Indol-3-acetic acid (IAA) (1 mg/L), and α-Naphthalene acetic acid (NAA) (2 mg/L)]. After additional two weeks of incubation at 24° C., the plantlets are transferred to 0.5 modified RIM medium [MS modified salts 4.4 gr/L, MS vitamins 103 mg/L, sucrose 30 gr/L with α-Tocopherol (2 mg/L), Indol-3-acetic acid (IAA) (1 mg/L), and α-Naphthalene acetic acid (NAA) (2 mg/L)] and are incubated at 28° C. for additional 15-20 days, till the roots appear.

If needed, in the tillering stage the plantlets can grow axillary tillers and eventually become bushy on the above mentioned media (SIM) without Bialaphos or Hygromycin B. Each bush from the same plant (event ID) is then divided to tissue culture boxes ("Humus") containing "rooting medium" [MS basal salts, 3% sucrose, 3 gr/L phytagel, 2 mg/L α-Naphthalene Acetic Acid (NAA) and 1 mg/L IAA and Ticarcillin 400 mg/L, PH 5.8]. All plants in a "Humus box" are individual plants of the same transformation event.

When plantlets establish roots they are transplanted to the soil and grown in the greenhouse. Before transfer to greenhouse, 20 randomly selected events are tested every month for expression of the BAR_GA gene (SEQ ID NO:39, BAR gene) which is responsible for resistance to Bialaphos, using AgraStrip® LL strip test seedcheck (Romer labs). Briefly, the expression of the BAR gene is determined as follows: Leaves (about 0.5 cm long leave) are grounded using a pellet pestle in an Eppendorf tube containing 150 µl of water until the water turns green in color. A strip test is then added to the Eppendorf tube and the results are read within 30-60 seconds. Appearance of two pink bands means that the plant is transgenic. On the other hand, appearance of one pink band means that the plant is not transgenic or not expressing BAR gene.

To verify the transgenic status of plants containing the gene of interest, T1 plants are subjected to PCR as previously described by Vogel et al. 2006 [*Agrobacterium* mediated transformation and inbred line development in the model grass *Brachypodium* distachyon. Plant Cell Tiss Org. Cult. 85:199-211].

Example 29

Evaluation of Transgenic *Arabidopsis* for Seed Yield and Plant Growth Rate Under Normal Conditions in Greenhouse Assays (GH-SM Assays)

Each validation trait assay measures the efficacy of specific traits as described in the Table below. In addition to those traits, the genes of some embodiments of the invention improve yield under various conditions (normal conditions as well as abiotic stress conditions such as nitrogen deficiency and drought stress).

TABLE 288

Allocation of *Arabidopsis* parameters to specific traits

| # | Parameters | Traits |
|---|---|---|
| 1 | Flowering | Flowering* |
| 2 | Dry weight | Flowering, Plant biomass and Seed yield |
| 3 | Rosette area | Flowering, Plant biomass and Grain filling period |
| 4 | Leaf blade area | Flowering, Plant biomass and Grain filling period |
| 5 | Leaf petiole length | Flowering and Plant biomass |
| 6 | Seed filling period | Grain filling period |
| 7 | Seed yield | Seed Yield and Grain filling period |
| 8 | Harvest Index | Seed Yield and Harvest Index |

Table 288. *The flowering trait refers to early flowering. Some of the parameters are indirect but will affect the trait, for example, "Dry weight" is effected by "flowering" and can also effect "seed yield". Usually, decrease in time to flowering reduces the "dry weight", and on the other hand, a reduce in "dry weight" can effect "seed yield".

Assay 1: Seed Yield, Plant Biomass and Plant Growth Rate in Greenhouse Conditions Until Seed Maturation (Seed Maturation Assay).

Under Normal conditions—This assay follows seed yield production, the biomass formation and the rosette area growth of plants grown in the greenhouse at non-limiting nitrogen growth conditions. Transgenic *Arabidopsis* seeds were sown in agar media supplemented with ½ Murashige-Skoog medium (MS) medium and a selection agent (Kanamycin). The $T_2$ transgenic seedlings were then transplanted to 1.7 trays filled with peat and perlite in a 1:2 ratio. The plants were grown under normal growth conditions which included irrigation of the trays with a solution containing 6 mM inorganic nitrogen in the form of $KNO_3$, supplemented with 1 mM $KH_2PO_4$, 1 mM $MgSO_4$, 1.5 mM $CaCl_2$ and microelements. Under normal conditions the plants grow in a controlled environment in a closed transgenic greenhouse, temperature about 18-22° C., humidity around 70%. Irrigation was done by flooding with a water solution containing 6 mM N (nitrogen) (as described hereinabove), and flooding was repeated whenever water loss reached 50%. All plants were grown in the greenhouse until mature seeds. Seeds were harvested, extracted and weighted. The remaining plant biomass (the above ground tissue) was also harvested, and weighted immediately or following drying in oven at 50° C. for 24 hours. Under drought conditions and standard growth conditions—This assay follows seed yield production, the biomass formation and the rosette area growth of plants grown in the greenhouse under drought conditions and under standard growth conditions. Transgenic *Arabidopsis* seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress. All plants were grown in the greenhouse until seeds maturation. Seeds were harvested, extracted and weighted. The remaining plant biomass (the above ground tissue) was also harvested, and weighted immediately or following drying in oven at 50° C. for 24 hours.

Under nitrogen limiting (low N) and standard (nitrogen non-limiting) conditions—This assay follows seed yield production, the biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 2.8 mM inorganic nitrogen in the form of $KNO_3$, supplemented with 1 mM $KH_2PO_4$, 1 mM $MgSO_4$, 1.5 mM $CaCl_2$ and microelements, while normal nitrogen levels were achieved by applying a solution of 5.5 mM inorganic nitrogen also in the form of $KNO_3$, supplemented with 1 mM $KH_2PO_4$, 1 mM $MgSO_4$, 1.5 mM $CaCl_2$ and microelements. All plants were grown in the greenhouse until mature seeds. Seeds were harvested, extracted and weight. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying a promoter and the selectable marker were used as control [The promoters which are described in Example 25 above, e.g., the At6669 promoter (SEQ ID NO: 25) or the 35S promoter (SEQ ID NO: 37)].

The plants were analyzed for their overall size, growth rate, flowering, seed yield, 1,000-seed weight, dry matter and harvest index (seed yield/dry matter). Transgenic plants performance was compared to control plants grown in parallel under the same (e.g., identical) conditions. Mock-transgenic plants expressing the uidA reporter gene (GUS-Intron) or with no gene at all, under the same promoter were used as controls.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at/rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area, petiole relative area and leaf petiole length.

Vegetative growth rate: the relative growth rate (RGR) of leaf number [formula 8 (described above)], rosette area (Formula 9, above), plot coverage (Formula 11, above) and harvest index (Formula 15) was calculated with the indicated formulas.

Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot. Dry weight=total weight of the vegetative portion above ground (excluding roots) after drying at 30° C. in a drying chamber; Seed yield per plant=total seed weight per plant (gr.). 1000 seed weight (the weight of 1000 seeds) (gr.).

The measured parameter "flowering" refers to the number of days in which 50% of the plants are flowering (50% or above).

The measured parameter "Inflorescence Emergence" refers to the number of days in which 50% of the plants are bolting (50% or above).

The measured parameter "plot coverage" refers to Rosette Area*plant number.

It should be noted that a negative increment (in percentages) when found in flowering or inflorescence emergence indicates drought avoidance of the plant.

Seed filling period—calculated as days to maturity (day in which 50% of seeds accumulated) minus the days to flowering.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 289-294 summarize the observed phenotypes of transgenic plants exogenously expressing the gene constructs using the seed maturation (GH-SM) assays under normal conditions. The evaluation of each gene was performed by testing the performance of different number of events. Event with p-value <0.1 was considered statistically significant.

TABLE 289

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| CT4 | 96486.3 | — | — | — | 25.2 | 0.25 | -4 | — | — | — |
| CT4 | 96488.2 | — | — | — | — | — | — | 18.1 | 0.22 | -6 |
| CONT. | — | — | — | — | 26.3 | — | — | 19.2 | — | — |
| LYD955 | 98062.3 | 207.5 | 0.15 | 11 | — | — | — | — | — | — |
| LYD955 | 98063.3 | 215.9 | 0.19 | 15 | — | — | — | — | — | — |
| LYD955 | 98064.2 | 229.1 | 0.02 | 22 | — | — | — | — | — | — |
| LYD955 | 98064.3 | — | — | — | 23.2 | 0.21 | -3 | — | — | — |
| LYD954 | 98360.1 | 212.5 | 0.08 | 13 | — | — | — | — | — | — |
| LYD954 | 98360.3 | 218.1 | 0.04 | 16 | — | — | — | — | — | — |
| LYD954 | 98363.2 | 225.0 | L | 20 | — | — | — | — | — | — |
| LYD954 | 98363.4 | 207.8 | 0.09 | 11 | 23.3 | 0.15 | -3 | — | — | — |
| LYD953 | 98244.2 | 206.2 | 0.07 | 10 | — | — | — | — | — | — |
| LYD953 | 98248.4 | — | — | — | 23.2 | 0.02 | -3 | — | — | — |
| LYD951 | 98210.1 | — | — | — | 23.0 | 0.10 | -4 | — | — | — |
| LYD951 | 98212.1 | — | — | — | 23.1 | 0.02 | -4 | — | — | — |
| LYD951 | 98213.1 | — | — | — | 22.9 | L | -4 | — | — | — |
| LYD951 | 98213.3 | — | — | — | 23.5 | 0.28 | -2 | — | — | — |
| LYD950 | 98527.4 | 230.0 | 0.02 | 23 | — | — | — | — | — | — |
| LYD950 | 98529.2 | 200.3 | 0.26 | 7 | — | — | — | — | — | — |
| LYD948 | 98161.1 | — | — | — | 21.0 | L | -12 | — | — | — |
| LYD947 | 98232.1 | 216.9 | 0.06 | 16 | 22.8 | 0.01 | -5 | — | — | — |
| LYD947 | 98232.2 | 207.5 | 0.06 | 11 | — | — | — | — | — | — |
| LYD946 | 98891.2 | 214.7 | L | 15 | 23.4 | 0.07 | -2 | — | — | — |
| LYD946 | 98892.1 | — | — | — | 23.1 | 0.03 | -3 | — | — | — |
| LYD946 | 98893.1 | — | — | — | 21.8 | 0.02 | -9 | — | — | — |
| LYD946 | 98893.2 | — | — | — | 23.2 | 0.02 | -3 | — | — | — |
| LYD946 | 98894.2 | — | — | — | 22.8 | 0.03 | -5 | — | — | — |
| LYD945 | 98204.2 | — | — | — | 23.2 | L | -3 | — | — | — |
| LYD945 | 98206.1 | — | — | — | 23.2 | 0.12 | -3 | — | — | — |
| LYD944 | 98705.2 | 226.6 | L | 21 | — | — | — | — | — | — |
| LYD944 | 98707.1 | — | — | — | 23.0 | L | -4 | — | — | — |
| LYD944 | 98708.1 | 208.4 | 0.15 | 11 | — | — | — | — | — | — |
| LYD943 | 98746.4 | 205.3 | 0.02 | 10 | — | — | — | — | — | — |
| LYD943 | 98748.4 | 199.7 | 0.15 | 7 | 23.1 | 0.04 | -4 | — | — | — |
| LYD943 | 98749.1 | — | — | — | 23.4 | 0.07 | -2 | — | — | — |
| LYD943 | 98749.2 | — | — | — | 22.7 | 0.13 | -5 | — | — | — |
| LYD942 | 98154.2 | 214.4 | L | 14 | — | — | — | — | — | — |
| LYD942 | 98155.3 | 217.8 | L | 16 | — | — | — | — | — | — |
| LYD942 | 98158.1 | 233.8 | L | 25 | — | — | — | — | — | — |
| LYD942 | 98158.3 | 228.1 | L | 22 | — | — | — | — | — | — |
| LYD940 | 98149.1 | 212.5 | 0.02 | 13 | — | — | — | — | — | — |

TABLE 289-continued

Genes showing improved plant performance at Normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LYD940 | 98151.3 | — | — | — | 22.7 | 0.02 | −5 | — | — | — |
| LYD940 | 98152.1 | 214.4 | 0.03 | 14 | — | — | — | — | — | — |
| LYD938 | 98145.2 | — | — | — | 23.1 | 0.08 | −4 | — | — | — |
| LYD938 | 98146.1 | 222.0 | 0.13 | 18 | — | — | — | — | — | — |
| LYD938 | 98147.3 | 220.9 | 0.03 | 18 | — | — | — | — | — | — |
| LYD936 | 98452.3 | 202.2 | 0.18 | 8 | — | — | — | — | — | — |
| LYD935 | 98240.1 | 211.6 | 0.11 | 13 | — | — | — | — | — | — |
| LYD935 | 98240.2 | 233.1 | L | 24 | — | — | — | — | — | — |
| LYD935 | 98241.1 | 224.7 | L | 20 | — | — | — | — | — | — |
| LYD935 | 98241.2 | 231.2 | L | 23 | — | — | — | — | — | — |
| LYD934 | 98479.2 | 210.0 | 0.13 | 12 | 23.5 | 0.24 | −2 | — | — | — |
| LYD934 | 98479.6 | 200.3 | 0.28 | 7 | — | — | — | — | — | — |
| LYD934 | 98480.1 | 199.7 | 0.20 | 7 | — | — | — | — | — | — |
| LYD934 | 98481.2 | 209.1 | 0.11 | 12 | 23.1 | 0.10 | −3 | — | — | — |
| CONT. | — | 187.4 | — | — | 23.9 | — | — | — | — | — |
| LGA15 | 96408.3 | 1169.6 | 0.16 | 8 | — | — | — | — | — | — |
| LGA15 | 96409.3 | 1185.0 | 0.28 | 10 | — | — | — | — | — | — |
| CONT. | — | 1081.2 | — | — | — | — | — | — | — | — |
| LYD955 | 98062.3 | — | — | — | 25.1 | 0.12 | −2 | — | — | — |
| LYD955 | 98063.3 | 319.2 | 0.08 | 14 | — | — | — | — | — | — |
| LYD955 | 98064.2 | — | — | — | 24.3 | L | −5 | — | — | — |
| LYD955 | 98064.3 | 319.4 | L | 14 | — | — | — | — | — | — |
| LYD954 | 98360.1 | 306.8 | 0.10 | 10 | — | — | — | — | — | — |
| LYD954 | 98360.3 | 310.0 | 0.15 | 11 | 24.6 | 0.02 | −4 | — | — | — |
| LYD954 | 98363.4 | 335.0 | 0.19 | 20 | — | — | — | — | — | — |
| LYD953 | 98244.2 | 296.9 | 0.26 | 6 | — | — | — | — | — | — |
| LYD953 | 98248.1 | — | — | — | 25.2 | 0.19 | −1 | — | — | — |
| LYD951 | 98210.1 | 344.4 | 0.04 | 23 | — | — | — | — | — | — |
| LYD951 | 98212.1 | — | — | — | 24.8 | 0.05 | −3 | — | — | — |
| LYD951 | 98213.1 | 317.2 | 0.02 | 14 | 25.3 | 0.17 | −1 | — | — | — |
| LYD951 | 98213.3 | — | — | — | 25.1 | 0.22 | −2 | — | — | — |
| LYD950 | 98527.3 | 338.4 | 0.28 | 21 | — | — | — | — | — | — |
| LYD950 | 98527.4 | 309.1 | 0.21 | 11 | — | — | — | — | — | — |
| LYD950 | 98529.1 | 295.8 | 0.23 | 6 | — | — | — | — | — | — |
| LYD950 | 98529.2 | 308.8 | 0.08 | 11 | — | — | — | — | — | — |
| LYD948 | 98161.1 | — | — | — | 24.3 | 0.04 | −5 | — | — | — |
| LYD948 | 98163.2 | 310.6 | 0.07 | 11 | — | — | — | — | — | — |
| LYD948 | 98163.4 | 295.7 | 0.20 | 6 | — | — | — | — | — | — |
| LYD947 | 98233.2 | 306.5 | 0.14 | 10 | — | — | — | — | — | — |
| LYD947 | 98233.3 | 305.4 | 0.16 | 9 | — | — | — | — | — | — |
| LYD946 | 98893.2 | — | — | — | 24.8 | 0.16 | −3 | — | — | — |
| LYD946 | 98894.2 | — | — | — | 24.3 | 0.04 | −5 | — | — | — |
| LYD945 | 98205.2 | 343.8 | 0.26 | 23 | — | — | — | — | — | — |
| LYD945 | 98205.3 | — | — | — | 24.8 | L | −3 | — | — | — |
| LYD945 | 98206.1 | 311.2 | L | 12 | — | — | — | — | — | — |
| LYD944 | 98705.2 | 310.0 | 0.18 | 11 | — | — | — | — | — | — |
| LYD944 | 98707.1 | 308.8 | 0.06 | 11 | 24.3 | L | −5 | — | — | — |
| LYD944 | 98708.1 | — | — | — | 24.7 | 0.15 | −3 | — | — | — |
| LYD944 | 98708.3 | 315.9 | 0.05 | 13 | — | — | — | — | — | — |
| LYD943 | 98748.4 | 298.8 | 0.26 | 7 | — | — | — | — | — | — |
| LYD943 | 98749.1 | 325.0 | 0.02 | 16 | 25.2 | 0.20 | −1 | — | — | — |
| LYD943 | 98749.2 | — | — | — | 24.9 | 0.19 | −2 | — | — | — |
| LYD942 | 98155.3 | 360.7 | 0.12 | 29 | — | — | — | — | — | — |
| LYD940 | 98149.1 | 304.4 | 0.19 | 9 | — | — | — | — | — | — |
| LYD940 | 98151.3 | — | — | — | 24.5 | L | −4 | — | — | — |
| LYD938 | 98145.2 | 305.9 | 0.02 | 10 | — | — | — | — | — | — |
| LYD938 | 98146.1 | — | — | — | 24.9 | 0.06 | −2 | — | — | — |
| LYD936 | 98450.2 | — | — | — | 24.6 | 0.06 | −4 | — | — | — |
| LYD936 | 98451.2 | 298.8 | 0.23 | 7 | — | — | — | — | — | — |
| LYD935 | 98240.2 | 331.9 | 0.06 | 19 | — | — | — | — | — | — |
| LYD935 | 98241.1 | 315.3 | 0.02 | 13 | — | — | — | — | — | — |
| LYD934 | 98480.1 | — | — | — | 25.3 | 0.22 | −1 | — | — | — |
| CONT. | — | 279.0 | — | — | 25.5 | — | — | — | — | — |
| LGA14 | 96403.2 | 1240.4 | 0.23 | 9 | — | — | — | — | — | — |
| LGA14 | 96407.2 | 1229.6 | 0.28 | 8 | — | — | — | — | — | — |
| CONT. | — | 1142.2 | — | — | — | — | — | — | — | — |
| LGA14 | 96405.2 | 1154.2 | 0.09 | 10 | 25.8 | 0.30 | −2 | — | — | — |

TABLE 289-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGA14 | 96407.2 | 1173.8 | 0.12 | 12 | — | — | — | — | — | — |
| CONT. | — | 1050.6 | — | — | 26.4 | — | — | — | — | — |

Table 289.
"CONT." = Control;
"Ave." = Average;
"% Incr." = % increment;
"p-val." = p-value, L = p < 0.01.
It should be noted that a negative increment (in percentages) when found in flowering or inflorescence emergence indicates drought avoidance of the plant.

TABLE 290

Genes showing improved plant performance at Normal growth conditions under regulation of At6669 promoter

| Gene Name | Event # | Leaf Blade Area [cm$^2$] | | | Leaf Number | | | Plot Coverage [cm$^2$] | | |
|---|---|---|---|---|---|---|---|---|---|---|
| | | Ave. | P-Val. | % Incr. | Ave. | P-Val. | % Incr. | Ave. | P-Val. | % Incr. |
| CT4 | 96487.1 | 0.934 | 0.11 | 20 | — | — | — | 49.5 | 0.18 | 20 |
| CT4 | 96488.1 | 0.823 | 0.25 | 6 | — | — | — | — | — | — |
| CONT. | — | 0.777 | — | — | — | — | — | 41.2 | — | — |
| CT4 | 96486.3 | 1.40 | 0.02 | 14 | — | — | — | 75.9 | 0.16 | 11 |
| CT4 | 96487.1 | 1.43 | 0.18 | 16 | — | — | — | 77.0 | 0.17 | 13 |
| CT4 | 96488.1 | 1.37 | 0.05 | 11 | — | — | — | 75.0 | 0.17 | 10 |
| CT4 | 96488.2 | 1.35 | 0.09 | 10 | — | — | — | 76.2 | 0.18 | 12 |
| CONT. | — | 1.23 | — | — | — | — | — | 68.3 | — | — |
| LGA23 | 96828.2 | — | — | — | 10.1 | 0.24 | 5 | — | — | — |
| LGA23 | 96828.3 | — | — | — | 10.0 | 0.27 | 4 | — | — | — |
| LGA23 | 96833.2 | 0.767 | 0.05 | 9 | 10.1 | L | 5 | 40.5 | 0.10 | 10 |
| CONT. | — | 0.703 | — | — | 9.61 | — | — | 36.8 | — | — |
| LYD955 | 98062.3 | 1.26 | 0.09 | 9 | — | — | — | — | — | — |
| LYD955 | 98064.2 | 1.26 | 0.21 | 10 | — | — | — | — | — | — |
| LYD954 | 98360.1 | 1.21 | 0.16 | 5 | — | — | — | — | — | — |
| LYD954 | 98360.3 | 1.33 | 0.02 | 16 | — | — | — | 79.4 | 0.10 | 15 |
| LYD954 | 98363.4 | 1.37 | 0.09 | 20 | 11.5 | 0.02 | 8 | 89.7 | 0.03 | 29 |
| LYD953 | 98244.2 | 1.22 | 0.25 | 6 | — | — | — | — | — | — |
| LYD953 | 98248.3 | 1.32 | 0.09 | 15 | 11.1 | 0.21 | 3 | 81.0 | 0.13 | 17 |
| LYD951 | 98210.1 | 1.33 | 0.02 | 16 | — | — | — | 80.5 | 0.04 | 16 |
| LYD951 | 98212.1 | 1.35 | 0.01 | 17 | 11.5 | 0.09 | 7 | 84.8 | 0.01 | 22 |
| LYD951 | 98213.1 | 1.28 | 0.01 | 11 | — | — | — | 75.2 | 0.03 | 8 |
| LYD951 | 98213.3 | 1.23 | 0.09 | 7 | 11.2 | 0.19 | 4 | 76.8 | L | 11 |
| LYD950 | 98529.2 | 1.26 | 0.19 | 10 | — | — | — | — | — | — |
| LYD948 | 98161.1 | 1.26 | 0.27 | 10 | — | — | — | — | — | — |
| LYD948 | 98163.1 | 1.22 | 0.26 | 7 | — | — | — | — | — | — |
| LYD948 | 98163.2 | 1.26 | 0.22 | 9 | — | — | — | 79.4 | 0.07 | 14 |
| LYD948 | 98163.4 | 1.22 | 0.30 | 6 | — | — | — | — | — | — |
| LYD947 | 98232.1 | 1.41 | L | 23 | — | — | — | 84.2 | L | 21 |
| LYD946 | 98892.1 | 1.20 | 0.14 | 4 | — | — | — | 72.9 | 0.22 | 5 |
| LYD946 | 98893.2 | 1.29 | L | 12 | 11.6 | 0.03 | 8 | 80.4 | L | 16 |
| LYD946 | 98894.2 | 1.29 | 0.07 | 12 | — | — | — | 77.1 | 0.09 | 11 |
| LYD945 | 98204.2 | 1.34 | L | 17 | — | — | — | 82.7 | 0.03 | 19 |
| LYD945 | 98205.2 | 1.25 | 0.15 | 9 | — | — | — | 82.1 | 0.03 | 18 |
| LYD945 | 98205.3 | 1.34 | 0.12 | 17 | 11.4 | 0.08 | 7 | 84.1 | 0.07 | 21 |
| LYD945 | 98206.1 | 1.29 | 0.14 | 12 | — | — | — | 77.1 | 0.23 | 11 |
| LYD945 | 98207.3 | 1.29 | 0.12 | 12 | 11.0 | 0.12 | 3 | 80.5 | 0.14 | 16 |
| LYD944 | 98705.2 | 1.24 | 0.08 | 8 | — | — | — | — | — | — |
| LYD944 | 98708.1 | 1.22 | 0.24 | 6 | — | — | — | — | — | — |
| LYD943 | 98748.4 | 1.25 | 0.14 | 9 | — | — | — | — | — | — |
| LYD943 | 98749.2 | 1.37 | 0.03 | 19 | — | — | — | 82.6 | 0.09 | 19 |
| LYD942 | 98155.3 | 1.23 | 0.09 | 7 | — | — | — | — | — | — |
| LYD940 | 98149.1 | 1.21 | 0.24 | 5 | — | — | — | — | — | — |
| LYD940 | 98151.3 | 1.30 | 0.01 | 13 | 11.9 | L | 11 | 85.4 | L | 23 |
| LYD936 | 98452.1 | 1.33 | 0.06 | 16 | 11.7 | 0.03 | 9 | 86.1 | 0.02 | 24 |
| LYD936 | 98452.3 | 1.23 | 0.05 | 7 | — | — | — | — | — | — |
| LYD935 | 98239.2 | 1.29 | 0.11 | 12 | — | — | — | 76.7 | 0.30 | 11 |
| LYD935 | 98241.1 | — | — | — | 11.1 | 0.21 | 3 | 75.7 | 0.09 | 9 |

TABLE 290-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD935 | 98241.2 | 1.23 | 0.25 | 7 | — | — | — | — | — | — |
| CONT. | — | 1.15 | — | — | 10.7 | — | — | 69.3 | — | — |
| LGA23 | 96828.4 | — | — | — | — | — | — | 56.5 | 0.27 | 10 |
| CONT. | — | — | — | — | — | — | — | 51.6 | — | — |
| LYD955 | 98063.3 | — | — | — | 11.3 | 0.11 | 5 | — | — | — |
| LYD955 | 98064.2 | 1.23 | 0.30 | 8 | 11.1 | 0.21 | 3 | 74.6 | 0.11 | 12 |
| LYD954 | 98360.3 | 1.25 | 0.01 | 10 | — | — | — | 75.2 | 0.02 | 13 |
| LYD951 | 98212.1 | — | — | — | 11.5 | 0.08 | 7 | 75.4 | 0.20 | 14 |
| LYD951 | 98213.1 | — | — | — | 10.9 | 0.26 | 1 | 69.6 | 0.21 | 5 |
| LYD947 | 98233.3 | 1.21 | 0.12 | 6 | — | — | — | 75.2 | 0.10 | 13 |
| LYD946 | 98893.2 | — | — | — | 11.2 | 0.18 | 4 | — | — | — |
| LYD946 | 98894.2 | 1.36 | 0.16 | 19 | 11.2 | 0.15 | 5 | 81.9 | 0.15 | 23 |
| LYD945 | 98204.2 | — | — | — | 11.0 | 0.25 | 2 | — | — | — |
| LYD945 | 98205.2 | — | — | — | 11.3 | 0.14 | 5 | 77.0 | 0.20 | 16 |
| LYD945 | 98205.3 | — | — | — | 11.3 | L | 5 | 73.0 | 0.12 | 10 |
| LYD943 | 98749.2 | — | — | — | 11.9 | 0.04 | 10 | 74.9 | 0.21 | 13 |
| LYD940 | 98149.1 | 1.19 | 0.29 | 4 | — | — | — | — | — | — |
| LYD940 | 98152.1 | 1.18 | 0.28 | 4 | — | — | — | — | — | — |
| CONT. | — | 1.14 | — | — | 10.8 | — | — | 66.4 | — | — |
| LGA14 | 96403.2 | — | — | — | 10.5 | 0.21 | 7 | 63.7 | 0.22 | 5 |
| CONT. | — | — | — | — | 9.84 | — | — | 60.5 | — | — |
| LGA14 | 96405.2 | — | — | — | 9.83 | 0.28 | 5 | — | — | — |
| CONT. | — | — | — | — | 9.41 | — | — | — | — | — |

Table 290.
"CONT." = Control;
"Ave." = Average;
"% Incr." = % increment;
"p-val." =- p-value, L = p < 0.01.

TABLE 291

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| CT4 | 96487.1 | — | — | — | 7.87 | 0.19 | 19 | 0.451 | 0.10 | 10 |
| CONT. | — | — | — | — | 6.60 | — | — | 0.410 | — | — |
| CT4 | 96486.3 | — | — | — | 12.7 | 0.14 | 13 | 0.583 | 0.07 | 9 |
| CT4 | 96487.1 | — | — | — | 12.7 | 0.18 | 13 | — | — | — |
| CT4 | 96488.1 | — | — | — | 12.1 | 0.29 | 8 | — | — | — |
| CT4 | 96488.2 | — | — | — | 12.5 | 0.27 | 11 | — | — | — |
| CONT. | — | — | — | — | 11.2 | — | — | 0.537 | — | — |
| LGA23 | 96828.1 | 1.15 | 0.19 | 15 | — | — | — | — | — | — |
| LGA23 | 96828.2 | 1.11 | 0.18 | 12 | — | — | — | — | — | — |
| LGA23 | 96828.3 | 1.22 | 0.07 | 22 | 8.21 | 0.19 | 5 | 0.442 | 0.05 | 8 |
| LGA23 | 96833.2 | — | — | — | 8.78 | 0.14 | 12 | 0.516 | 0.06 | 26 |
| CONT. | — | 0.997 | — | — | 7.85 | — | — | 0.410 | — | — |
| LYD955 | 98064.2 | — | — | — | 11.8 | 0.22 | 11 | — | — | — |
| LYD954 | 98360.3 | — | — | — | 12.3 | 0.08 | 16 | 0.517 | 0.16 | 13 |
| LYD954 | 98363.4 | — | — | — | 13.8 | L | 30 | 0.511 | 0.22 | 11 |
| LYD953 | 98248.3 | — | — | — | 12.3 | 0.08 | 16 | — | — | — |
| LYD951 | 98210.1 | — | — | — | 12.4 | 0.05 | 17 | 0.511 | 0.18 | 12 |
| LYD951 | 98212.1 | — | — | — | 12.6 | 0.04 | 19 | — | — | — |
| LYD950 | 98529.2 | — | — | — | 11.9 | 0.17 | 13 | 0.519 | 0.15 | 13 |
| LYD948 | 98161.1 | — | — | — | 12.0 | 0.17 | 13 | — | — | — |
| LYD948 | 98163.2 | — | — | — | 12.1 | 0.11 | 14 | — | — | — |
| LYD947 | 98232.1 | — | — | — | 12.9 | 0.01 | 22 | 0.530 | 0.07 | 16 |
| LYD946 | 98893.2 | — | — | — | 12.2 | 0.09 | 15 | — | — | — |
| LYD946 | 98894.2 | — | — | — | 11.7 | 0.22 | 11 | 0.501 | 0.28 | 9 |
| LYD945 | 98204.2 | — | — | — | 12.7 | 0.03 | 20 | 0.525 | 0.09 | 15 |
| LYD945 | 98205.2 | — | — | — | 12.5 | 0.05 | 18 | — | — | — |
| LYD945 | 98205.3 | — | — | — | 12.8 | 0.02 | 21 | 0.500 | 0.30 | 9 |
| LYD945 | 98207.3 | — | — | — | 12.4 | 0.06 | 17 | 0.502 | 0.28 | 9 |

TABLE 291-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD943 | 98749.2 | — | — | — | 12.5 | 0.04 | 18 | 0.505 | 0.25 | 10 |
| LYD940 | 98151.3 | — | — | — | 12.8 | 0.02 | 21 | — | — | — |
| LYD938 | 98147.2 | 0.623 | 0.21 | 22 | — | — | — | — | — | — |
| LYD936 | 98452.1 | — | — | — | 13.0 | L | 23 | — | — | — |
| LYD935 | 98239.2 | — | — | — | 12.1 | 0.13 | 14 | 0.510 | 0.20 | 11 |
| LYD935 | 98241.1 | — | — | — | 11.7 | 0.23 | 11 | — | — | — |
| LYD934 | 98481.2 | — | — | — | — | — | — | 0.502 | 0.27 | 9 |
| CONT. | — | 0.512 | — | — | 10.6 | — | — | 0.459 | — | — |
| LGA23 | 96828.2 | — | — | — | — | — | — | 0.453 | 0.27 | 4 |
| LGA23 | 96828.3 | — | — | — | — | — | — | 0.465 | 0.08 | 7 |
| LGA23 | 96828.4 | — | — | — | 9.01 | 0.19 | 10 | 0.468 | 0.03 | 8 |
| LGA23 | 96833.2 | — | — | — | — | — | — | 0.467 | 0.03 | 7 |
| CONT. | — | — | — | — | 8.17 | — | — | 0.435 | — | — |
| LYD955 | 98063.3 | 0.675 | 0.18 | 12 | — | — | — | — | — | — |
| LYD955 | 98064.2 | — | — | — | 9.30 | 0.17 | 14 | 0.509 | 0.18 | 10 |
| LYD955 | 98064.3 | 0.645 | 0.18 | 7 | — | — | — | — | — | — |
| LYD954 | 98360.3 | — | — | — | 9.26 | 0.18 | 13 | 0.511 | 0.16 | 10 |
| LYD954 | 98363.2 | 0.655 | 0.23 | 9 | — | — | — | — | — | — |
| LYD953 | 98246.3 | 0.703 | 0.07 | 17 | — | — | — | — | — | — |
| LYD953 | 98248.3 | — | — | — | — | — | — | 0.488 | 0.28 | 5 |
| LYD951 | 98212.1 | — | — | — | 9.30 | 0.17 | 14 | 0.489 | 0.19 | 5 |
| LYD948 | 98161.3 | 0.670 | 0.20 | 11 | — | — | — | — | — | — |
| LYD947 | 98231.4 | 0.668 | 0.21 | 11 | — | — | — | — | — | — |
| LYD947 | 98233.2 | 0.690 | 0.12 | 15 | — | — | — | — | — | — |
| LYD947 | 98233.3 | — | — | — | 9.17 | 0.22 | 12 | — | — | — |
| LYD946 | 98894.2 | — | — | — | 10.1 | 0.02 | 24 | 0.521 | 0.11 | 12 |
| LYD945 | 98205.2 | — | — | — | 9.60 | 0.21 | 18 | 0.514 | 0.16 | 11 |
| LYD945 | 98205.3 | 0.669 | 0.21 | 11 | 9.06 | 0.27 | 11 | 0.488 | 0.17 | 5 |
| LYD944 | 98708.3 | 0.663 | 0.26 | 10 | — | — | — | — | — | — |
| LYD943 | 98749.2 | 0.730 | 0.02 | 21 | 9.33 | 0.16 | 14 | 0.497 | 0.27 | 7 |
| LYD940 | 98149.1 | — | — | — | — | — | — | 0.492 | 0.06 | 6 |
| LYD940 | 98152.1 | — | — | — | — | — | — | 0.488 | 0.27 | 5 |
| LYD938 | 98145.3 | 0.699 | 0.08 | 16 | — | — | — | — | — | — |
| LYD936 | 98452.3 | 0.654 | 0.22 | 9 | — | — | — | — | — | — |
| LYD935 | 98239.2 | 0.640 | 0.24 | 6 | — | — | — | — | — | — |
| LYD935 | 98240.2 | 0.676 | 0.18 | 12 | — | — | — | — | — | — |
| CONT. | — | 0.601 | — | — | 8.17 | — | — | 0.465 | — | — |
| LGA14 | 96403.2 | 0.720 | 0.06 | 20 | — | — | — | — | — | — |
| LGA14 | 96407.2 | 0.664 | 0.23 | 11 | — | — | — | — | — | — |
| CONT. | — | 0.598 | — | — | — | — | — | — | — | — |
| LGA14 | 96403.2 | 0.690 | 0.24 | 12 | — | — | — | — | — | — |
| LGA14 | 96403.3 | 0.667 | 0.30 | 9 | — | — | — | — | — | — |
| LGA14 | 96405.2 | 0.717 | 0.28 | 17 | — | — | — | — | — | — |
| LGA14 | 96407.1 | 0.685 | 0.22 | 12 | — | — | — | — | — | — |
| CONT. | — | 0.614 | — | — | — | — | — | — | — | — |

Table 291.
"CONT." = Control;
"Ave" = Average;
"% Incr." = % increment;
"p-val." = p-value, L = p < 0.01.
RGR = relative growth rate.

TABLE 292

Genes showing improved plant performance at Normal growth conditions under regulation of At6669 promoter

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| CT4 | 96487.1 | — | — | — | 6.18 | 0.18 | 20 | 4.35 | 0.06 | 11 |
| CONT. | — | — | — | — | 5.15 | — | — | 3.93 | — | — |
| CT4 | 96486.2 | 0.237 | 0.29 | 37 | — | — | — | — | — | — |
| CT4 | 96486.3 | 0.249 | 0.18 | 44 | 9.49 | 0.16 | 11 | 5.42 | 0.18 | 4 |
| CT4 | 96487.1 | — | — | — | 9.63 | 0.17 | 13 | — | — | — |

TABLE 292-continued

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| CT4 | 96488.1 | — | — | — | 9.38 | 0.17 | 10 | 5.45 | 0.19 | 5 |
| CT4 | 96488.2 | — | — | — | 9.53 | 0.18 | 12 | 5.41 | 0.14 | 4 |
| CONT. | — | 0.173 | — | — | 8.54 | — | — | 5.20 | — | — |
| LGA23 | 96828.2 | 0.236 | 0.05 | 13 | — | — | — | — | — | — |
| LGA23 | 96828.3 | — | — | — | — | — | — | 3.93 | 0.13 | 3 |
| LGA23 | 96833.2 | — | — | — | 5.06 | 0.10 | 10 | 4.11 | L | 8 |
| CONT. | — | 0.209 | — | — | 4.60 | — | — | 3.80 | — | — |
| LYD955 | 98062.3 | — | — | — | — | — | — | 5.28 | 0.26 | 4 |
| LYD954 | 98360.3 | — | — | — | 9.93 | 0.10 | 15 | 5.48 | 0.14 | 8 |
| LYD954 | 98363.4 | — | — | — | 11.2 | 0.03 | 29 | 5.69 | 0.09 | 13 |
| LYD953 | 98248.3 | — | — | — | 10.1 | 0.13 | 17 | 5.38 | 0.27 | 6 |
| LYD951 | 98210.1 | — | — | — | 10.1 | 0.04 | 16 | 5.56 | 0.04 | 10 |
| LYD951 | 98212.1 | — | — | — | 10.6 | 0.01 | 22 | 5.46 | 0.05 | 8 |
| LYD951 | 98213.1 | — | — | — | 9.40 | 0.03 | 8 | 5.24 | 0.19 | 4 |
| LYD951 | 98213.3 | — | — | — | 9.60 | L | 11 | 5.21 | 0.16 | 3 |
| LYD950 | 98529.2 | — | — | — | — | — | — | 5.37 | 0.23 | 6 |
| LYD948 | 98161.1 | — | — | — | — | — | — | 5.40 | 0.28 | 7 |
| LYD948 | 98163.2 | — | — | — | 9.92 | 0.07 | 14 | 5.34 | 0.10 | 6 |
| LYD947 | 98232.1 | — | — | — | 10.5 | L | 21 | 5.62 | L | 11 |
| LYD946 | 98892.1 | — | — | — | 9.11 | 0.22 | 5 | 5.24 | 0.22 | 4 |
| LYD946 | 98893.2 | — | — | — | 10.1 | L | 16 | 5.35 | L | 6 |
| LYD946 | 98894.2 | — | — | — | 9.63 | 0.09 | 11 | 5.43 | 0.04 | 7 |
| LYD945 | 98204.2 | — | — | — | 10.3 | 0.03 | 19 | 5.59 | L | 11 |
| LYD945 | 98205.2 | — | — | — | 10.3 | 0.03 | 18 | 5.39 | 0.08 | 7 |
| LYD945 | 98205.3 | — | — | — | 10.5 | 0.07 | 21 | 5.48 | 0.08 | 8 |
| LYD945 | 98206.1 | — | — | — | 9.64 | 0.23 | 11 | — | — | — |
| LYD945 | 98207.3 | — | — | — | 10.1 | 0.14 | 16 | 5.36 | 0.26 | 6 |
| LYD944 | 98708.1 | — | — | — | — | — | — | 5.25 | 0.17 | 4 |
| LYD943 | 98749.2 | — | — | — | 10.3 | 0.09 | 19 | 5.57 | 0.09 | 10 |
| LYD940 | 98151.3 | — | — | — | 10.7 | L | 23 | 5.50 | 0.01 | 9 |
| LYD938 | 98145.2 | — | — | — | — | — | — | 5.29 | 0.27 | 5 |
| LYD936 | 98452.1 | — | — | — | 10.8 | 0.02 | 24 | 5.54 | 0.09 | 10 |
| LYD936 | 98452.3 | — | — | — | — | — | — | 5.21 | 0.14 | 3 |
| LYD935 | 98239.2 | — | — | — | 9.58 | 0.30 | 11 | 5.33 | 0.27 | 6 |
| LYD935 | 98241.1 | — | — | — | 9.46 | 0.09 | 9 | — | — | — |
| LYD934 | 98481.2 | — | — | — | — | — | — | 5.32 | 0.11 | 5 |
| CONT. | — | — | — | — | 8.67 | — | — | 5.05 | — | — |
| LGA23 | 96828.2 | 0.240 | 0.12 | 14 | — | — | — | — | — | — |
| LGA23 | 96828.4 | — | — | — | 7.07 | 0.27 | 10 | 4.76 | 0.29 | 5 |
| CONT. | — | 0.211 | — | — | 6.45 | — | — | 4.54 | — | — |
| LGA15 | 96409.1 | 0.288 | 0.21 | 8 | — | — | — | — | — | — |
| CONT. | — | 0.268 | — | — | — | — | — | — | — | — |
| LYD955 | 98064.2 | — | — | — | 9.32 | 0.12 | 12 | 5.38 | L | 7 |
| LYD954 | 98360.3 | — | — | — | 9.40 | 0.03 | 13 | 5.43 | L | 8 |
| LYD951 | 98212.1 | — | — | — | 9.43 | 0.21 | 13 | 5.32 | 0.19 | 6 |
| LYD951 | 98213.1 | — | — | — | 8.70 | 0.27 | 4 | 5.20 | 0.18 | 4 |
| LYD947 | 98233.3 | — | — | — | 9.40 | 0.11 | 13 | 5.20 | 0.28 | 4 |
| LYD946 | 98894.2 | — | — | — | 10.2 | 0.16 | 23 | 5.61 | 0.15 | 12 |
| LYD945 | 98205.2 | — | — | — | 9.63 | 0.21 | 15 | 5.42 | 0.09 | 8 |
| LYD945 | 98205.3 | — | — | — | 9.13 | 0.14 | 9 | 5.22 | 0.13 | 4 |
| LYD943 | 98749.2 | — | — | — | 9.37 | 0.22 | 12 | 5.34 | 0.20 | 7 |
| LYD940 | 98149.1 | — | — | — | — | — | — | 5.17 | 0.18 | 3 |
| LYD940 | 98152.1 | — | — | — | — | — | — | 5.19 | 0.21 | 4 |
| CONT. | — | — | — | — | 8.35 | — | — | 5.01 | — | — |
| LGA14 | 96403.2 | — | — | — | 7.97 | 0.22 | 5 | — | — | — |
| CONT. | — | — | — | — | 7.56 | — | — | — | — | — |

Table 292.
"CONT." = Control;
"Ave." = Average;
"% Incr." = % increment;
"p-val." = p-value, L = p < 0.01.

TABLE 293

Genes showing improved plant performance at Normal growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| CT4 | 96486.2 | 253.2 | 0.24 | 34 | 20.0 | 0.14 | 9 |
| CT4 | 96486.3 | 244.0 | 0.29 | 29 | 18.7 | 0.17 | 2 |
| CONT. | — | 189.0 | — | — | 18.3 | — | — |
| LGA23 | 96828.1 | — | — | — | 21.0 | 0.09 | 9 |
| CONT. | — | — | — | — | 19.3 | — | — |
| LGA23 | 96828.2 | 269.0 | 0.09 | 21 | — | — | — |
| CONT. | — | 223.1 | — | — | — | — | — |
| LGA15 | 96409.1 | 321.5 | 0.21 | 11 | — | — | — |
| CONT. | — | 289.2 | — | — | — | — | — |
| LGA14 | 96403.3 | — | — | — | 18.8 | 0.20 | 4 |
| CONT. | — | — | — | — | 18.1 | — | — |

Table 293.
"CONT." = Control;
"Ave." = Average;
"% Incr." = % increment;
"p-val." = p-value, L = p < 0.01.

TABLE 294

Genes showing improved plant performance at Normal growth conditions under regulation of At6669 promoter

| Gene Name | Event # | Harvest Index | | |
|---|---|---|---|---|
| | | Ave. | P-Val. | % Incr. |
| CT4 | 96486.2 | 0.237 | 0.29 | 37 |
| CT4 | 96486.3 | 0.249 | 0.18 | 44 |
| CONT. | — | 0.173 | — | — |
| LGA23 | 96828.2 | 0.236 | 0.05 | 13 |
| CONT. | — | 0.209 | — | — |
| LGA23 | 96828.2 | 0.240 | 0.12 | 14 |
| CONT. | — | 0.211 | — | — |
| LGA15 | 96409.1 | 0.288 | 0.21 | 8 |
| CONT. | — | 0.268 | — | — |

Table 294. "CONT."—Control; "Ave."—Average; "% Incr." = % increment; "p-val."—p-value, L- p < 0.01.

Tables 295-300 summarize the observed phenotypes of transgenic plants exogenously expressing the gene constructs using the seed maturation (GH-SM) assays under drought conditions. The evaluation of each gene was performed by testing the performance of different number of events. Event with p-value <0.1 was considered statistically significant.

TABLE 295

Genes showing improved plant performance at Drought growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| CT4 | 96488.1 | 823.3 | 0.24 | 3 | — | — | — | — | — | — |
| CONT. | — | 799.2 | — | — | — | — | — | — | — | — |
| LGA23 | 96828.2 | — | — | — | 23.5 | 0.11 | -2 | — | — | — |
| LGA23 | 96828.4 | — | — | — | 23.4 | 0.10 | -2 | 16.3 | 0.12 | -4 |
| LGA23 | 96833.2 | — | — | — | 23.6 | 0.28 | -1 | — | — | — |
| CONT. | — | — | — | — | 23.9 | — | — | 17.0 | — | — |
| LGA15 | 96409.1 | 883.3 | 0.29 | 26 | — | — | — | — | — | — |
| LGA15 | 96413.3 | 901.6 | 0.25 | 29 | — | — | — | — | — | — |
| LGA15 | 96413.4 | 908.3 | 0.24 | 30 | — | — | — | — | — | — |
| CONT. | — | 699.6 | — | — | — | — | — | — | — | — |
| LGA14 | 96403.3 | 831.2 | 0.20 | 5 | — | — | — | — | — | — |
| LGA14 | 96407.2 | 865.0 | 0.15 | 9 | — | — | — | — | — | — |
| CONT. | — | 793.1 | — | — | — | — | — | — | — | — |

Table 295.
"CONT."—Control;
"Ave."—Average;
"% Incr." = % increment;
"p-val."—p-value, L - p < 0.01.
It should be noted that a negative increment (in percentages) when found in flowering or inflorescence emergence indicates drought avoidance of the plant.

TABLE 296

Genes showing improved plant performance at Drought growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| CT4 | 96487.1 | — | — | — | 9.79 | 0.14 | 4 | 48.0 | 0.18 | 12 |
| CT4 | 96488.1 | 0.902 | 0.16 | 11 | — | — | — | 49.6 | 0.08 | 16 |
| CONT. | — | 0.815 | — | — | 9.42 | — | — | 43.0 | — | — |
| CT4 | 96487.1 | 1.31 | 0.05 | 9 | — | — | — | 70.9 | 0.20 | 8 |

TABLE 296-continued

Genes showing improved plant performance at Drought growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 1.21 | — | — | — | — | — | 65.8 | — | — |
| LGA23 | 96828.1 | — | — | — | 9.71 | L | 4 | — | — | — |
| LGA23 | 96828.3 | 0.723 | 0.04 | 12 | 9.88 | 0.05 | 5 | 38.5 | 0.02 | 12 |
| CONT. | — | 0.648 | — | — | 9.38 | — | — | 34.4 | — | — |
| LGA23 | 96828.2 | — | — | — | 9.75 | 0.24 | 5 | — | — | — |
| LGA23 | 96828.3 | 0.897 | 0.04 | 21 | — | — | — | 47.3 | 0.04 | 25 |
| LGA23 | 96828.4 | 0.932 | 0.02 | 25 | — | — | — | 49.9 | 0.02 | 32 |
| LGA23 | 96833.2 | 0.993 | L | 33 | — | — | — | 51.8 | 0.01 | 37 |
| CONT. | — | 0.744 | — | — | 9.28 | — | — | 37.9 | — | — |
| LGA14 | 96403.2 | — | — | — | 9.79 | 0.20 | 3 | — | — | — |
| CONT. | — | — | — | — | 9.47 | — | — | — | — | — |

Table 296.
"CONT."—Control;
"Ave."—Average;
"% Incr." = % increment;
"p-val."—p-value, L - p < 0.01.

TABLE 297

Genes showing improved plant performance at Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| CT4 | 96487.1 | — | — | — | 7.42 | 0.18 | 11 | — | — | — |
| CT4 | 96488.1 | — | — | — | 7.68 | 0.07 | 15 | 0.439 | 0.11 | 6 |
| CONT. | — | — | — | — | 6.67 | — | — | 0.415 | — | — |
| CT4 | 96487.1 | — | — | — | 11.4 | 0.27 | 9 | 0.496 | 0.18 | 6 |
| CONT. | — | — | — | — | 10.5 | — | — | 0.469 | — | — |
| LGA15 | 96409.1 | 0.750 | 0.09 | 22 | — | — | — | — | — | — |
| CONT. | — | 0.613 | — | — | — | — | — | — | — | — |
| LGA23 | 96828.2 | 1.11 | 0.01 | 22 | — | — | — | — | — | — |
| LGA23 | 96828.3 | 1.24 | 0.02 | 35 | 8.54 | L | 18 | 0.452 | 0.06 | 13 |
| LGA23 | 96833.2 | — | — | — | — | — | — | 0.438 | 0.23 | 9 |
| CONT. | — | 0.912 | — | — | 7.23 | — | — | 0.402 | — | — |
| LGA23 | 96828.2 | 0.753 | 0.25 | 12 | — | — | — | — | — | — |
| LGA23 | 96828.3 | — | — | — | 7.23 | 0.05 | 23 | — | — | — |
| LGA23 | 96828.4 | — | — | — | 7.78 | 0.01 | 32 | 0.412 | 0.02 | 18 |
| LGA23 | 96833.2 | — | — | — | 7.92 | 0.01 | 35 | 0.398 | 0.06 | 14 |
| CONT. | — | 0.673 | — | — | 5.88 | — | — | 0.349 | — | — |
| LGA15 | 96413.4 | 0.863 | 0.27 | 16 | — | — | — | — | — | — |
| CONT. | — | 0.747 | — | — | — | — | — | — | — | — |
| LGA14 | 96407.1 | 0.732 | 0.29 | 14 | — | — | — | — | — | — |
| CONT. | — | 0.643 | — | — | — | — | — | — | — | — |

Table 297.
"CONT."—Control;
"Ave."—Average;
"% Incr." = % increment;
"p-val."—p-value, L - p < 0.01.
"RGR" = relative growth rate.

TABLE 298

Genes showing improved plant performance at Drought growth conditions under regulation of At6669 promoter

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| CT4 | 96487.1 | — | — | — | 5.99 | 0.18 | 12 | 4.32 | 0.27 | 6 |
| CT4 | 96488.1 | — | — | — | 6.21 | 0.08 | 16 | 4.35 | 0.19 | 6 |
| CONT. | — | — | — | — | 5.37 | — | — | 4.09 | — | — |
| CT4 | 96487.1 | — | — | — | 8.87 | 0.20 | 8 | 5.33 | L | 7 |
| CT4 | 96488.2 | — | — | — | — | — | — | 5.07 | 0.06 | 2 |
| CONT. | — | — | — | — | 8.22 | — | — | 4.99 | — | — |
| LGA23 | 96828.1 | 0.243 | 0.05 | 10 | — | — | — | — | — | — |
| LGA23 | 96828.2 | 0.253 | 0.07 | 14 | — | — | — | — | — | — |
| LGA23 | 96828.3 | — | — | — | 4.81 | 0.02 | 12 | 3.91 | 0.11 | 5 |
| LGA23 | 96828.4 | — | — | — | — | — | — | 3.87 | 0.14 | 4 |
| LGA23 | 96833.2 | 0.247 | 0.03 | 11 | — | — | — | — | — | — |
| CONT. | — | 0.222 | — | — | 4.30 | — | — | 3.71 | — | — |
| LGA23 | 96828.2 | — | — | — | — | — | — | 4.05 | 0.27 | 7 |
| LGA23 | 96828.3 | — | — | — | 5.91 | 0.04 | 22 | 4.22 | 0.07 | 11 |
| LGA23 | 96828.4 | — | — | — | 6.24 | 0.01 | 29 | 4.46 | 0.01 | 18 |
| LGA23 | 96833.2 | 0.258 | 0.24 | 7 | 6.47 | L | 33 | 4.50 | 0.01 | 19 |
| CONT. | — | 0.241 | — | — | 4.85 | — | — | 3.79 | — | — |
| LGA15 | 96408.3 | — | — | — | — | — | — | 4.25 | 0.24 | 4 |
| CONT. | — | — | — | — | — | — | — | 4.07 | — | — |

Table 298.
"CONT."—Control;
"Ave."—Average;
"% Incr." = % increment;
"p-val."—p-value, L - p < 0.01.

TABLE 299

Genes showing improved plant performance at Drought growth conditions under regulation of At6669 promoter

| Gene Name | Event # | Seed Yield [mg] Ave. | Seed Yield [mg] P-Val. | Seed Yield [mg] % Incr. | 1000 Seed Weight [mg] Ave. | 1000 Seed Weight [mg] P-Val. | 1000 Seed Weight [mg] % Incr. |
|---|---|---|---|---|---|---|---|
| CT4 | 96486.2 | — | — | — | 20.7 | 0.29 | 3 |
| CT4 | 96486.3 | — | — | — | 20.8 | 0.22 | 4 |
| CT4 | 96487.1 | — | — | — | 22.5 | 0.10 | 12 |
| CONT. | — | — | — | — | 20.1 | — | — |
| LGA23 | 96828.1 | 182.6 | 0.07 | 10 | — | — | — |
| LGA23 | 96828.2 | 176.7 | 0.22 | 6 | — | — | — |
| LGA23 | 96828.3 | 180.1 | 0.23 | 9 | — | — | — |
| LGA23 | 96833.2 | 190.1 | 0.02 | 15 | 20.7 | 0.23 | 8 |
| CONT. | — | 165.9 | — | — | 19.2 | — | — |

Table 299.
"CONT."—Control;
"Ave."—Average;
"% Incr." = % increment;
"p-val."—p-value, L - p < 0.01.

TABLE 300

Genes showing improved plant performance at Drought growth conditions under regulation of 6669 promoter

| Gene Name | Event # | Harvest Index Ave. | Harvest Index P-Val. | Harvest Index % Incr. |
|---|---|---|---|---|
| LGA23 | 96828.1 | 0.243 | 0.05 | 10 |
| LGA23 | 96828.2 | 0.253 | 0.07 | 14 |
| LGA23 | 96833.2 | 0.247 | 0.03 | 11 |
| CONT. | — | 0.222 | — | — |
| LGA23 | 96833.2 | 0.258 | 0.24 | 7 |
| CONT. | — | 0.241 | — | — |

Table 300. "CONT."—Control; "Ave."—Average; "% Incr." = % increment; "p-val."—p-value, L- p < 0.01.

Example 30

Evaluation of Transgenic *Arabidopsis* for Seed Yield and Plant Growth Rate Under Normal, Drought and Nitrogen Deficient Conditions in Greenhouse Assays Until Bolting (GH-SB Assays)

Assay 2: Plant Performance Improvement Measured Until Bolting Stage: Plant Biomass and Plant Growth Rate in Greenhouse Conditions (GH-SB Assays)

Under Normal (Standard Conditions)—This assay follows the plant biomass formation and the rosette area growth of plants grown in the greenhouse under normal growth conditions. Transgenic *Arabidopsis* seeds were sown in agar media supplemented with ½ Murashige-Skoog medium (MS) medium and a selection agent (Kanamycin). The $T_2$ transgenic seedlings were then transplanted to 1.7 trays filled with peat and perlite in a 1:2 ratio. Plants were grown under normal conditions which included irrigation of the trays with a solution containing of 6 mM inorganic nitrogen in the form of $KNO_3$ supplemented with 1 mM $KH_2PO_4$, 1 mM $MgSO_4$, 1.5 mM $CaCl_2$ and microelements. Under normal conditions the plants grow in a controlled environment in a closed transgenic greenhouse; temperature was 18-22° C., humidity around 70%; Irrigation was done by flooding with a water solution containing 6 mM N (nitrogen) (as described hereinabove), and flooding was repeated whenever water loss reached 50%. All plants were grown in the greenhouse until bolting stage. Plant biomass (the above ground tissue) was weighted directly after harvesting the rosette (plant fresh weight [FW]). Following plants were dried in an oven at 50° C. for 48 hours and weighted (plant dry weight [DW]).

Under Drought and Standard Growth Conditions—This assay follows the plant biomass formation and the rosette area growth of plants grown in the greenhouse under drought conditions and standard growth conditions. Transgenic *Arabidopsis* seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress (drought conditions). All plants were grown in the greenhouse until bolting stage. At harvest, plant biomass (the above ground tissue) was weighted directly after harvesting the rosette (plant fresh weight [FW]). Thereafter, plants were dried in an oven at 50° C. for 48 hours and weighted (plant dry weight [DW]).

Under limited and optimal nitrogen concentration—This assay follows the plant biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 2.8 mM inorganic nitrogen in the form of $KNO_3$, supplemented with 1 mM $KH_2PO_4$, 1 mM $MgSO_4$, 1.5 mM $CaCl_2$ and microelements, while normal nitrogen levels were achieved by applying a solution of 5.5 mM inorganic nitrogen also in the form of $KNO_3$ supplemented with 1 mM $KH_2PO_4$, 1 mM $MgSO_4$, 1.5 mM $CaCl_2$ and microelements. All plants were grown in the greenhouse until bolting stage. Plant biomass (the above ground tissue) was weighted directly after harvesting the rosette (plant fresh weight [FW]). Following, plants were dried in an oven at 50° C. for 48 hours and weighted (plant dry weight [DW]).

Each construct was validated at its $T_2$ generation. Transgenic plants transformed with a construct conformed by an empty vector carrying a promoter and the selectable marker were used as control [The promoters which are described in Example 25 above, e.g., the At6669 promoter (SEQ ID NO: 25) or the 35S promoter (SEQ ID NO: 37)]. Additionally or alternatively, Mock-transgenic plants expressing the uidA reporter gene (GUS-Intron) or with no gene at all, under the same promoter were used as control.

The plants were analyzed for their overall size, growth rate, fresh weight and dry matter. Transgenic plants performance was compared to control plants grown in parallel under the same conditions. The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area, petiole relative area and leaf petiole length.

Vegetative growth rate: the relative growth rate (RGR) of leaf blade area (Formula 12), leaf number (Formula 8), rosette area (Formula 9), rosette diameter (Formula 10), plot coverage (Formula 11) and Petiole Relative Area (Formula 25) as described above.

Plant Fresh and Dry weight—On about day 80 from sowing, the plants were harvested and directly weighted for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results

Tables 301-303 summarize the observed phenotypes of transgenic plants expressing the genes constructs using the GH-SB Assays.

The genes listed in Tables 300-302 improved plant performance when grown at drought conditions. These genes produced larger plants with a larger photosynthetic area (e.g., leaf number), biomass (fresh weight, dry weight, rosette diameter, rosette area and plot coverage), and relative growth rate (e.g., of leaf number, plot coverage and rosette diameter). The genes were cloned under the regulation of a constitutive At6669 promoter (SEQ ID NO: 25). The evaluation of each gene was performed by testing the performance of different number of events. Event with p-value <0.1 was considered statistically significant.

TABLE 301

Genes showing improved plant performance at Drought growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LGA10 | 96396.6 | 82.1 | 0.21 | 12 | — | — | — | — | — | — |
| CONT. | — | 73.3 | — | — | — | — | — | — | — | — |
| LGA3 | 96419.3 | 95.4 | 0.02 | 19 | 1004.2 | 0.24 | 15 | — | — | — |
| CONT. | — | 80.3 | — | — | 875.0 | — | — | — | — | — |
| LGA3 | 96419.2 | 100.8 | 0.13 | 12 | 1050.0 | L | 17 | 9.96 | 0.15 | 8 |
| LGA3 | 96419.3 | — | — | — | — | — | — | 9.62 | 0.11 | 4 |
| CONT. | — | 90.4 | — | — | 896.9 | — | — | 9.25 | — | — |

Table 301.
"CONT."—Control;
"Ave."—Average;
"% Incr." = % increment;
"p-val."—p-value, L - p < 0.01.

TABLE 302

Genes showing improved plant performance at Drought growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGA3 | 96419.2 | 49.6 | 0.04 | 14 | 6.21 | 0.04 | 14 | 4.46 | 0.08 | 6 |
| CONT. | — | 43.7 | — | — | 5.46 | — | — | 4.21 | — | — |
| LGA10 | 96399.2 | — | — | — | — | — | — | 4.04 | 0.28 | 4 |
| LGA10 | 96401.2 | 45.3 | 0.09 | 13 | 5.66 | 0.09 | 13 | 4.28 | 0.02 | 10 |
| CONT. | — | 40.0 | — | — | 5.00 | — | — | 3.90 | — | — |

Table 302.
"CONT."—Control;
"Ave."—Average;
"% Incr." = % increment;
"p-val."—p-value, L - p < 0.01.

TABLE 303

Genes showing improved plant performance at Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGA3 | 96417.2 | 0.658 | 0.20 | 8 | — | — | — | — | — | — |
| LGA3 | 96419.4 | 0.664 | 0.16 | 9 | — | — | — | — | — | — |
| CONT. | — | 0.609 | — | — | — | — | — | — | — | — |
| LGA3 | 96417.1 | 0.616 | 0.15 | 8 | — | — | — | — | — | — |
| LGA3 | 96417.2 | 0.686 | 0.04 | 20 | — | — | — | — | — | — |
| LGA3 | 96419.2 | 0.638 | 0.06 | 12 | 7.27 | 0.06 | 16 | 0.412 | 0.18 | 7 |
| LGA3 | 96419.3 | 0.710 | 0.05 | 24 | — | — | — | — | — | — |
| CONT. | — | 0.573 | — | — | 6.28 | — | — | 0.386 | — | — |
| LGA10 | 96396.6 | — | — | — | — | — | — | 0.354 | 0.17 | 7 |
| LGA10 | 96399.2 | — | — | — | — | — | — | 0.350 | 0.15 | 5 |

TABLE 303-continued

Genes showing improved plant performance at Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGA10 | 96401.2 | — | — | — | 6.54 | 0.07 | 12 | 0.391 | L | 18 |
| CONT. | — | — | — | — | 5.82 | — | — | 0.332 | — | — |

Table 303.
"CONT."—Control;
"Ave."—Average;
"% Incr." = % increment;
"p-val."—p-value, L - p < 0.01.
"RGR" = relative growth rate.

The genes listed in Tables 304-306 improved plant performance when grown at normal conditions. These genes produced larger plants with a larger photosynthetic area (e.g., leaf number), biomass (e.g., fresh weight, dry weight, rosette diameter, rosette area and plot coverage), and relative growth rate (e.g., of leaf number, plot coverage and rosette diameter). The genes were cloned under the regulation of a constitutive At6669 promoter (SEQ ID NO: 25). The evaluation of each gene was performed by testing the performance of different number of events. Event with p-value <0.1 was considered statistically significant.

TABLE 304

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| MGP36 | 96699.1 | 87.1 | 0.13 | 23 | 833.3 | 0.13 | 14 | — | — | — |
| MGP36 | 96699.2 | — | — | — | — | — | — | 9.04 | 0.16 | 2 |
| MGP36 | 96699.5 | — | — | — | — | — | — | 9.25 | 0.02 | 4 |
| CONT. | — | 70.5 | — | — | 730.4 | — | — | 8.88 | — | — |
| MGP91 | 99108.3 | — | — | — | — | — | — | 11.0 | 0.14 | 7 |
| MGP82 | 99190.1 | 123.8 | 0.13 | 17 | 1937.5 | 0.02 | 22 | 10.8 | 0.22 | 5 |
| MGP82 | 99190.3 | — | — | — | — | — | — | 11.1 | 0.18 | 9 |
| MGP67 | 99103.2 | — | — | — | — | — | — | 11.1 | 0.16 | 8 |
| MGP66 | 99098.2 | 121.9 | 0.03 | 15 | 1843.8 | 0.07 | 16 | 10.9 | 0.14 | 6 |
| MGP63 | 99796.2 | 125.0 | 0.01 | 18 | 1762.5 | 0.18 | 11 | — | — | — |
| MGP63 | 99796.3 | — | — | — | — | — | — | 11.1 | 0.09 | 8 |
| MGP62 | 99258.1 | 118.8 | 0.29 | 12 | — | — | — | — | — | — |
| MGP59 | 98102.7 | 123.8 | 0.02 | 17 | 1856.2 | 0.07 | 17 | 11.3 | 0.17 | 10 |
| MGP53 | 97720.1 | — | — | — | 1787.5 | 0.28 | 13 | — | — | — |
| MGP52 | 97960.1 | — | — | — | — | — | — | 10.8 | 0.21 | 5 |
| MGP51 | 98786.3 | — | — | — | — | — | — | 11.2 | 0.12 | 9 |
| MGP49 | 98051.2 | — | — | — | — | — | — | 11.0 | 0.09 | 7 |
| MGP49 | 98054.2 | — | — | — | — | — | — | 10.8 | 0.24 | 5 |
| MGP48 | 97796.1 | 119.4 | 0.05 | 13 | 1718.8 | 0.30 | 9 | — | — | — |
| MGP48 | 97799.4 | 120.6 | 0.03 | 14 | 1818.8 | 0.09 | 15 | 11.3 | 0.03 | 10 |
| MGP32 | 97788.1 | 115.0 | 0.17 | 8 | — | — | — | — | — | — |
| MGP32 | 97790.4 | 121.2 | 0.03 | 14 | 1800.0 | 0.13 | 14 | 11.9 | 0.01 | 16 |
| CONT. | — | 106.1 | — | — | 1583.9 | — | — | 10.2 | — | — |
| NUE543 | 94149.1 | 103.8 | 0.06 | 26 | 1104.2 | 0.07 | 17 | — | — | — |
| CONT. | — | 82.1 | — | — | 944.6 | — | — | — | — | — |
| MGP62 | 99256.2 | 158.1 | 0.25 | 17 | — | — | — | — | — | — |
| CONT. | — | 135.0 | — | — | — | — | — | — | — | — |
| NUE543 | 94153.3 | 61.7 | 0.13 | 12 | — | — | — | — | — | — |
| CONT. | — | 55.0 | — | — | — | — | — | — | — | — |
| MGP36 | 96696.1 | — | — | — | 987.5 | 0.15 | 7 | — | — | — |
| MGP36 | 96699.1 | — | — | — | 1022.0 | 0.20 | 11 | 9.38 | 0.22 | 3 |
| MGP36 | 96699.2 | 76.2 | 0.29 | 6 | — | — | — | — | — | — |
| MGP36 | 96699.5 | — | — | — | — | — | — | 9.54 | 0.13 | 5 |
| CONT. | — | 72.1 | — | — | 921.4 | — | — | 9.12 | — | — |
| MGP92 | 99112.3 | — | — | — | — | — | — | 10.5 | 0.06 | 6 |
| MGP92 | 99113.3 | — | — | — | 1625.0 | L | 19 | 10.6 | 0.03 | 7 |
| MGP91 | 99105.2 | 145.6 | 0.04 | 13 | 1506.2 | 0.04 | 10 | — | — | — |
| MGP91 | 99108.3 | 138.8 | 0.20 | 7 | 1425.0 | 0.21 | 4 | — | — | — |
| MGP82 | 99191.2 | 168.1 | L | 30 | 1693.8 | 0.06 | 24 | 10.6 | 0.03 | 7 |
| MGP82 | 99194.1 | 153.8 | L | 19 | — | — | — | — | — | — |
| MGP82 | 99194.3 | 145.6 | 0.12 | 13 | — | — | — | — | — | — |

TABLE 304-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| MGP67 | 99102.1 | — | — | — | — | — | — | 10.2 | 0.28 | 3 |
| MGP67 | 99102.3 | — | — | — | — | — | — | 10.8 | L | 9 |
| MGP67 | 99103.2 | 168.8 | 0.09 | 31 | 1787.5 | L | 31 | 10.8 | 0.02 | 9 |
| MGP67 | 99104.1 | 170.6 | L | 32 | 1625.0 | L | 19 | — | — | — |
| MGP66 | 99095.1 | 153.8 | 0.10 | 19 | — | — | — | — | — | — |
| MGP66 | 99096.2 | 145.6 | 0.23 | 13 | — | — | — | — | — | — |
| MGP66 | 99096.3 | 150.0 | 0.14 | 16 | 1481.2 | 0.30 | 8 | — | — | — |
| MGP59 | 98102.7 | 163.1 | 0.29 | 26 | 1693.8 | 0.29 | 24 | 10.9 | 0.10 | 11 |
| MGP53 | 97720.1 | — | — | — | 1593.8 | 0.24 | 17 | — | — | — |
| MGP52 | 97956.2 | 160.6 | L | 24 | 1693.8 | 0.13 | 24 | 11.1 | L | 12 |
| MGP52 | 97958.2 | 138.1 | 0.20 | 7 | — | — | — | — | — | — |
| MGP52 | 97960.1 | 160.6 | 0.05 | 24 | 1731.2 | L | 27 | 11.1 | L | 12 |
| MGP50 | 98460.12 | 146.9 | 0.03 | 14 | 1575.0 | 0.06 | 15 | — | — | — |
| MGP50 | 98460.3 | 170.6 | 0.24 | 32 | — | — | — | — | — | — |
| MGP50 | 98463.3 | 154.4 | L | 19 | 1662.5 | 0.06 | 22 | 11.0 | 0.22 | 11 |
| MGP48 | 97795.1 | 156.9 | L | 21 | 1687.5 | 0.05 | 24 | — | — | — |
| MGP48 | 97796.1 | 171.9 | 0.02 | 33 | 1725.0 | L | 26 | 10.6 | 0.03 | 7 |
| MGP48 | 97799.4 | — | — | — | 1650.0 | 0.29 | 21 | — | — | — |
| MGP46 | 97881.2 | — | — | — | 1556.2 | 0.21 | 14 | — | — | — |
| MGP46 | 97883.1 | 148.8 | 0.29 | 15 | — | — | — | — | — | — |
| MGP45 | 99011.3 | 154.4 | 0.24 | 19 | 1462.5 | 0.09 | 7 | — | — | — |
| MGP45 | 99013.1 | 137.5 | 0.21 | 6 | 1487.5 | 0.09 | 9 | — | — | — |
| MGP45 | 99013.2 | 155.6 | L | 20 | 1587.5 | 0.15 | 16 | — | — | — |
| MGP45 | 99013.3 | 166.2 | L | 29 | 1743.8 | 0.11 | 28 | — | — | — |
| MGP45 | 99014.1 | 148.1 | 0.28 | 15 | 1450.0 | 0.29 | 6 | — | — | — |
| MGP32 | 97788.1 | 184.4 | 0.19 | 43 | — | — | — | — | — | — |
| MGP32 | 97788.3 | — | — | — | — | — | — | 10.3 | 0.23 | 4 |
| MGP32 | 97790.1 | 163.1 | 0.25 | 26 | — | — | — | — | — | — |
| CONT. | — | 129.2 | — | — | 1365.6 | — | — | 9.89 | — | — |
| LYD999 | 100312.1 | — | — | — | — | — | — | 9.75 | 0.16 | 5 |
| LYD983 | 99389.2 | — | — | — | — | — | — | 9.69 | 0.29 | 4 |
| LYD982 | 99041.2 | — | — | — | — | — | — | 9.94 | 0.10 | 7 |
| LYD966 | 100357.1 | — | — | — | — | — | — | 9.75 | 0.16 | 5 |
| LYD966 | 100358.2 | — | — | — | — | — | — | 9.88 | 0.09 | 6 |
| LYD966 | 100359.1 | — | — | — | — | — | — | 10.4 | L | 12 |
| LYD959 | 100309.2 | — | — | — | — | — | — | 9.62 | 0.26 | 3 |
| CONT. | — | — | — | — | — | — | — | 9.32 | — | — |
| LBY310 | 98922.1 | — | — | — | 1781.2 | 0.26 | 11 | — | — | — |
| LBY306 | 98939.2 | — | — | — | — | — | — | 9.75 | 0.16 | 3 |
| LBY306 | 98939.4 | — | — | — | 1843.8 | 0.28 | 14 | — | — | — |
| LBY305 | 98842.3 | — | — | — | 2106.2 | 0.15 | 31 | — | — | — |
| LBY305 | 98843.2 | — | — | — | — | — | — | 9.81 | 0.02 | 4 |
| LBY302 | 98839.2 | 160.6 | 0.01 | 24 | 2012.5 | 0.02 | 25 | — | — | — |
| LBY296 | 98857.1 | — | — | — | 1812.5 | 0.17 | 13 | — | — | — |
| LBY296 | 98857.2 | 146.9 | 0.28 | 13 | — | — | — | — | — | — |
| LBY296 | 98857.3 | 175.0 | 0.02 | 35 | 1962.5 | 0.05 | 22 | — | — | — |
| LBY296 | 98858.3 | — | — | — | — | — | — | 9.56 | 0.29 | 1 |
| LBY295 | 98803.1 | 152.5 | 0.04 | 17 | 2131.2 | 0.30 | 32 | 10.1 | 0.05 | 8 |
| LBY292 | 98932.2 | 147.5 | 0.24 | 13 | 2068.8 | 0.17 | 28 | — | — | — |
| LBY292 | 98932.3 | — | — | — | — | — | — | 10.4 | 0.25 | 11 |
| LBY292 | 98933.2 | — | — | — | — | — | — | 9.81 | 0.24 | 4 |
| LBY290 | 98925.1 | — | — | — | 2031.2 | 0.04 | 26 | — | — | — |
| LBY290 | 98929.2 | 149.4 | 0.07 | 15 | — | — | — | — | — | — |
| LBY290 | 98929.3 | 142.5 | 0.22 | 10 | — | — | — | — | — | — |
| LBY289 | 98963.2 | 156.9 | 0.03 | 21 | 1925.0 | 0.22 | 20 | — | — | — |
| LBY286 | 98915.3 | — | — | — | — | — | — | 9.81 | 0.02 | 4 |
| LBY275 | 98911.1 | — | — | — | — | — | — | 9.62 | 0.09 | 2 |
| LBY275 | 98914.1 | — | — | — | — | — | — | 9.69 | 0.07 | 3 |
| LBY275 | 98914.2 | — | — | — | — | — | — | 9.69 | 0.07 | 3 |
| LBY270 | 98978.1 | — | — | — | 1906.2 | 0.25 | 18 | — | — | — |
| LBY270 | 98978.2 | 159.4 | 0.10 | 23 | 1962.5 | 0.05 | 22 | — | — | — |
| LBY258 | 98955.1 | — | — | — | — | — | — | 9.88 | 0.30 | 5 |
| LBY258 | 98955.2 | 145.6 | 0.22 | 12 | 1893.8 | 0.21 | 18 | 9.56 | 0.29 | 1 |
| LBY258 | 98959.2 | 148.8 | 0.22 | 14 | 2025.0 | 0.02 | 26 | — | — | — |
| LBY258 | 98959.3 | 153.1 | 0.20 | 18 | — | — | — | — | — | — |
| LBY246 | 98830.1 | 173.8 | 0.07 | 34 | 2150.0 | 0.10 | 33 | — | — | — |
| LBY246 | 98832.2 | — | — | — | 1768.8 | 0.26 | 10 | 9.75 | 0.02 | 3 |
| LBY243 | 98906.2 | — | — | — | 1843.8 | 0.12 | 14 | — | — | — |
| LBY237 | 98901.3 | 155.0 | 0.03 | 19 | 1762.5 | 0.28 | 9 | 9.94 | L | 5 |
| CONT. | — | 130.0 | — | — | 1610.7 | — | — | 9.43 | — | — |
| NUE543 | 94149.1 | 103.8 | 0.06 | 26 | 1104.2 | 0.07 | 17 | — | — | — |
| CONT. | — | 82.1 | — | — | 944.6 | — | — | — | — | — |

TABLE 304-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LBY457 | 99546.1 | — | — | — | — | — | — | 12.0 | 0.29 | 4 |
| LBY457 | 99547.2 | — | — | — | — | — | — | 12.4 | 0.04 | 8 |
| LBY457 | 99547.3 | — | — | — | — | — | — | 11.9 | 0.29 | 4 |
| LBY456 | 99525.3 | 165.6 | L | 36 | 1768.8 | 0.20 | 35 | 12.3 | 0.07 | 7 |
| LBY456 | 99527.1 | — | — | — | — | — | — | 12.2 | 0.07 | 6 |
| LBY456 | 99529.2 | 131.9 | 0.15 | 8 | 1487.5 | 0.19 | 13 | — | — | — |
| LBY454 | 99515.1 | — | — | — | — | — | — | 12.1 | 0.19 | 5 |
| LBY454 | 99516.1 | — | — | — | 1631.2 | L | 24 | — | — | — |
| LBY454 | 99517.3 | — | — | — | 1643.8 | L | 25 | 11.9 | 0.29 | 4 |
| LBY454 | 99519.1 | — | — | — | 2068.8 | L | 58 | 12.1 | 0.10 | 5 |
| LBY438 | 99810.2 | 132.5 | 0.09 | 9 | 1475.0 | 0.10 | 12 | — | — | — |
| LBY438 | 99811.1 | — | — | — | — | — | — | 12.2 | 0.12 | 6 |
| LBY438 | 99811.3 | 144.4 | L | 18 | — | — | — | 12.4 | 0.09 | 7 |
| LBY430 | 99760.2 | — | — | — | 1475.0 | 0.13 | 12 | — | — | — |
| LBY430 | 99762.1 | — | — | — | — | — | — | 12.2 | 0.13 | 6 |
| LBY430 | 99762.3 | 132.5 | 0.22 | 9 | — | — | — | 12.2 | 0.07 | 6 |
| LBY430 | 99764.1 | — | — | — | 1681.2 | 0.28 | 28 | — | — | — |
| LBY424 | 99696.1 | — | — | — | — | — | — | 12.0 | 0.18 | 4 |
| LBY424 | 99696.2 | 134.4 | 0.20 | 10 | 1662.5 | L | 27 | — | — | — |
| LBY424 | 99698.2 | 140.6 | 0.01 | 15 | — | — | — | — | — | — |
| LBY422 | 99705.3 | — | — | — | 1425.0 | 0.20 | 9 | — | — | — |
| LBY422 | 99709.2 | 137.5 | 0.28 | 13 | 1531.2 | 0.23 | 17 | — | — | — |
| LBY419 | 99520.3 | — | — | — | — | — | — | 12.1 | 0.19 | 5 |
| LBY419 | 99521.3 | 136.9 | 0.14 | 12 | 1468.8 | 0.16 | 12 | 12.7 | 0.23 | 10 |
| LBY419 | 99522.3 | 136.9 | 0.05 | 12 | 1506.2 | 0.04 | 15 | 12.0 | 0.18 | 4 |
| LBY419 | 99524.3 | — | — | — | 1593.8 | 0.01 | 21 | — | — | — |
| LBY412 | 99626.3 | 137.5 | 0.23 | 13 | 1575.0 | 0.19 | 20 | — | — | — |
| LBY412 | 99629.3 | 142.5 | 0.28 | 17 | — | — | — | — | — | — |
| LBY410 | 99691.1 | 133.8 | 0.06 | 10 | 1581.2 | 0.01 | 20 | — | — | — |
| LBY410 | 99693.1 | — | — | — | — | — | — | 12.2 | 0.08 | 6 |
| LBY410 | 99693.3 | 145.0 | 0.29 | 19 | 1550.0 | 0.03 | 18 | 12.3 | 0.27 | 7 |
| LBY406 | 99758.1 | — | — | — | 1575.0 | 0.11 | 20 | — | — | — |
| LBY406 | 99758.3 | 134.4 | 0.08 | 10 | 1431.2 | 0.22 | 9 | — | — | — |
| LBY406 | 99759.3 | — | — | — | — | — | — | 12.5 | 0.02 | 9 |
| LBY404 | 99686.1 | — | — | — | 1568.8 | 0.25 | 20 | 12.2 | 0.07 | 6 |
| LBY404 | 99686.3 | 141.2 | 0.01 | 16 | 1606.2 | 0.24 | 22 | — | — | — |
| LBY404 | 99687.1 | — | — | — | 1650.0 | 0.02 | 26 | — | — | — |
| LBY401 | 99704.1 | — | — | — | — | — | — | 12.2 | 0.12 | 6 |
| LBY401 | 99704.2 | — | — | — | — | — | — | 12.4 | 0.09 | 7 |
| LBY380 | 99752.2 | 135.6 | 0.04 | 11 | 1425.0 | 0.19 | 9 | — | — | — |
| LBY380 | 99753.1 | — | — | — | — | — | — | 12.4 | 0.04 | 7 |
| LBY380 | 99754.1 | 153.8 | 0.28 | 26 | 1712.5 | 0.22 | 30 | — | — | — |
| LBY357 | 99540.1 | — | — | — | — | — | — | 12.3 | 0.16 | 7 |
| LBY357 | 99541.1 | — | — | — | 1481.2 | 0.07 | 13 | 12.4 | 0.03 | 8 |
| LBY357 | 99542.2 | — | — | — | — | — | — | 12.8 | 0.01 | 11 |
| LBY355 | 99536.2 | 138.1 | 0.03 | 13 | 1493.8 | 0.06 | 14 | — | — | — |
| LBY355 | 99538.3 | 147.5 | 0.26 | 21 | 1525.0 | 0.03 | 16 | — | — | — |
| LBY355 | 99539.1 | — | — | — | 1743.8 | 0.01 | 33 | 12.2 | 0.07 | 6 |
| LBY318 | 99930.2 | — | — | — | 1443.8 | 0.14 | 10 | — | — | — |
| LBY318 | 99932.1 | — | — | — | — | — | — | 12.3 | 0.16 | 7 |
| LBY318 | 99933.3 | — | — | — | 1537.5 | 0.05 | 17 | — | — | — |
| LBY312 | 99482.1 | 137.5 | 0.28 | 13 | 1475.0 | 0.08 | 12 | — | — | — |
| LBY312 | 99483.2 | — | — | — | 1725.0 | L | 31 | — | — | — |
| LBY312 | 99484.2 | — | — | — | 1431.2 | 0.22 | 9 | — | — | — |
| CONT. | — | 122.0 | — | — | 1312.5 | — | — | 11.5 | — | — |
| LBY308 | 98700.2 | — | — | — | — | — | — | 12.0 | 0.18 | 5 |
| LBY308 | 98701.2 | — | — | — | — | — | — | 12.1 | 0.09 | 6 |
| LBY308 | 98702.2 | — | — | — | — | — | — | 12.9 | L | 13 |
| LBY308 | 98702.3 | — | — | — | — | — | — | 12.2 | 0.27 | 7 |
| LBY303 | 98660.2 | — | — | — | — | — | — | 11.8 | 0.25 | 4 |
| LBY303 | 98660.3 | 146.9 | 0.30 | 8 | — | — | — | 12.2 | 0.02 | 8 |
| LBY303 | 98663.2 | — | — | — | — | — | — | 11.9 | 0.15 | 4 |
| LBY303 | 98664.2 | — | — | — | — | — | — | 12.2 | 0.30 | 8 |
| LBY282 | 98587.1 | — | — | — | — | — | — | 12.2 | 0.03 | 7 |
| LBY282 | 98588.2 | 165.6 | 0.02 | 22 | 1837.5 | 0.25 | 10 | — | — | — |
| LBY281 | 98741.1 | — | — | — | — | — | — | 12.7 | L | 11 |
| LBY281 | 98743.2 | — | — | — | — | — | — | 11.9 | 0.26 | 4 |
| LBY281 | 98744.1 | 150.6 | 0.15 | 11 | 1893.8 | 0.28 | 13 | 12.3 | 0.03 | 8 |
| LBY281 | 98744.2 | — | — | — | — | — | — | 11.9 | 0.12 | 4 |
| LBY280 | 98580.3 | — | — | — | — | — | — | 12.2 | 0.16 | 7 |
| LBY280 | 98584.2 | — | — | — | — | — | — | 12.2 | 0.19 | 8 |
| LBY278 | 98735.1 | — | — | — | — | — | — | 12.6 | 0.11 | 11 |

TABLE 304-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LBY278 | 98735.3 | — | — | — | 2137.5 | 0.21 | 28 | 12.9 | 0.02 | 13 |
| LBY278 | 98736.2 | — | — | — | 2200.0 | 0.12 | 32 | 12.8 | 0.09 | 12 |
| LBY278 | 98737.1 | — | — | — | 1993.8 | 0.27 | 19 | — | — | — |
| LBY278 | 98737.2 | 161.2 | 0.03 | 19 | 2031.2 | 0.03 | 22 | 12.2 | 0.16 | 7 |
| LBY272 | 98645.1 | — | — | — | — | — | — | 11.9 | 0.12 | 4 |
| LBY272 | 98645.2 | 173.8 | 0.15 | 28 | 2081.2 | 0.02 | 25 | 12.2 | 0.08 | 8 |
| LBY272 | 98646.1 | — | — | — | — | — | — | 12.1 | 0.04 | 6 |
| LBY272 | 98649.3 | — | — | — | — | — | — | 12.0 | 0.18 | 5 |
| LBY269 | 98775.5 | — | — | — | — | — | — | 12.3 | 0.03 | 8 |
| LBY269 | 98775.6 | — | — | — | — | — | — | 12.2 | 0.16 | 7 |
| LBY269 | 98776.4 | — | — | — | — | — | — | 12.4 | 0.01 | 9 |
| LBY269 | 98778.1 | 162.5 | 0.02 | 20 | 2037.5 | 0.08 | 22 | 12.2 | 0.02 | 8 |
| LBY268 | 98595.2 | 159.4 | 0.04 | 18 | 1937.5 | 0.12 | 16 | — | — | — |
| LBY268 | 98597.2 | — | — | — | — | — | — | 12.1 | 0.24 | 6 |
| LBY268 | 98597.3 | — | — | — | — | — | — | 12.4 | 0.28 | 9 |
| LBY266 | 98592.1 | — | — | — | — | — | — | 12.3 | 0.12 | 8 |
| LBY266 | 98592.3 | — | — | — | — | — | — | 12.2 | 0.06 | 7 |
| LBY266 | 98592.4 | — | — | — | — | — | — | 12.4 | 0.01 | 9 |
| LBY259 | 98640.2 | — | — | — | — | — | — | 12.1 | 0.12 | 6 |
| LBY259 | 98641.2 | — | — | — | 1925.0 | 0.21 | 15 | 12.2 | 0.06 | 7 |
| LBY259 | 98642.1 | — | — | — | — | — | — | 12.1 | 0.04 | 6 |
| LBY259 | 98643.1 | — | — | — | — | — | — | 11.9 | 0.15 | 4 |
| LBY249 | 98665.2 | — | — | — | — | — | — | 12.2 | 0.19 | 8 |
| LBY249 | 98667.1 | — | — | — | — | — | — | 11.7 | 0.27 | 3 |
| LBY249 | 98667.2 | — | — | — | — | — | — | 12.7 | L | 11 |
| LBY249 | 98668.1 | — | — | — | — | — | — | 12.6 | 0.24 | 10 |
| LBY249 | 98668.2 | — | — | — | — | — | — | 12.4 | 0.09 | 9 |
| LBY248 | 98637.2 | — | — | — | — | — | — | 12.1 | 0.21 | 6 |
| LBY248 | 98639.3 | — | — | — | 1937.5 | 0.22 | 16 | — | — | — |
| LBY247 | 98630.1 | 148.1 | 0.21 | 9 | — | — | — | — | — | — |
| LBY247 | 98632.2 | — | — | — | — | — | — | 12.1 | 0.09 | 6 |
| LBY247 | 98634.2 | — | — | — | — | — | — | 11.9 | 0.15 | 5 |
| LBY244 | 98570.1 | 152.5 | 0.21 | 13 | 1925.0 | 0.14 | 15 | — | — | — |
| LBY244 | 98572.2 | — | — | — | — | — | — | 11.8 | 0.27 | 3 |
| LBY244 | 98573.3 | — | — | — | — | — | — | 11.8 | 0.27 | 3 |
| LBY244 | 98573.4 | — | — | — | — | — | — | 11.9 | 0.09 | 5 |
| LBY240 | 98566.1 | — | — | — | — | — | — | 13.0 | 0.19 | 14 |
| LBY240 | 98568.2 | — | — | — | — | — | — | 11.9 | 0.15 | 4 |
| LBY238 | 98627.1 | — | — | — | — | — | — | 11.8 | 0.25 | 4 |
| CONT. | — | 135.5 | — | — | 1671.4 | — | — | 11.4 | — | — |
| LYD996 | 99039.4 | — | — | — | — | — | — | 9.88 | 0.26 | 3 |
| LYD993 | 99437.3 | 96.2 | 0.25 | 15 | 1093.8 | 0.06 | 8 | 10.0 | 0.13 | 5 |
| LYD991 | 99557.2 | — | — | — | 1075.0 | 0.18 | 6 | — | — | — |
| LYD991 | 99557.3 | — | — | — | — | — | — | 10.2 | 0.03 | 7 |
| LYD991 | 99558.1 | 91.2 | 0.07 | 9 | 1081.2 | 0.08 | 7 | — | — | — |
| LYD985 | 99612.3 | — | — | — | — | — | — | 10.2 | 0.23 | 7 |
| LYD984 | 99391.1 | — | — | — | 1212.5 | 0.08 | 20 | — | — | — |
| LYD979 | 99165.2 | — | — | — | 1068.8 | 0.01 | 5 | — | — | — |
| LYD979 | 99168.1 | 94.4 | 0.17 | 13 | 1068.8 | 0.29 | 5 | — | — | — |
| LYD978 | 99550.3 | 89.4 | 0.29 | 7 | — | — | — | — | — | — |
| LYD977 | 99601.1 | — | — | — | 1050.0 | 0.14 | 4 | — | — | — |
| LYD971 | 99116.2 | 90.6 | 0.12 | 8 | — | — | — | — | — | — |
| LYD971 | 99118.2 | — | — | — | — | — | — | 9.94 | 0.15 | 4 |
| LYD971 | 99119.3 | — | — | — | — | — | — | 10.2 | 0.26 | 7 |
| LYD969 | 99360.2 | — | — | — | 1100.0 | L | 8 | — | — | — |
| LYD963 | 99299.2 | — | — | — | 1112.5 | 0.09 | 10 | — | — | — |
| LYD962 | 99138.1 | 100.6 | 0.02 | 20 | — | — | — | — | — | — |
| CONT. | — | 83.8 | — | — | 1014.3 | — | — | 9.55 | — | — |
| LBY457 | 99546.1 | — | — | — | 1531.2 | 0.10 | 10 | — | — | — |
| LBY457 | 99546.3 | 141.9 | L | 19 | — | — | — | — | — | — |
| LBY457 | 99547.2 | 152.5 | L | 28 | 1706.2 | L | 22 | 11.1 | 0.10 | 9 |
| LBY456 | 99525.3 | 153.8 | 0.08 | 29 | 1725.0 | L | 24 | 11.1 | L | 9 |
| LBY456 | 99529.1 | 140.0 | 0.09 | 17 | 1587.5 | 0.03 | 14 | 10.8 | 0.03 | 5 |
| LBY454 | 99515.1 | — | — | — | 1568.8 | 0.01 | 13 | 11.1 | 0.28 | 8 |
| LBY454 | 99517.3 | 134.4 | 0.04 | 13 | 1487.5 | 0.10 | 7 | — | — | — |
| LBY454 | 99518.1 | 132.5 | 0.06 | 11 | — | — | — | — | — | — |
| LBY454 | 99519.1 | 160.0 | 0.09 | 34 | 1643.8 | L | 18 | — | — | — |
| LBY438 | 99814.3 | 133.1 | 0.11 | 12 | 1556.2 | 0.07 | 12 | — | — | — |
| LBY430 | 99762.1 | 153.8 | L | 29 | 1837.5 | L | 32 | 12.3 | 0.23 | 20 |
| LBY430 | 99763.2 | 136.9 | 0.02 | 15 | 1525.0 | 0.03 | 9 | — | — | — |
| LBY430 | 99764.1 | 129.4 | 0.13 | 8 | 1481.2 | 0.17 | 6 | 10.8 | 0.03 | 5 |
| LBY424 | 99696.2 | 158.8 | 0.30 | 33 | 1650.0 | L | 18 | 11.2 | 0.27 | 10 |

TABLE 304-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LBY424 | 99696.3 | 144.4 | 0.20 | 21 | 1525.0 | 0.08 | 9 | — | — | — |
| LBY424 | 99699.3 | 145.6 | 0.07 | 22 | — | — | — | — | — | — |
| LBY422 | 99705.3 | — | — | — | — | — | — | 10.5 | 0.30 | 2 |
| LBY419 | 99522.2 | — | — | — | — | — | — | 10.7 | 0.05 | 4 |
| LBY412 | 99625.3 | — | — | — | — | — | — | 11.1 | L | 9 |
| LBY412 | 99629.1 | 168.8 | L | 41 | 1756.2 | L | 26 | 10.8 | 0.11 | 5 |
| LBY412 | 99629.2 | 152.5 | 0.18 | 28 | 1687.5 | L | 21 | 11.9 | 0.09 | 16 |
| LBY412 | 99629.3 | — | — | — | — | — | — | 10.5 | 0.30 | 2 |
| LBY410 | 99691.1 | — | — | — | 1456.2 | 0.24 | 5 | — | — | — |
| LBY410 | 99693.1 | 150.0 | 0.01 | 26 | 1712.5 | 0.04 | 23 | 12.5 | L | 22 |
| LBY410 | 99693.2 | — | — | — | — | — | — | 10.8 | 0.07 | 5 |
| LBY410 | 99694.2 | 156.9 | L | 32 | 1600.0 | 0.02 | 15 | 11.1 | L | 9 |
| LBY406 | 99755.2 | 129.4 | 0.22 | 8 | — | — | — | — | — | — |
| LBY406 | 99756.1 | 134.4 | 0.14 | 13 | — | — | — | 11.1 | 0.21 | 9 |
| LBY406 | 99758.1 | 136.9 | 0.02 | 15 | — | — | — | 10.6 | 0.14 | 4 |
| LBY404 | 99685.3 | 163.8 | 0.03 | 37 | 1681.2 | 0.11 | 21 | 11.9 | 0.18 | 16 |
| LBY404 | 99686.1 | — | — | — | — | — | — | 11.2 | 0.07 | 10 |
| LBY404 | 99686.3 | 168.8 | 0.07 | 41 | 1806.2 | L | 30 | 12.2 | L | 20 |
| LBY404 | 99687.1 | — | — | — | — | — | — | 10.9 | 0.01 | 6 |
| LBY401 | 99701.1 | 156.2 | L | 31 | 1681.2 | 0.07 | 21 | 10.9 | 0.03 | 6 |
| LBY401 | 99702.1 | — | — | — | 1543.8 | 0.02 | 11 | — | — | — |
| LBY401 | 99703.2 | 130.6 | 0.10 | 10 | — | — | — | 10.7 | 0.05 | 4 |
| LBY401 | 99704.1 | — | — | — | 1612.5 | L | 16 | 11.2 | 0.18 | 10 |
| LBY401 | 99704.2 | 158.1 | 0.23 | 33 | 1675.0 | L | 20 | 11.6 | L | 13 |
| LBY380 | 99752.2 | 138.8 | 0.01 | 16 | — | — | — | — | — | — |
| LBY357 | 99540.1 | 135.0 | 0.03 | 13 | 1512.5 | 0.06 | 9 | 11.1 | L | 8 |
| LBY357 | 99543.1 | — | — | — | — | — | — | 10.6 | 0.14 | 4 |
| LBY355 | 99536.2 | 137.5 | 0.17 | 15 | — | — | — | — | — | — |
| LBY355 | 99537.2 | 138.8 | 0.25 | 16 | — | — | — | — | — | — |
| LBY355 | 99539.1 | 158.8 | L | 33 | 1556.2 | 0.01 | 12 | — | — | — |
| LBY318 | 99932.1 | 142.5 | L | 19 | 1656.2 | 0.27 | 19 | 10.9 | 0.07 | 7 |
| LBY318 | 99932.2 | 149.4 | L | 25 | 1612.5 | L | 16 | 11.4 | 0.02 | 12 |
| LBY318 | 99933.1 | — | — | — | — | — | — | 10.6 | 0.14 | 4 |
| LBY312 | 99482.1 | 148.8 | 0.02 | 25 | 1562.5 | 0.26 | 12 | 10.9 | L | 7 |
| LBY312 | 99484.1 | 131.9 | 0.07 | 11 | 1493.8 | 0.08 | 7 | 11.2 | 0.07 | 10 |
| LBY312 | 99484.2 | 156.2 | 0.13 | 31 | 1631.2 | 0.10 | 17 | 10.8 | 0.11 | 5 |
| CONT. | — | 119.3 | — | — | 1392.9 | — | — | 10.2 | — | — |
| LYD983 | 99386.1 | 153.8 | 0.18 | 24 | — | — | — | — | — | — |
| LYD980 | 99787.2 | — | — | — | — | — | — | 11.1 | L | 10 |
| LYD980 | 99788.2 | 156.2 | 0.18 | 26 | — | — | — | 10.7 | 0.13 | 6 |
| LYD965_H1 | 100228.1 | — | — | — | — | — | — | 10.6 | 0.12 | 5 |
| LYD961 | 99783.1 | — | — | — | — | — | — | 10.6 | 0.22 | 4 |
| LYD959 | 100309.2 | — | — | — | — | — | — | 10.8 | 0.03 | 7 |
| CONT. | — | 123.8 | — | — | — | — | — | 10.1 | — | — |
| LBY451 | 100171.2 | 93.8 | 0.08 | 25 | 1193.8 | 0.17 | 24 | 10.8 | 0.02 | 8 |
| LBY451 | 100173.3 | — | — | — | 1187.5 | 0.28 | 23 | 10.8 | 0.26 | 8 |
| LBY442 | 100163.2 | 90.3 | 0.14 | 20 | — | — | — | — | — | — |
| LBY435 | 100201.2 | — | — | — | — | — | — | 10.4 | 0.20 | 5 |
| LBY435 | 100204.3 | 89.4 | 0.13 | 19 | 1118.8 | 0.05 | 16 | 10.6 | 0.05 | 6 |
| LBY435 | 100204.4 | — | — | — | — | — | — | 11.1 | 0.02 | 11 |
| LBY434 | 99900.2 | 101.2 | 0.02 | 35 | 1300.0 | L | 35 | 11.2 | L | 13 |
| LBY434 | 99901.3 | 99.4 | 0.05 | 32 | 1225.0 | 0.02 | 27 | — | — | — |
| LBY427 | 100186.1 | 104.4 | 0.03 | 39 | 1362.5 | 0.16 | 42 | — | — | — |
| LBY427 | 100186.2 | 89.4 | 0.15 | 19 | 1131.2 | 0.22 | 18 | — | — | — |
| LBY427 | 100186.4 | — | — | — | — | — | — | 10.9 | 0.22 | 10 |
| LBY427 | 100187.2 | — | — | — | — | — | — | 10.5 | 0.08 | 5 |
| LBY423 | 100199.2 | — | — | — | 1162.5 | 0.06 | 21 | 11.3 | 0.28 | 13 |
| LBY421 | 100035.3 | — | — | — | 1312.5 | 0.19 | 36 | — | — | — |
| LBY421 | 100036.2 | — | — | — | 1143.8 | 0.06 | 19 | — | — | — |
| LBY421 | 100038.1 | 98.1 | 0.25 | 30 | 1256.2 | L | 31 | 10.9 | L | 10 |
| LBY421 | 100039.3 | — | — | — | — | — | — | 10.5 | 0.23 | 5 |
| LBY413 | 100230.2 | — | — | — | — | — | — | 11.5 | 0.08 | 15 |
| LBY413 | 100233.2 | 91.2 | 0.09 | 21 | 1231.2 | 0.03 | 28 | — | — | — |
| LBY409 | 99502.1 | — | — | — | 1237.5 | 0.25 | 29 | — | — | — |
| LBY409 | 99502.2 | — | — | — | 1118.8 | 0.19 | 16 | 10.4 | 0.19 | 4 |
| LBY409 | 99504.1 | 90.0 | 0.12 | 20 | 1231.2 | L | 28 | — | — | — |
| LBY409 | 99504.2 | 120.0 | 0.07 | 60 | 1487.5 | 0.11 | 55 | 11.0 | 0.06 | 10 |
| LBY378 | 100222.2 | — | — | — | 1093.8 | 0.09 | 14 | — | — | — |
| LBY377 | 99960.2 | — | — | — | — | — | — | 10.3 | 0.23 | 3 |
| LBY377 | 99961.2 | — | — | — | — | — | — | 10.6 | 0.05 | 6 |
| LBY377 | 99964.2 | — | — | — | 1200.0 | 0.03 | 25 | — | — | — |
| LBY364 | 100325.2 | 96.4 | 0.19 | 28 | 1292.9 | L | 34 | — | — | — |

TABLE 304-continued

Genes showing improved plant performance at normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LBY352 | 100075.2 | 100.6 | 0.02 | 34 | 1343.8 | 0.05 | 40 | 11.6 | 0.14 | 16 |
| LBY352 | 100078.2 | — | — | — | 1243.8 | 0.26 | 29 | 11.0 | L | 10 |
| LBY352 | 100079.2 | 104.4 | 0.24 | 39 | 1318.8 | 0.03 | 37 | 10.9 | 0.01 | 9 |
| LBY311 | 100135.3 | 104.4 | 0.27 | 39 | 1246.4 | 0.13 | 30 | 11.5 | 0.15 | 15 |
| LBY311 | 100136.3 | — | — | — | 1156.2 | 0.18 | 20 | — | — | — |
| LBY311 | 100139.3 | 123.1 | L | 64 | 1531.2 | L | 59 | 11.6 | L | 16 |
| CONT. | — | 75.2 | — | — | 962.0 | — | — | 9.98 | — | — |
| LBY308 | 98703.2 | 158.8 | 0.18 | 14 | 2100.0 | L | 15 | — | — | — |
| LBY303 | 98660.3 | 163.8 | 0.17 | 18 | 2125.0 | 0.04 | 16 | — | — | — |
| LBY303 | 98663.2 | 151.9 | 0.20 | 9 | — | — | — | — | — | — |
| LBY282 | 98588.2 | — | — | — | 1993.8 | 0.07 | 9 | — | — | — |
| LBY281 | 98743.1 | — | — | — | 2037.5 | 0.14 | 11 | — | — | — |
| LBY281 | 98744.1 | 148.8 | 0.05 | 7 | 2000.0 | 0.02 | 9 | — | — | — |
| LBY280 | 98581.3 | — | — | — | 2181.2 | 0.13 | 19 | — | — | — |
| LBY278 | 98736.2 | — | — | — | 2343.8 | 0.12 | 28 | — | — | — |
| LBY272 | 98645.1 | 151.9 | 0.02 | 9 | 2031.2 | L | 11 | — | — | — |
| LBY269 | 98775.3 | 166.2 | L | 20 | 2187.5 | 0.20 | 20 | — | — | — |
| LBY269 | 98775.5 | — | — | — | 2050.0 | 0.18 | 12 | 10.6 | 0.22 | 4 |
| LBY269 | 98775.6 | 218.1 | 0.02 | 57 | 2675.0 | L | 46 | 11.1 | 0.02 | 9 |
| LBY268 | 98597.2 | 161.9 | L | 16 | 2237.5 | 0.15 | 22 | — | — | — |
| LBY266 | 98592.4 | 162.5 | 0.26 | 17 | 2037.5 | L | 11 | — | — | — |
| LBY266 | 98594.1 | 150.0 | 0.03 | 8 | 1906.2 | 0.26 | 4 | — | — | — |
| LBY259 | 98640.2 | — | — | — | — | — | — | 10.8 | 0.13 | 5 |
| LBY259 | 98641.2 | 185.6 | 0.11 | 33 | 2368.8 | L | 29 | — | — | — |
| LBY259 | 98643.1 | 150.0 | 0.03 | 8 | — | — | — | — | — | — |
| LBY249 | 98667.2 | 156.2 | 0.21 | 12 | — | — | — | — | — | — |
| LBY248 | 98639.3 | 146.2 | 0.26 | 5 | 2100.0 | 0.13 | 15 | — | — | — |
| LBY247 | 98630.1 | 158.1 | L | 14 | 2050.0 | L | 12 | — | — | — |
| LBY247 | 98632.1 | 170.0 | 0.22 | 22 | 2150.0 | 0.13 | 17 | — | — | — |
| LBY247 | 98634.2 | 146.9 | 0.28 | 6 | — | — | — | — | — | — |
| LBY244 | 98570.1 | — | — | — | 1937.5 | 0.09 | 6 | — | — | — |
| LBY244 | 98572.2 | — | — | — | 2331.2 | 0.29 | 27 | — | — | — |
| LBY240 | 98568.1 | 145.6 | 0.25 | 5 | 1956.2 | 0.06 | 7 | — | — | — |
| CONT. | — | 139.1 | — | — | 1830.4 | — | — | 10.2 | — | — |
| LYD998 | 99034.1 | — | — | — | — | — | — | 11.1 | 0.16 | 4 |
| LYD996 | 99037.3 | — | — | — | 2200.0 | 0.24 | 13 | 11.3 | 0.12 | 5 |
| LYD996 | 99038.2 | 210.6 | 0.15 | 14 | 2306.2 | 0.03 | 18 | 11.2 | 0.10 | 5 |
| LYD996 | 99038.3 | — | — | — | — | — | — | 11.4 | 0.03 | 7 |
| LYD996 | 99039.4 | — | — | — | 2300.0 | 0.02 | 18 | 11.3 | 0.12 | 5 |
| LYD995 | 99180.1 | 203.1 | 0.17 | 10 | 2181.2 | 0.06 | 12 | — | — | — |
| LYD995 | 99181.2 | — | — | — | 2187.5 | 0.12 | 12 | 11.4 | 0.19 | 7 |
| LYD993 | 99435.3 | — | — | — | 2106.2 | 0.20 | 8 | — | — | — |
| LYD993 | 99436.1 | — | — | — | 2300.0 | 0.11 | 18 | — | — | — |
| LYD993 | 99436.2 | — | — | — | — | — | — | 11.7 | 0.11 | 9 |
| LYD993 | 99437.3 | — | — | — | — | — | — | 11.4 | 0.04 | 6 |
| LYD991 | 99557.2 | — | — | — | 2131.2 | 0.14 | 9 | 11.5 | 0.02 | 7 |
| LYD991 | 99558.3 | — | — | — | — | — | — | 11.1 | 0.23 | 3 |
| LYD991 | 99559.3 | — | — | — | 2481.2 | L | 27 | — | — | — |
| LYD989 | 99175.2 | — | — | — | 2418.8 | L | 24 | 11.6 | 0.26 | 8 |
| LYD989 | 99179.2 | — | — | — | — | — | — | 11.1 | 0.16 | 4 |
| LYD989 | 99179.3 | — | — | — | — | — | — | 12.1 | 0.28 | 12 |
| LYD987 | 99170.1 | — | — | — | — | — | — | 11.5 | 0.03 | 7 |
| LYD987 | 99170.2 | — | — | — | — | — | — | 11.6 | 0.08 | 8 |
| LYD987 | 99172.1 | — | — | — | — | — | — | 11.6 | 0.04 | 8 |
| LYD984 | 99391.1 | — | — | — | 2150.0 | 0.10 | 10 | — | — | — |
| LYD979 | 99167.1 | — | — | — | — | — | — | 11.8 | L | 9 |
| LYD979 | 99167.3 | — | — | — | — | — | — | 11.2 | 0.10 | 5 |
| LYD978 | 99552.2 | — | — | — | 2281.2 | 0.08 | 17 | — | — | — |
| LYD978 | 99554.3 | — | — | — | — | — | — | 11.6 | 0.04 | 8 |
| LYD977 | 99604.2 | — | — | — | — | — | — | 11.2 | 0.11 | 4 |
| LYD971 | 99117.1 | — | — | — | — | — | — | 13.1 | L | 22 |
| LYD971 | 99118.2 | 198.8 | 0.29 | 8 | 2287.5 | 0.21 | 17 | — | — | — |
| LYD969 | 99360.2 | — | — | — | — | — | — | 11.5 | 0.03 | 7 |
| LYD969 | 99361.3 | — | — | — | — | — | — | 11.2 | 0.20 | 4 |
| LYD969 | 99364.1 | — | — | — | — | — | — | 11.6 | 0.04 | 8 |
| LYD964 | 99141.2 | — | — | — | 2106.2 | 0.22 | 8 | — | — | — |
| LYD963 | 99295.1 | — | — | — | 2106.2 | 0.20 | 8 | 11.8 | 0.27 | 10 |
| LYD963 | 99298.2 | — | — | — | — | — | — | 11.7 | L | 9 |
| LYD963 | 99299.2 | — | — | — | — | — | — | 11.6 | 0.01 | 8 |
| LYD962 | 99135.1 | 216.2 | 0.05 | 17 | 2287.5 | 0.26 | 17 | — | — | — |
| LYD962 | 99135.3 | — | — | — | 2200.0 | 0.05 | 13 | — | — | — |
| LYD962 | 99138.1 | 218.8 | 0.03 | 19 | 2400.0 | 0.18 | 23 | 11.8 | 0.02 | 10 |

TABLE 304-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 184.3 | — | — | 1955.4 | — | — | 10.7 | — | — |
| LBY441 | 99815.2 | 97.5 | 0.24 | 12 | — | — | — | — | — | — |
| LBY441 | 99818.3 | — | — | — | — | — | — | 11.2 | 0.19 | 6 |
| LBY441 | 99819.2 | 99.4 | 0.22 | 15 | — | — | — | — | — | — |
| LBY439 | 99927.2 | 116.2 | 0.01 | 34 | — | — | — | 10.9 | 0.04 | 3 |
| LBY439 | 99928.3 | — | — | — | — | — | — | 10.8 | 0.26 | 1 |
| LBY439 | 99929.3 | 112.5 | 0.08 | 30 | — | — | — | — | — | — |
| LBY431 | 99890.2 | 130.0 | 0.18 | 50 | — | — | — | — | — | — |
| LBY431 | 99894.2 | 103.1 | 0.20 | 19 | — | — | — | 10.8 | 0.26 | 1 |
| LBY418 | 99881.2 | 110.0 | 0.07 | 27 | — | — | — | — | — | — |
| LBY418 | 99884.3 | — | — | — | — | — | — | 11.1 | 0.01 | 4 |
| LBY405 | 99946.3 | 108.8 | 0.05 | 25 | — | — | — | — | — | — |
| LBY405 | 99947.2 | 101.9 | 0.23 | 17 | — | — | — | — | — | — |
| LBY405 | 99948.2 | 102.5 | 0.11 | 18 | — | — | — | — | — | — |
| LBY394 | 99936.3 | — | — | — | — | — | — | 11.4 | 0.29 | 8 |
| LBY394 | 99937.2 | 100.6 | 0.22 | 16 | — | — | — | — | — | — |
| LBY384 | 100166.2 | 113.1 | 0.02 | 30 | — | — | — | 11.1 | 0.05 | 5 |
| LBY384 | 100169.1 | 121.9 | 0.13 | 40 | — | — | — | — | — | — |
| LBY371 | 100180.1 | 105.0 | 0.22 | 21 | — | — | — | 11.3 | 0.24 | 7 |
| LBY369 | 99919.1 | 103.8 | 0.09 | 20 | — | — | — | — | — | — |
| LBY366 | 99860.3 | — | — | — | — | — | — | 11.4 | L | 7 |
| LBY366 | 99861.1 | 115.0 | 0.07 | 33 | — | — | — | 11.6 | 0.17 | 9 |
| LBY362 | 99858.2 | 105.6 | 0.11 | 22 | — | — | — | — | — | — |
| LBY349 | 100126.3 | 120.6 | 0.03 | 39 | — | — | — | — | — | — |
| LBY349 | 100127.3 | 115.6 | 0.03 | 33 | — | — | — | — | — | — |
| LBY340 | 99488.2 | 102.5 | 0.13 | 18 | — | — | — | — | — | — |
| LBY332 | 99823.3 | 103.8 | 0.16 | 20 | — | — | — | — | — | — |
| LBY332 | 99824.2 | 122.5 | 0.14 | 41 | — | — | — | — | — | — |
| LBY332 | 99824.3 | 100.0 | 0.16 | 15 | — | — | — | — | — | — |
| CONT. | — | 86.8 | — | — | — | — | — | 10.6 | — | — |
| LGA3 | 96417.2 | — | — | — | 1636.9 | 0.25 | 5 | — | — | — |
| LGA3 | 96419.3 | 143.8 | 0.05 | 8 | 1637.5 | 0.29 | 5 | — | — | — |
| CONT. | — | 132.5 | — | — | 1556.2 | — | — | — | — | — |
| LYD997 | 99560.3 | — | — | — | — | — | — | 9.62 | 0.20 | 3 |
| LYD997 | 99563.1 | 97.5 | 0.03 | 27 | 1093.8 | 0.11 | 16 | — | — | — |
| LYD988 | 99048.4 | 86.9 | 0.19 | 13 | 1081.2 | 0.05 | 14 | — | — | — |
| LYD986 | 99021.3 | 100.6 | L | 31 | 1243.8 | 0.07 | 31 | — | — | — |
| LYD976 | 99160.2 | 86.2 | 0.26 | 12 | — | — | — | — | — | — |
| LYD976 | 99164.2 | — | — | — | — | — | — | 9.81 | 0.06 | 5 |
| LYD974 | 99055.1 | 100.0 | 0.12 | 30 | — | — | — | — | — | — |
| LYD974 | 99056.1 | — | — | — | — | — | — | 9.62 | 0.27 | 3 |
| LYD974 | 99058.2 | 93.8 | 0.18 | 22 | — | — | — | 9.69 | 0.14 | 4 |
| LYD973 | 99150.2 | 92.5 | L | 20 | — | — | — | — | — | — |
| LYD973 | 99153.3 | — | — | — | — | — | — | 9.75 | 0.13 | 4 |
| LYD972 | 99302.2 | 94.4 | 0.19 | 23 | — | — | — | — | — | — |
| LYD972 | 99303.3 | 89.4 | L | 16 | 1031.2 | 0.02 | 9 | — | — | — |
| LYD970 | 99382.3 | 83.8 | 0.07 | 9 | 993.8 | 0.21 | 5 | — | — | — |
| LYD970 | 99384.2 | 86.2 | 0.07 | 12 | 1075.0 | L | 14 | — | — | — |
| LYD967 | 99148.3 | 83.1 | 0.12 | 8 | — | — | — | — | — | — |
| LYD967 | 99149.3 | 87.5 | 0.05 | 14 | — | — | — | — | — | — |
| LYD960 | 99638.2 | 83.1 | 0.23 | 8 | — | — | — | — | — | — |
| LYD958 | 99130.3 | — | — | — | 1031.2 | 0.02 | 9 | — | — | — |
| LYD958 | 99131.1 | 90.0 | 0.09 | 17 | — | — | — | — | — | — |
| LYD958 | 99132.1 | 101.2 | L | 32 | 1237.5 | L | 31 | — | — | — |
| LYD956 | 99681.1 | 86.2 | 0.26 | 12 | — | — | — | 9.88 | 0.06 | 6 |
| LYD952 | 98254.2 | — | — | — | — | — | — | 10.0 | 0.15 | 7 |
| LYD952 | 98255.1 | 90.6 | 0.26 | 18 | 1037.5 | 0.07 | 10 | — | — | — |
| LYD952 | 98255.3 | 100.0 | L | 30 | 1256.2 | L | 33 | 9.88 | 0.06 | 6 |
| LYD949 | 98216.2 | 102.5 | 0.10 | 33 | — | — | — | — | — | — |
| LYD941 | 98985.1 | 91.2 | L | 19 | — | — | — | 9.81 | 0.06 | 5 |
| LYD937 | 98270.1 | — | — | — | — | — | — | 9.94 | 0.25 | 6 |
| LYD937 | 98273.3 | 97.1 | 0.01 | 27 | 1218.8 | L | 29 | — | — | — |
| CONT. | — | 76.8 | — | — | 946.4 | — | — | 9.34 | — | — |
| NUE543 | 94153.3 | 61.7 | 0.13 | 12 | — | — | — | — | — | — |
| CONT. | — | 55.0 | — | — | — | — | — | — | — | — |
| LBY304 | 99094.3 | 146.2 | L | 66 | 1443.8 | 0.01 | 30 | — | — | — |
| LBY301 | 98982.1 | 108.1 | 0.05 | 23 | — | — | — | — | — | — |
| LBY299_H1 | 99806.3 | — | — | — | — | — | — | 10.3 | 0.20 | 4 |
| LBY299_H1 | 99809.2 | 103.1 | 0.22 | 17 | 1218.8 | 0.09 | 10 | — | — | — |
| LBY298 | 99066.2 | — | — | — | — | — | — | 10.4 | 0.01 | 6 |
| LBY298 | 99068.2 | 97.5 | 0.04 | 11 | — | — | — | 10.2 | 0.11 | 3 |
| LBY297 | 99779.1 | — | — | — | — | — | — | 10.1 | 0.17 | 2 |

TABLE 304-continued

Genes showing improved plant performance at normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LBY291 | 99765.3 | — | — | — | 1225.0 | 0.03 | 10 | — | — | — |
| LBY288 | 99187.3 | — | — | — | — | — | — | 10.1 | 0.29 | 2 |
| LBY288 | 99188.2 | 100.0 | 0.10 | 13 | — | — | — | — | — | — |
| LBY283 | 99060.2 | — | — | — | — | — | — | 10.2 | 0.11 | 3 |
| LBY283 | 99061.2 | — | — | — | — | — | — | 10.6 | 0.08 | 7 |
| LBY277 | 99122.1 | — | — | — | — | — | — | 10.1 | 0.29 | 2 |
| LBY274 | 99345.3 | — | — | — | — | — | — | 10.1 | 0.29 | 2 |
| LBY264 | 99508.1 | — | — | — | — | — | — | 10.4 | 0.06 | 5 |
| LBY264 | 99509.2 | — | — | — | 1312.5 | 0.06 | 18 | 10.6 | 0.14 | 7 |
| LBY263 | 98971.2 | — | — | — | — | — | — | 10.2 | 0.13 | 4 |
| LBY262 | 99568.1 | 106.2 | 0.15 | 20 | 1237.5 | 0.09 | 11 | 10.7 | 0.30 | 8 |
| CONT. | — | 88.2 | — | — | 1110.7 | — | — | 9.89 | — | — |
| LBY310 | 98922.2 | 124.4 | 0.21 | 6 | — | — | — | 11.8 | 0.20 | 6 |
| LBY310 | 98923.1 | 136.2 | 0.03 | 17 | 1606.2 | 0.22 | 11 | — | — | — |
| LBY306 | 98937.1 | 138.1 | 0.08 | 18 | — | — | — | — | — | — |
| LBY306 | 98939.4 | 134.4 | 0.06 | 15 | — | — | — | — | — | — |
| LBY305 | 98842.1 | 141.2 | 0.17 | 21 | 1775.0 | L | 22 | — | — | — |
| LBY305 | 98843.2 | 135.6 | L | 16 | 1881.2 | L | 29 | 12.0 | L | 8 |
| LBY302 | 98839.2 | 125.0 | 0.22 | 7 | — | — | — | — | — | — |
| LBY296 | 98857.2 | — | — | — | — | — | — | 11.6 | 0.08 | 5 |
| LBY296 | 98857.3 | — | — | — | — | — | — | 12.1 | 0.12 | 9 |
| LBY296 | 98858.2 | 126.2 | 0.07 | 8 | 1562.5 | 0.29 | 7 | 11.9 | 0.27 | 7 |
| LBY296 | 98858.3 | — | — | — | 1612.5 | 0.14 | 11 | — | — | — |
| LBY295 | 98803.1 | 137.5 | 0.21 | 18 | — | — | — | 11.9 | 0.04 | 7 |
| LBY292 | 98932.2 | — | — | — | — | — | — | 12.5 | L | 13 |
| LBY292 | 98932.3 | — | — | — | — | — | — | 11.8 | 0.07 | 6 |
| LBY292 | 98933.2 | — | — | — | — | — | — | 11.4 | 0.17 | 3 |
| LBY290 | 98925.1 | 138.1 | 0.30 | 18 | — | — | — | — | — | — |
| LBY290 | 98929.2 | — | — | — | 1662.5 | 0.04 | 14 | — | — | — |
| LBY289 | 98963.1 | — | — | — | 1631.2 | 0.08 | 12 | — | — | — |
| LBY289 | 98964.2 | 123.8 | 0.28 | 6 | — | — | — | — | — | — |
| LBY286 | 98915.3 | 130.6 | 0.10 | 12 | 1768.8 | 0.30 | 22 | 11.9 | L | 7 |
| LBY275 | 98911.1 | 131.2 | 0.02 | 12 | — | — | — | — | — | — |
| LBY275 | 98914.1 | — | — | — | 1731.2 | 0.26 | 19 | — | — | — |
| LBY275 | 98914.2 | 140.0 | 0.05 | 20 | — | — | — | — | — | — |
| LBY270 | 98978.2 | 124.4 | 0.12 | 6 | 1606.2 | 0.11 | 11 | — | — | — |
| LBY270 | 98978.3 | 141.9 | 0.22 | 21 | 1856.2 | 0.03 | 28 | 12.4 | 0.27 | 11 |
| LBY270 | 98979.1 | 133.8 | L | 15 | 1725.0 | 0.07 | 19 | — | — | — |
| LBY270 | 98979.2 | 139.4 | L | 19 | 1756.2 | 0.07 | 21 | — | — | — |
| LBY258 | 98955.2 | 127.5 | 0.07 | 9 | — | — | — | — | — | — |
| LBY258 | 98957.1 | — | — | — | 1750.0 | 0.15 | 20 | — | — | — |
| LBY258 | 98959.2 | 145.6 | 0.08 | 25 | 1662.5 | 0.18 | 14 | — | — | — |
| LBY258 | 98959.3 | — | — | — | 1812.5 | 0.29 | 25 | — | — | — |
| LBY246 | 98830.1 | 160.0 | 0.21 | 37 | 1868.8 | 0.17 | 29 | — | — | — |
| LBY246 | 98831.2 | 132.5 | 0.11 | 13 | — | — | — | — | — | — |
| LBY243 | 98907.1 | 122.5 | 0.22 | 5 | — | — | — | — | — | — |
| LBY237 | 98901.4 | 151.9 | 0.29 | 30 | 1775.0 | L | 22 | — | — | — |
| CONT. | — | 116.8 | — | — | 1453.6 | — | — | 11.1 | — | — |
| LYD976 | 99164.3 | 189.4 | 0.07 | 13 | 2162.5 | 0.15 | 19 | — | — | — |
| LYD975 | 99156.4 | — | — | — | 1950.0 | 0.06 | 7 | 11.9 | L | 5 |
| LYD974 | 99056.1 | 193.1 | 0.02 | 15 | — | — | — | — | — | — |
| LYD972 | 99300.3 | — | — | — | 2037.5 | 0.30 | 12 | — | — | — |
| LYD970 | 99381.1 | 202.5 | L | 21 | 2287.5 | L | 26 | — | — | — |
| LYD970 | 99381.3 | 180.6 | 0.15 | 8 | 2050.0 | 0.12 | 13 | — | — | — |
| LYD967 | 99149.1 | — | — | — | 1962.5 | 0.03 | 8 | — | — | — |
| LYD960 | 99638.2 | — | — | — | — | — | — | 11.6 | 0.14 | 2 |
| LYD960 | 99638.4 | — | — | — | — | — | — | 12.0 | 0.18 | 6 |
| LYD957 | 99019.1 | — | — | — | 2137.5 | L | 18 | — | — | — |
| LYD956 | 99681.1 | — | — | — | 1881.2 | 0.29 | 4 | — | — | — |
| LYD952 | 98255.2 | 193.1 | 0.03 | 15 | 2162.5 | 0.21 | 19 | — | — | — |
| LYD941 | 98989.1 | 189.4 | 0.14 | 13 | 2018.7 | L | 11 | — | — | — |
| CONT. | — | 167.7 | — | — | 1816.1 | — | — | 11.3 | — | — |
| LBY441 | 99815.2 | — | — | — | — | — | — | 11.7 | 0.30 | 5 |
| LBY441 | 99818.2 | 132.5 | 0.06 | 17 | 1375.0 | 0.21 | 13 | — | — | — |
| LBY441 | 99819.3 | — | — | — | 1568.8 | 0.21 | 28 | — | — | — |
| LBY439 | 99927.2 | 141.2 | 0.10 | 25 | 1475.0 | 0.04 | 21 | 12.2 | L | 10 |
| LBY431 | 99891.2 | 139.4 | 0.02 | 23 | 1593.8 | 0.02 | 30 | — | — | — |
| LBY431 | 99891.3 | 130.6 | 0.10 | 16 | — | — | — | — | — | — |
| LBY418 | 99881.3 | 130.6 | 0.07 | 16 | 1525.0 | 0.02 | 25 | — | — | — |
| LBY418 | 99883.3 | — | — | — | 1368.8 | 0.21 | 12 | 12.2 | 0.21 | 9 |
| LBY417 | 99944.2 | — | — | — | — | — | — | 12.3 | 0.10 | 10 |
| LBY405 | 99947.2 | — | — | — | 1381.2 | 0.24 | 13 | — | — | — |

TABLE 304-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LBY394 | 99936.2 | 163.1 | 0.28 | 45 | 1656.2 | L | 36 | 11.5 | 0.20 | 3 |
| LBY394 | 99937.3 | — | — | — | — | — | — | 11.8 | 0.02 | 6 |
| LBY384 | 100169.1 | — | — | — | 1475.0 | 0.19 | 21 | — | — | — |
| LBY371 | 100180.1 | — | — | — | 1356.2 | 0.23 | 11 | — | — | — |
| LBY371 | 100181.1 | 131.9 | 0.18 | 17 | 1537.5 | 0.10 | 26 | — | — | — |
| LBY369 | 99915.1 | — | — | — | 1375.0 | 0.21 | 13 | 11.9 | 0.05 | 7 |
| LBY369 | 99918.2 | 143.8 | L | 27 | 1575.0 | 0.04 | 29 | 11.9 | 0.01 | 6 |
| LBY369 | 99919.3 | 135.6 | 0.25 | 20 | 1537.5 | 0.16 | 26 | 11.8 | 0.02 | 5 |
| LBY366 | 99861.1 | 153.8 | 0.11 | 36 | 1625.0 | L | 33 | 11.7 | 0.04 | 5 |
| LBY366 | 99861.3 | — | — | — | — | — | — | 12.2 | 0.15 | 10 |
| LBY366 | 99864.3 | — | — | — | 1525.0 | 0.26 | 25 | 11.6 | 0.09 | 4 |
| LBY362 | 99856.1 | — | — | — | 1443.8 | 0.15 | 18 | 11.6 | 0.09 | 4 |
| LBY362 | 99856.3 | 134.4 | 0.04 | 19 | 1550.0 | 0.02 | 27 | — | — | — |
| LBY349 | 100125.2 | — | — | — | 1375.0 | 0.19 | 13 | — | — | — |
| LBY349 | 100128.2 | — | — | — | 1350.0 | 0.24 | 11 | — | — | — |
| LBY340 | 99488.2 | — | — | — | — | — | — | 12.2 | 0.21 | 9 |
| LBY339 | 100120.3 | 139.4 | 0.02 | 23 | 1587.5 | L | 30 | 11.9 | 0.05 | 7 |
| LBY339 | 100121.2 | 126.2 | 0.15 | 12 | — | — | — | — | — | — |
| LBY332 | 99821.3 | — | — | — | 1375.0 | 0.18 | 13 | — | — | — |
| LBY319 | 100157.2 | — | — | — | 1443.8 | 0.29 | 18 | — | — | — |
| LBY319 | 100159.3 | — | — | — | 1618.8 | 0.07 | 33 | 12.4 | 0.30 | 11 |
| CONT. | — | 112.9 | — | — | 1221.4 | — | — | 11.2 | — | — |
| LBY455 | 100043.2 | — | — | — | 2212.5 | 0.07 | 13 | — | — | — |
| LBY446 | 99971.1 | 158.8 | 0.19 | 19 | 2356.2 | 0.24 | 20 | — | — | — |
| LBY398 | 100089.2 | — | — | — | — | — | — | 12.1 | L | 12 |
| LBY398 | 100089.3 | 155.0 | 0.08 | 16 | 2268.8 | 0.04 | 16 | — | — | — |
| LBY387 | 99571.2 | 155.0 | 0.08 | 16 | 2231.2 | 0.06 | 14 | — | — | — |
| LBY383 | 100024.1 | — | — | — | 2281.2 | 0.23 | 16 | — | — | — |
| LBY368 | 100105.1 | 160.0 | 0.09 | 20 | 2337.5 | 0.03 | 19 | — | — | — |
| LBY353 | 100014.1 | — | — | — | 2225.0 | 0.23 | 13 | — | — | — |
| LBY327 | 100113.3 | 160.6 | 0.05 | 20 | 2375.0 | 0.07 | 21 | 11.2 | 0.28 | 4 |
| LBY327 | 100114.1 | 166.9 | 0.02 | 25 | 2331.2 | 0.04 | 19 | — | — | — |
| LBY326 | 100100.3 | 171.2 | 0.22 | 28 | — | — | — | — | — | — |
| LBY325 | 100146.3 | 161.9 | 0.06 | 21 | 2400.0 | L | 22 | 11.5 | 0.26 | 6 |
| LBY321 | 100091.3 | — | — | — | 2106.2 | 0.26 | 7 | — | — | — |
| LBY320 | 100143.2 | 158.8 | 0.07 | 19 | 2281.2 | 0.17 | 16 | — | — | — |
| CONT. | — | 133.4 | — | — | 1962.5 | — | — | 10.8 | — | — |
| LBY304 | 99094.3 | 84.4 | 0.28 | 17 | — | — | — | — | — | — |
| LBY301 | 98980.1 | — | — | — | 1012.5 | 0.11 | 18 | — | — | — |
| LBY299_H1 | 99807.2 | — | — | — | — | — | — | 9.69 | 0.09 | 4 |
| LBY298 | 99065.2 | — | — | — | — | — | — | 9.81 | 0.16 | 5 |
| LBY297 | 99776.2 | 95.0 | 0.30 | 32 | — | — | — | — | — | — |
| LBY294 | 99770.3 | 80.6 | 0.11 | 12 | 1068.8 | L | 25 | 9.75 | 0.10 | 4 |
| LBY294 | 99771.3 | 88.1 | 0.13 | 22 | 1081.2 | L | 26 | 9.62 | 0.23 | 3 |
| LBY294 | 99772.1 | — | — | — | — | — | — | 9.88 | 0.05 | 6 |
| LBY291 | 99766.2 | — | — | — | — | — | — | 9.69 | 0.09 | 4 |
| LBY291 | 99767.2 | 86.2 | 0.03 | 20 | — | — | — | — | — | — |
| LBY288 | 99187.2 | — | — | — | 925.0 | 0.25 | 8 | 9.62 | 0.13 | 3 |
| LBY288 | 99188.2 | — | — | — | 1075.0 | 0.13 | 25 | — | — | — |
| LBY283 | 99060.2 | — | — | — | 1093.8 | 0.26 | 28 | 10.1 | L | 8 |
| LBY283 | 99062.1 | 89.4 | 0.23 | 24 | 1075.0 | L | 25 | 11.1 | L | 18 |
| LBY283 | 99062.2 | 89.4 | 0.02 | 24 | 993.8 | 0.04 | 16 | — | — | — |
| LBY277 | 99121.2 | — | — | — | 925.0 | 0.25 | 8 | — | — | — |
| LBY277 | 99124.3 | 83.1 | 0.09 | 15 | 975.0 | 0.07 | 14 | 9.69 | 0.09 | 4 |
| LBY274 | 99345.2 | 93.1 | 0.13 | 29 | — | — | — | — | — | — |
| LBY274 | 99345.3 | 88.1 | L | 22 | 1081.2 | L | 26 | — | — | — |
| LBY274 | 99346.1 | 93.1 | L | 29 | 1018.8 | 0.02 | 19 | — | — | — |
| LBY274 | 99349.1 | — | — | — | — | — | — | 10.2 | 0.05 | 9 |
| LBY264 | 99508.2 | — | — | — | — | — | — | 9.62 | 0.23 | 3 |
| LBY263 | 98971.2 | 83.8 | 0.03 | 16 | 1031.2 | 0.02 | 20 | — | — | — |
| LBY263 | 98972.1 | — | — | — | — | — | — | 9.75 | 0.05 | 4 |
| LBY263 | 98972.2 | 95.0 | L | 32 | 1062.5 | 0.01 | 24 | — | — | — |
| LBY263 | 98973.3 | — | — | — | — | — | — | 10.4 | L | 11 |
| LBY263 | 98974.3 | — | — | — | — | — | — | 9.88 | 0.02 | 6 |
| LBY254 | 98819.1 | — | — | — | — | — | — | 9.62 | 0.13 | 3 |
| LBY250 | 99051.1 | — | — | — | — | — | — | 9.75 | 0.10 | 4 |
| LBY250 | 99052.1 | — | — | — | 962.5 | 0.23 | 12 | — | — | — |
| LBY242 | 99631.3 | 77.5 | 0.25 | 7 | 1106.2 | 0.04 | 29 | — | — | — |
| LBY242 | 99634.3 | — | — | — | 1087.5 | 0.25 | 27 | — | — | — |
| CONT. | — | 72.1 | — | — | 857.1 | — | — | 9.34 | — | — |
| LBY451 | 100173.2 | 145.0 | 0.03 | 20 | 2120.5 | 0.08 | 20 | — | — | — |
| LBY451 | 100173.3 | 160.6 | 0.04 | 33 | 2381.2 | L | 35 | 10.8 | 0.02 | 10 |

TABLE 304-continued

Genes showing improved plant performance at normal
growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LBY435 | 100204.4 | — | — | — | — | — | — | 10.8 | 0.26 | 10 |
| LBY432 | 99899.1 | 145.0 | 0.09 | 20 | — | — | — | — | — | — |
| LBY427 | 100185.3 | 149.4 | 0.03 | 24 | 2000.0 | 0.25 | 13 | — | — | — |
| LBY427 | 100186.1 | 154.4 | 0.08 | 28 | 2100.0 | 0.05 | 19 | — | — | — |
| LBY427 | 100186.4 | 141.9 | 0.27 | 18 | 2093.8 | 0.06 | 18 | — | — | — |
| LBY423 | 100198.2 | — | — | — | — | — | — | 10.3 | 0.19 | 5 |
| LBY413 | 100230.3 | — | — | — | — | — | — | 10.5 | 0.14 | 7 |
| LBY413 | 100231.1 | — | — | — | — | — | — | 10.2 | 0.24 | 4 |
| LBY409 | 99504.1 | 146.9 | 0.01 | 22 | — | — | — | — | — | — |
| LBY409 | 99504.2 | — | — | — | — | — | — | 10.3 | 0.19 | 5 |
| LBY388 | 100029.3 | — | — | — | — | — | — | 10.2 | 0.24 | 4 |
| LBY377 | 99961.2 | 153.8 | 0.01 | 28 | 2325.0 | L | 31 | — | — | — |
| LBY377 | 99964.2 | 143.8 | 0.19 | 19 | — | — | — | — | — | — |
| LBY377 | 99964.3 | — | — | — | — | — | — | 11.4 | 0.01 | 16 |
| LBY364 | 100328.1 | 132.5 | 0.23 | 10 | — | — | — | — | — | — |
| LBY352 | 100075.2 | 151.2 | 0.03 | 26 | — | — | — | — | — | — |
| LBY346 | 100150.2 | 131.9 | 0.27 | 9 | — | — | — | 10.6 | 0.03 | 8 |
| LBY346 | 100153.1 | 128.8 | 0.30 | 7 | — | — | — | — | — | — |
| LBY311 | 100135.3 | — | — | — | — | — | — | 10.5 | 0.26 | 7 |
| CONT. | — | 120.5 | — | — | 1770.4 | — | — | 9.80 | — | — |
| LGA3 | 96419.2 | 197.1 | 0.05 | 8 | 2220.8 | 0.08 | 9 | — | — | — |
| LGA3 | 96419.4 | — | — | — | — | — | — | 10.0 | 0.10 | 11 |
| CONT. | — | 182.2 | — | — | 2043.3 | — | — | 9.06 | — | — |
| LBY455 | 100041.1 | 99.6 | 0.23 | 16 | 1305.4 | 0.26 | 14 | — | — | — |
| LBY446 | 99972.3 | 121.9 | 0.14 | 42 | 1468.8 | L | 28 | 11.8 | 0.23 | 9 |
| LBY383 | 100022.2 | — | — | — | 1319.6 | 0.28 | 15 | — | — | — |
| LBY383 | 100024.3 | — | — | — | 1443.8 | 0.29 | 26 | — | — | — |
| LBY379 | 100083.1 | 108.1 | 0.23 | 26 | 1412.5 | 0.02 | 23 | — | — | — |
| LBY368 | 100107.3 | 96.9 | 0.15 | 13 | — | — | — | — | — | — |
| LBY353 | 100010.2 | — | — | — | 1381.2 | 0.21 | 20 | — | — | — |
| LBY353 | 100012.2 | 105.6 | 0.26 | 23 | 1418.8 | 0.06 | 23 | — | — | — |
| LBY353 | 100014.1 | 114.4 | L | 33 | 1506.2 | L | 31 | — | — | — |
| LBY350 | 100115.2 | — | — | — | 1431.2 | 0.11 | 24 | — | — | — |
| LBY350 | 100117.3 | — | — | — | 1364.3 | 0.10 | 19 | — | — | — |
| LBY342 | 100003.3 | — | — | — | — | — | — | 11.8 | 0.08 | 10 |
| LBY338 | 99994.3 | 113.8 | 0.07 | 32 | 1406.2 | 0.02 | 22 | — | — | — |
| LBY327 | 100113.3 | — | — | — | 1318.8 | 0.19 | 15 | — | — | — |
| LBY327 | 100114.1 | — | — | — | 1754.5 | 0.18 | 53 | 12.0 | 0.16 | 12 |
| LBY326 | 100101.1 | — | — | — | 1618.8 | 0.17 | 41 | 11.6 | 0.20 | 8 |
| LBY326 | 100102.2 | 102.5 | 0.10 | 19 | 1525.0 | 0.23 | 33 | 11.3 | 0.28 | 5 |
| LBY325 | 100146.2 | — | — | — | 1556.2 | 0.07 | 35 | 11.5 | 0.16 | 7 |
| LBY320 | 100141.1 | — | — | — | — | — | — | 11.8 | 0.08 | 9 |
| CONT. | — | 85.9 | — | — | 1150.0 | — | — | 10.7 | — | — |
| LGA10 | 96401.2 | 206.7 | 0.16 | 16 | 2270.8 | 0.19 | 11 | 9.62 | 0.19 | 5 |
| CONT. | — | 178.8 | — | — | 2041.7 | — | — | 9.12 | — | — |
| LBY453 | 100511.3 | 314.4 | 0.02 | 26 | 2525.0 | 0.22 | 11 | 12.4 | 0.03 | 5 |
| LBY453 | 100512.2 | 278.8 | 0.05 | 12 | — | — | — | — | — | — |
| LBY453 | 100512.3 | — | — | — | — | — | — | 12.9 | 0.09 | 10 |
| LBY453 | 100513.1 | 282.5 | 0.20 | 13 | 2568.8 | 0.13 | 13 | 13.2 | L | 12 |
| LBY453 | 100513.2 | 270.0 | 0.12 | 8 | 2412.5 | 0.21 | 6 | — | — | — |
| LBY428 | 100190.4 | 290.0 | 0.02 | 16 | 2618.8 | 0.01 | 15 | — | — | — |
| LBY428 | 100191.3 | 278.8 | 0.06 | 12 | — | — | — | — | — | — |
| LBY414 | 99965.2 | 277.5 | 0.19 | 11 | — | — | — | 12.2 | 0.04 | 4 |
| LBY414 | 99967.3 | 275.6 | 0.23 | 10 | — | — | — | — | — | — |
| LBY414 | 99969.3 | 268.8 | 0.23 | 8 | — | — | — | — | — | — |
| LBY408 | 99511.2 | — | — | — | — | — | — | 12.6 | L | 7 |
| LBY408 | 99512.1 | — | — | — | — | — | — | 12.4 | 0.21 | 6 |
| LBY407 | 99495.1 | — | — | — | — | — | — | 12.1 | 0.16 | 3 |
| LBY407 | 99497.3 | — | — | — | — | — | — | 12.4 | 0.03 | 5 |
| LBY392 | 99491.3 | — | — | — | — | — | — | 12.4 | 0.03 | 5 |
| LBY392 | 99494.3 | — | — | — | — | — | — | 12.3 | 0.11 | 5 |
| LBY363 | 100323.2 | 263.1 | 0.29 | 5 | 2487.5 | 0.09 | 10 | — | — | — |
| LBY358 | 100254.2 | — | — | — | — | — | — | 12.7 | 0.24 | 8 |
| LBY356 | 100016.2 | 305.6 | 0.13 | 22 | 2781.2 | 0.02 | 23 | — | — | — |
| LBY356 | 100018.2 | 318.1 | L | 27 | 2737.5 | 0.01 | 21 | — | — | — |
| LBY356 | 100019.2 | — | — | — | 2593.8 | 0.22 | 14 | — | — | — |
| LBY336 | 100495.2 | 290.6 | 0.03 | 16 | — | — | — | — | — | — |
| LBY335_H3 | 100546.2 | — | — | — | — | — | — | 13.3 | L | 13 |
| LBY335_H3 | 100549.1 | 266.2 | 0.20 | 7 | — | — | — | — | — | — |
| LBY335_H3 | 100549.3 | 266.9 | 0.19 | 7 | — | — | — | — | — | — |
| LBY324 | 100095.2 | 264.4 | 0.23 | 6 | — | — | — | 12.1 | 0.16 | 3 |
| LBY324 | 100099.3 | — | — | — | — | — | — | 12.6 | L | 7 |

TABLE 304-continued

Genes showing improved plant performance at normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LBY271 | 100236.1 | 270.0 | 0.21 | 8 | 2506.2 | 0.13 | 10 | — | — | — |
| LBY271 | 100237.2 | — | — | — | 2518.8 | 0.28 | 11 | 12.1 | 0.17 | 3 |
| LBY271 | 100237.3 | — | — | — | — | — | — | 12.8 | 0.17 | 9 |
| CONT. | — | 249.5 | — | — | 2268.8 | — | — | 11.8 | — | — |
| LBY453 | 100511.3 | 233.1 | 0.19 | 4 | 2112.5 | L | 11 | — | — | — |
| LBY453 | 100512.2 | — | — | — | — | — | — | 12.4 | 0.17 | 6 |
| LBY453 | 100513.1 | — | — | — | 2081.2 | 0.25 | 9 | — | — | — |
| LBY453 | 100513.2 | — | — | — | — | — | — | 12.4 | 0.17 | 6 |
| LBY414 | 99965.2 | — | — | — | 2100.0 | 0.28 | 10 | — | — | — |
| LBY414 | 99967.3 | — | — | — | 2218.8 | 0.24 | 16 | 12.6 | 0.24 | 9 |
| LBY408 | 99510.1 | 241.2 | 0.13 | 8 | 2206.2 | L | 16 | — | — | — |
| LBY408 | 99511.2 | 267.5 | 0.22 | 20 | 2225.0 | 0.22 | 17 | — | — | — |
| LBY407 | 99495.1 | 244.4 | 0.04 | 9 | 2175.0 | L | 14 | — | — | — |
| LBY407 | 99496.3 | — | — | — | — | — | — | 12.2 | 0.28 | 5 |
| LBY407 | 99499.3 | — | — | — | 1968.8 | 0.12 | 3 | 12.9 | 0.12 | 11 |
| LBY392 | 99491.3 | 234.0 | 0.11 | 5 | 2042.9 | 0.11 | 7 | 12.3 | 0.22 | 6 |
| LBY392 | 99494.3 | — | — | — | — | — | — | 12.9 | 0.23 | 11 |
| LBY376 | 99922.1 | 249.4 | 0.08 | 11 | 2350.0 | L | 23 | — | — | — |
| LBY376 | 99923.1 | 256.9 | 0.08 | 15 | 2343.8 | L | 23 | 13.2 | 0.02 | 13 |
| LBY363 | 100321.3 | — | — | — | 2062.5 | 0.25 | 8 | — | — | — |
| LBY363 | 100323.1 | 235.6 | 0.29 | 5 | 2162.5 | 0.02 | 13 | — | — | — |
| LBY356 | 100016.3 | — | — | — | 1981.2 | 0.10 | 4 | — | — | — |
| LBY356 | 100018.2 | — | — | — | 2187.5 | L | 15 | — | — | — |
| LBY356 | 100019.2 | — | — | — | 2075.0 | L | 9 | — | — | — |
| LBY324 | 100095.2 | — | — | — | 2025.0 | 0.27 | 6 | 12.4 | 0.14 | 7 |
| LBY324 | 100096.2 | 245.0 | 0.18 | 9 | — | — | — | — | — | — |
| LBY324 | 100099.2 | — | — | — | — | — | — | 12.4 | 0.20 | 7 |
| LBY324 | 100099.3 | — | — | — | 1947.3 | 0.30 | 2 | — | — | — |
| LBY271 | 100236.2 | 236.2 | 0.07 | 6 | 2012.5 | 0.06 | 5 | — | — | — |
| LBY271 | 100237.3 | 266.2 | 0.04 | 19 | 2237.5 | 0.13 | 17 | — | — | — |
| CONT. | — | 223.8 | — | — | 1908.3 | — | — | 11.6 | — | — |
| LBY460 | 100488.3 | — | — | — | — | — | — | 13.0 | L | 6 |
| LBY458 | 100470.2 | — | — | — | 2068.8 | 0.04 | 18 | — | — | — |
| LBY452 | 100395.3 | — | — | — | — | — | — | 12.8 | 0.26 | 4 |
| LBY452 | 100397.1 | — | — | — | — | — | — | 12.8 | 0.13 | 4 |
| LBY447 | 100466.2 | 240.0 | 0.04 | 21 | 1968.8 | 0.15 | 12 | — | — | — |
| LBY445 | 100392.1 | — | — | — | — | — | — | 12.7 | 0.09 | 3 |
| LBY440 | 100575.3 | 242.5 | 0.04 | 22 | 2118.8 | 0.08 | 21 | — | — | — |
| LBY440 | 100577.3 | — | — | — | — | — | — | 12.9 | 0.18 | 5 |
| LBY440 | 100579.1 | — | — | — | — | — | — | 13.1 | L | 6 |
| LBY440 | 100579.2 | 219.4 | 0.25 | 11 | 2000.0 | 0.12 | 14 | — | — | — |
| LBY433 | 100561.3 | — | — | — | — | — | — | 13.4 | 0.06 | 9 |
| LBY402 | 100573.3 | — | — | — | — | — | — | 12.9 | 0.08 | 5 |
| LBY402 | 100574.3 | 221.2 | 0.30 | 11 | — | — | — | — | — | — |
| LBY393_H1 | 100536.1 | — | — | — | — | — | — | 12.6 | 0.21 | 2 |
| LBY393_H1 | 100539.2 | 220.0 | 0.24 | 11 | 1918.8 | 0.19 | 9 | 13.1 | L | 6 |
| LBY389 | 100552.3 | 251.2 | 0.29 | 27 | 2006.2 | 0.10 | 14 | — | — | — |
| LBY389 | 100554.3 | 248.8 | 0.02 | 25 | 2125.0 | 0.02 | 21 | — | — | — |
| LBY382 | 100378.2 | — | — | — | — | — | — | 13.2 | 0.14 | 7 |
| LBY359_H13 | 100531.2 | 220.6 | 0.22 | 11 | 1912.5 | 0.21 | 9 | — | — | — |
| LBY323 | 100544.3 | 253.1 | 0.02 | 28 | 2231.2 | L | 27 | 12.7 | 0.22 | 3 |
| LBY317 | 100056.3 | — | — | — | — | — | — | 13.2 | 0.25 | 7 |
| CONT. | — | 198.5 | — | — | 1755.9 | — | — | 12.3 | — | — |
| LBY460 | 100486.2 | — | — | — | 2206.2 | 0.18 | 6 | — | — | — |
| LBY458 | 100470.2 | 239.4 | 0.10 | 18 | 2431.2 | L | 17 | — | — | — |
| LBY458 | 100473.2 | 230.0 | 0.09 | 14 | 2312.5 | 0.08 | 12 | — | — | — |
| LBY452 | 100395.3 | 210.0 | 0.23 | 4 | 2193.8 | 0.13 | 6 | — | — | — |
| LBY447 | 100465.3 | 213.8 | 0.09 | 6 | 2237.5 | 0.04 | 8 | — | — | — |
| LBY447 | 100466.2 | 241.2 | L | 19 | 2400.0 | 0.02 | 16 | — | — | — |
| LBY447 | 100469.3 | 208.8 | 0.28 | 3 | 2225.0 | 0.11 | 7 | — | — | — |
| LBY445 | 100394.1 | 212.5 | 0.13 | 5 | 2150.0 | 0.14 | 4 | — | — | — |
| LBY443 | 100400.2 | 233.8 | 0.20 | 15 | — | — | — | — | — | — |
| LBY443 | 100403.1 | — | — | — | — | — | — | 13.2 | 0.22 | 3 |
| LBY440 | 100575.3 | — | — | — | — | — | — | 13.4 | 0.04 | 5 |
| LBY440 | 100579.1 | 239.4 | 0.18 | 18 | — | — | — | — | — | — |
| LBY440 | 100579.2 | 221.9 | 0.14 | 10 | — | — | — | — | — | — |
| LBY426 | 100461.2 | 224.4 | 0.06 | 11 | — | — | — | — | — | — |
| LBY426 | 100464.1 | 220.6 | 0.01 | 9 | 2250.0 | L | 9 | — | — | — |
| LBY426 | 100464.3 | 233.1 | 0.16 | 15 | 2387.5 | L | 15 | — | — | — |
| LBY402 | 100572.2 | 220.0 | 0.13 | 9 | 2325.0 | L | 12 | — | — | — |
| LBY393_H1 | 100535.3 | 234.4 | L | 16 | 2331.2 | 0.02 | 12 | 13.6 | 0.29 | 6 |
| LBY393_H1 | 100536.1 | — | — | — | — | — | — | 13.4 | 0.02 | 5 |

TABLE 304-continued

Genes showing improved plant performance at normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LBY393_H1 | 100536.3 | — | — | — | 2200.0 | 0.03 | 6 | 13.1 | 0.13 | 3 |
| LBY393_H1 | 100539.2 | — | — | — | 2162.5 | 0.09 | 4 | 13.5 | 0.13 | 6 |
| LBY389 | 100551.3 | 221.2 | 0.01 | 9 | 2162.5 | 0.28 | 4 | — | — | — |
| LBY389 | 100553.1 | — | — | — | 2175.0 | 0.06 | 5 | — | — | — |
| LBY382 | 100376.2 | 227.5 | 0.06 | 12 | — | — | — | — | — | — |
| LBY382 | 100379.1 | — | — | — | 2212.5 | 0.27 | 7 | — | — | — |
| LBY375 | 100318.3 | 218.1 | 0.13 | 8 | 2243.8 | L | 8 | — | — | — |
| LBY375 | 100319.2 | 224.4 | 0.20 | 11 | 2243.8 | 0.12 | 8 | — | — | — |
| LBY359_H13 | 100530.2 | 224.4 | 0.11 | 11 | 2225.0 | 0.11 | 7 | 14.1 | 0.16 | 10 |
| LBY359_H13 | 100531.3 | 227.5 | 0.03 | 12 | 2306.2 | L | 11 | — | — | — |
| LBY359_H13 | 100533.2 | — | — | — | 2181.2 | 0.10 | 5 | — | — | — |
| LBY341 | 100380.2 | 256.2 | L | 27 | 2500.0 | L | 21 | — | — | — |
| LBY323 | 100542.3 | 210.6 | 0.29 | 4 | — | — | — | 13.2 | 0.09 | 3 |
| LBY323 | 100544.3 | 224.4 | 0.01 | 11 | 2137.5 | 0.19 | 3 | — | — | — |
| LBY317 | 100056.3 | 221.9 | L | 10 | — | — | — | — | — | — |
| CONT. | — | 202.5 | — | — | 2073.2 | — | — | 12.8 | — | — |
| LBY300 | 99790.3 | — | — | — | — | — | — | 12.2 | 0.21 | 9 |
| LBY300 | 99791.3 | — | — | — | — | — | — | 12.5 | 0.25 | 12 |
| LBY293_H1 | 99958.3 | — | — | — | 2025.0 | 0.28 | 8 | — | — | — |
| LBY287 | 99616.3 | — | — | — | 2131.2 | 0.02 | 14 | 11.9 | 0.13 | 6 |
| LBY287 | 99617.2 | — | — | — | — | — | — | 11.6 | 0.13 | 4 |
| LBY287 | 99617.3 | — | — | — | — | — | — | 11.9 | 0.01 | 7 |
| LBY279 | 99951.1 | — | — | — | — | — | — | 12.4 | 0.15 | 11 |
| LBY257 | 99986.3 | — | — | — | — | — | — | 12.1 | 0.24 | 8 |
| LBY236 | 100130.1 | — | — | — | 2075.0 | L | 11 | — | — | — |
| LBY236 | 100134.3 | — | — | — | — | — | — | 12.1 | 0.17 | 9 |
| CONT. | — | — | — | — | 1876.2 | — | — | 11.2 | — | — |
| LBY307 | 100178.3 | — | — | — | — | — | — | 12.9 | 0.09 | 3 |
| LBY293_H1 | 99958.3 | — | — | — | — | — | — | 13.4 | 0.09 | 7 |
| LBY287 | 99616.3 | — | — | — | — | — | — | 12.9 | 0.09 | 3 |
| LBY287 | 99617.2 | — | — | — | — | — | — | 13.3 | 0.17 | 6 |
| LBY287 | 99617.3 | — | — | — | — | — | — | 13.3 | 0.17 | 6 |
| LBY287 | 99618.2 | — | — | — | — | — | — | 12.9 | 0.20 | 3 |
| LBY261_H1 | 99975.1 | — | — | — | — | — | — | 13.2 | 0.01 | 5 |
| LBY261_H1 | 99978.3 | — | — | — | — | — | — | 13.1 | 0.13 | 4 |
| LBY257 | 99986.3 | — | — | — | — | — | — | 13.2 | 0.26 | 6 |
| LBY245 | 99802.1 | — | — | — | — | — | — | 13.0 | 0.05 | 4 |
| LBY236 | 100130.1 | — | — | — | — | — | — | 13.3 | 0.05 | 6 |
| LBY236 | 100132.2 | — | — | — | — | — | — | 12.9 | 0.09 | 3 |
| CONT. | — | — | — | — | — | — | — | 12.5 | — | — |

Table 304.
"CONT."—Control;
"Ave."—Average;
"% Incr." = % increment;
"p-val."—p-value, L - p < 0.01.

TABLE 305

Genes showing improved plant performance at normal growth conditions under regulation of At6669 promoter

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| MGP36 | 96699.1 | 42.1 | 0.21 | 11 | 5.26 | 0.21 | 11 | — | — | — |
| CONT. | — | 37.9 | — | — | 4.74 | — | — | — | — | — |
| MGP91 | 99108.3 | 89.8 | 0.18 | 29 | 11.2 | 0.18 | 29 | 6.10 | 0.25 | 15 |
| MGP82 | 99190.1 | 84.1 | 0.02 | 21 | 10.5 | 0.02 | 21 | 6.04 | 0.06 | 14 |
| MGP82 | 99190.3 | 81.2 | 0.15 | 17 | 10.2 | 0.15 | 17 | 5.74 | 0.08 | 8 |
| MGP82 | 99191.2 | 74.7 | 0.29 | 7 | 9.34 | 0.29 | 7 | — | — | — |
| MGP66 | 99095.1 | 84.5 | 0.01 | 21 | 10.6 | 0.01 | 21 | 5.93 | 0.02 | 12 |
| MGP66 | 99097.2 | — | — | — | — | — | — | 5.47 | 0.29 | 3 |
| MGP66 | 99098.2 | 94.4 | L | 36 | 11.8 | L | 36 | 6.05 | L | 14 |
| MGP63 | 99796.2 | 76.4 | 0.17 | 10 | 9.56 | 0.17 | 10 | — | — | — |
| MGP62 | 99258.1 | 84.6 | 0.11 | 22 | 10.6 | 0.11 | 22 | 5.77 | 0.18 | 9 |
| MGP62 | 99259.1 | 79.5 | 0.11 | 14 | 9.93 | 0.11 | 14 | 5.49 | 0.25 | 4 |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| MGP59 | 98102.7 | 84.8 | 0.01 | 22 | 10.6 | 0.01 | 22 | 5.89 | 0.01 | 11 |
| MGP53 | 97720.1 | 99.1 | L | 42 | 12.4 | L | 42 | 6.58 | L | 24 |
| MGP52 | 97958.2 | 75.4 | 0.26 | 8 | 9.42 | 0.26 | 8 | — | — | — |
| MGP49 | 98051.2 | 76.5 | 0.29 | 10 | 9.56 | 0.29 | 10 | 5.73 | 0.18 | 8 |
| MGP48 | 97796.1 | 84.8 | 0.01 | 22 | 10.6 | 0.01 | 22 | 5.93 | L | 12 |
| MGP48 | 97799.4 | 91.8 | L | 32 | 11.5 | L | 32 | 6.13 | L | 16 |
| MGP32 | 97788.3 | 76.7 | 0.30 | 10 | 9.58 | 0.30 | 10 | — | — | — |
| MGP32 | 97790.4 | 94.4 | L | 36 | 11.8 | L | 36 | 6.19 | 0.07 | 17 |
| CONT. | — | 69.6 | — | — | 8.70 | — | — | 5.29 | — | — |
| NUE543 | 94149.1 | 49.7 | 0.02 | 16 | 6.21 | 0.02 | 16 | 4.40 | 0.28 | 4 |
| CONT. | — | 42.7 | — | — | 5.34 | — | — | 4.23 | — | — |
| NUE543 | 94149.1 | 40.9 | 0.08 | 15 | 5.11 | 0.08 | 15 | 3.85 | 0.15 | 3 |
| CONT. | — | 35.5 | — | — | 4.44 | — | — | 3.73 | — | — |
| MGP36 | 96696.1 | — | — | — | — | — | — | 4.29 | 0.18 | 2 |
| MGP36 | 96697.1 | 43.9 | 0.25 | 4 | 5.49 | 0.25 | 4 | — | — | — |
| MGP36 | 96699.2 | — | — | — | — | — | — | 4.39 | 0.09 | 5 |
| CONT. | — | 42.2 | — | — | 5.28 | — | — | 4.20 | — | — |
| MGP92 | 99112.3 | 79.6 | 0.20 | 20 | 9.96 | 0.20 | 20 | 5.52 | 0.11 | 13 |
| MGP92 | 99113.3 | 78.1 | 0.03 | 17 | 9.76 | 0.03 | 17 | 5.29 | 0.08 | 9 |
| MGP91 | 99105.3 | — | — | — | — | — | — | 5.15 | 0.17 | 6 |
| MGP91 | 99108.3 | 78.1 | 0.01 | 17 | 9.76 | 0.01 | 17 | 5.34 | 0.01 | 10 |
| MGP82 | 99190.1 | — | — | — | — | — | — | 5.06 | 0.20 | 4 |
| MGP82 | 99191.2 | 81.8 | 0.02 | 23 | 10.2 | 0.02 | 23 | 5.39 | 0.04 | 11 |
| MGP67 | 99102.3 | 93.2 | 0.02 | 40 | 11.7 | 0.02 | 40 | 5.77 | L | 19 |
| MGP67 | 99103.2 | 92.4 | L | 39 | 11.5 | L | 39 | 5.65 | 0.03 | 16 |
| MGP67 | 99104.1 | 76.0 | 0.10 | 14 | 9.50 | 0.10 | 14 | 5.19 | 0.10 | 7 |
| MGP66 | 99096.2 | 82.7 | 0.12 | 24 | 10.3 | 0.12 | 24 | 5.56 | L | 14 |
| MGP66 | 99096.3 | 72.1 | 0.17 | 8 | 9.01 | 0.17 | 8 | — | — | — |
| MGP59 | 98102.4 | 70.0 | 0.30 | 5 | 8.75 | 0.30 | 5 | 5.06 | 0.18 | 4 |
| MGP59 | 98102.7 | 92.2 | 0.03 | 38 | 11.5 | 0.03 | 38 | 5.94 | 0.07 | 22 |
| MGP53 | 97720.1 | 72.8 | 0.07 | 9 | 9.11 | 0.07 | 9 | 5.15 | 0.07 | 6 |
| MGP52 | 97956.2 | 87.3 | 0.15 | 31 | 10.9 | 0.15 | 31 | 5.50 | 0.25 | 13 |
| MGP52 | 97958.1 | 77.7 | 0.14 | 17 | 9.71 | 0.14 | 17 | 5.21 | 0.29 | 7 |
| MGP52 | 97960.1 | 92.8 | L | 39 | 11.6 | L | 39 | 5.83 | 0.01 | 20 |
| MGP50 | 98463.3 | 94.2 | L | 41 | 11.8 | L | 41 | 5.82 | L | 19 |
| MGP48 | 97795.1 | 87.1 | 0.06 | 31 | 10.9 | 0.06 | 31 | 5.46 | 0.05 | 12 |
| MGP48 | 97796.1 | 93.8 | 0.04 | 41 | 11.7 | 0.04 | 41 | 5.77 | 0.14 | 18 |
| MGP48 | 97796.2 | 72.9 | 0.30 | 9 | 9.12 | 0.30 | 9 | 5.06 | 0.27 | 4 |
| MGP48 | 97799.4 | 76.3 | 0.26 | 14 | 9.53 | 0.26 | 14 | 5.34 | 0.16 | 10 |
| MGP45 | 99013.1 | 71.1 | 0.18 | 7 | 8.89 | 0.18 | 7 | 5.09 | 0.16 | 5 |
| MGP45 | 99013.2 | 75.5 | 0.02 | 13 | 9.44 | 0.02 | 13 | 5.21 | 0.03 | 7 |
| MGP45 | 99013.3 | 76.0 | 0.22 | 14 | 9.49 | 0.22 | 14 | 5.33 | 0.17 | 9 |
| MGP32 | 97788.3 | 77.5 | 0.20 | 16 | 9.69 | 0.20 | 16 | — | — | — |
| CONT. | — | 66.6 | — | — | 8.33 | — | — | 4.87 | — | — |
| LYD999 | 100311.3 | 54.8 | L | 17 | 6.85 | L | 17 | 4.57 | L | 9 |
| LYD999 | 100312.1 | 53.6 | L | 15 | 6.70 | L | 15 | 4.66 | L | 11 |
| LYD999 | 100312.2 | 50.5 | 0.22 | 8 | 6.31 | 0.22 | 8 | 4.40 | 0.09 | 5 |
| LYD999 | 100314.1 | 57.3 | L | 22 | 7.16 | L | 22 | 4.60 | 0.02 | 9 |
| LYD992 | 100364.3 | 54.5 | 0.14 | 16 | 6.81 | 0.14 | 16 | 4.60 | 0.02 | 9 |
| LYD983 | 99388.3 | 54.1 | 0.05 | 15 | 6.76 | 0.05 | 15 | 4.57 | L | 9 |
| LYD982 | 99041.2 | 60.7 | 0.04 | 30 | 7.59 | 0.04 | 30 | 4.76 | L | 13 |
| LYD982 | 99041.4 | 61.2 | 0.02 | 31 | 7.65 | 0.02 | 31 | 4.78 | L | 14 |
| LYD981 | 99607.3 | 56.1 | 0.12 | 20 | 7.01 | 0.12 | 20 | — | — | — |
| LYD980 | 99787.2 | 49.1 | 0.26 | 5 | 6.14 | 0.26 | 5 | — | — | — |
| LYD980 | 99788.2 | 51.3 | 0.15 | 10 | 6.41 | 0.15 | 10 | 4.40 | L | 5 |
| LYD966 | 100358.2 | 67.4 | 0.13 | 44 | 8.43 | 0.13 | 44 | 5.01 | 0.07 | 19 |
| LYD965_H1 | 100225.2 | 51.0 | 0.03 | 9 | 6.38 | 0.03 | 9 | 4.35 | 0.07 | 3 |
| LYD965_H1 | 100229.1 | 55.6 | 0.25 | 19 | 6.95 | 0.25 | 19 | — | — | — |
| LYD961 | 99783.3 | 49.9 | 0.17 | 7 | 6.23 | 0.17 | 7 | 4.30 | 0.30 | 2 |
| LYD961 | 99784.2 | — | — | — | — | — | — | 4.29 | 0.30 | 2 |
| LYD961 | 99784.3 | 58.8 | 0.12 | 26 | 7.35 | 0.12 | 26 | 4.73 | 0.02 | 12 |
| LYD959 | 100308.3 | 55.7 | 0.10 | 19 | 6.96 | 0.10 | 19 | 4.69 | 0.17 | 12 |
| CONT. | — | 46.8 | — | — | 5.85 | — | — | 4.20 | — | — |
| LBY302 | 98839.2 | 62.7 | 0.17 | 8 | 7.84 | 0.17 | 8 | — | — | — |
| LBY296 | 98857.3 | 69.0 | L | 19 | 8.62 | L | 19 | 5.60 | L | 13 |
| LBY290 | 98925.1 | 67.8 | 0.02 | 16 | 8.48 | 0.02 | 16 | 5.42 | 0.03 | 9 |
| LBY289 | 98963.2 | 65.2 | 0.12 | 12 | 8.15 | 0.12 | 12 | 5.28 | 0.22 | 6 |
| LBY270 | 98978.2 | 63.3 | 0.11 | 9 | 7.91 | 0.11 | 9 | — | — | — |
| LBY258 | 98955.1 | — | — | — | — | — | — | 5.47 | 0.08 | 10 |
| LBY258 | 98959.2 | 63.4 | 0.11 | 9 | 7.92 | 0.11 | 9 | 5.28 | 0.11 | 6 |
| LBY246 | 98830.1 | 70.3 | L | 21 | 8.78 | L | 21 | 5.39 | 0.05 | 8 |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 58.2 | — | — | 7.28 | — | — | 4.97 | — | — |
| NUE543 | 94149.1 | 49.7 | 0.02 | 16 | 6.21 | 0.02 | 16 | 4.40 | 0.28 | 4 |
| CONT. | — | 42.7 | — | — | 5.34 | — | — | 4.23 | — | — |
| LBY457 | 99546.1 | 97.4 | 0.03 | 8 | 12.2 | 0.03 | 8 | 6.10 | 0.16 | 3 |
| LBY457 | 99546.2 | 95.4 | 0.12 | 5 | 11.9 | 0.12 | 5 | — | — | — |
| LBY457 | 99547.2 | 103.2 | 0.12 | 14 | 12.9 | 0.12 | 14 | 6.17 | 0.06 | 4 |
| LBY456 | 99525.3 | 107.3 | 0.16 | 19 | 13.4 | 0.16 | 19 | 6.54 | L | 10 |
| LBY456 | 99527.1 | 107.1 | 0.10 | 18 | 13.4 | 0.10 | 18 | 6.45 | L | 8 |
| LBY454 | 99517.3 | 96.0 | 0.06 | 6 | 12.0 | 0.06 | 6 | 6.30 | L | 6 |
| LBY454 | 99518.1 | 102.3 | 0.27 | 13 | 12.8 | 0.27 | 13 | 6.30 | L | 6 |
| LBY454 | 99519.1 | 105.4 | 0.20 | 16 | 13.2 | 0.20 | 16 | 6.55 | 0.21 | 10 |
| LBY430 | 99762.3 | 102.1 | 0.07 | 13 | 12.8 | 0.07 | 13 | — | — | — |
| LBY424 | 99699.3 | 104.6 | 0.09 | 16 | 13.1 | 0.09 | 16 | 6.49 | L | 9 |
| LBY419 | 99521.3 | 101.6 | L | 12 | 12.7 | L | 12 | 6.27 | 0.02 | 5 |
| LBY419 | 99522.3 | 101.0 | L | 12 | 12.6 | L | 12 | 6.55 | L | 10 |
| LBY419 | 99524.3 | 100.9 | L | 12 | 12.6 | L | 12 | 6.44 | L | 8 |
| LBY412 | 99626.3 | 97.4 | 0.22 | 8 | 12.2 | 0.22 | 8 | — | — | — |
| LBY412 | 99629.1 | 107.6 | L | 19 | 13.4 | L | 19 | 6.32 | 0.15 | 6 |
| LBY410 | 99693.1 | — | — | — | 13.4 | L | 19 | 6.56 | L | 10 |
| LBY410 | 99693.3 | 108.2 | L | 20 | 13.5 | L | 20 | 6.48 | L | 9 |
| LBY410 | 99694.2 | 95.8 | 0.15 | 6 | 12.0 | 0.15 | 6 | 6.29 | 0.10 | 6 |
| LBY406 | 99755.2 | 97.2 | 0.21 | 7 | 12.2 | 0.21 | 7 | — | — | — |
| LBY404 | 99686.1 | 101.4 | 0.02 | 12 | 12.7 | 0.02 | 12 | — | — | — |
| LBY404 | 99686.3 | — | — | — | — | — | — | 6.10 | 0.29 | 3 |
| LBY404 | 99687.1 | 100.0 | L | 10 | 12.5 | L | 10 | 6.49 | L | 9 |
| LBY401 | 99703.2 | 99.1 | 0.01 | 9 | 12.4 | 0.01 | 9 | — | — | — |
| LBY401 | 99704.2 | 107.4 | 0.02 | 19 | 13.4 | 0.02 | 19 | 6.30 | L | 6 |
| LBY380 | 99753.1 | 95.4 | 0.28 | 5 | 11.9 | 0.28 | 5 | — | — | — |
| LBY357 | 99540.1 | 103.9 | L | 15 | 13.0 | L | 15 | 6.28 | 0.03 | 5 |
| LBY357 | 99541.1 | 99.7 | 0.01 | 10 | 12.5 | 0.01 | 10 | 6.21 | 0.13 | 4 |
| LBY357 | 99543.1 | 94.0 | 0.28 | 4 | 11.7 | 0.28 | 4 | — | — | — |
| LBY355 | 99539.1 | 100.4 | 0.14 | 11 | 12.5 | 0.14 | 11 | 6.49 | 0.02 | 9 |
| LBY312 | 99482.1 | 104.9 | 0.20 | 16 | 13.1 | 0.20 | 16 | — | — | — |
| CONT. | — | 90.5 | — | — | 11.3 | — | — | 5.95 | — | — |
| LBY303 | 98664.2 | 82.6 | 0.11 | 12 | 10.3 | 0.11 | 12 | 5.16 | 0.19 | 6 |
| LBY281 | 98741.1 | 84.8 | 0.05 | 15 | 10.6 | 0.05 | 15 | 5.20 | 0.10 | 7 |
| LBY280 | 98584.2 | 82.9 | 0.08 | 12 | 10.4 | 0.08 | 12 | 5.26 | 0.05 | 8 |
| LBY278 | 98735.3 | 91.9 | L | 24 | 11.5 | L | 24 | 5.40 | 0.03 | 11 |
| LBY278 | 98736.2 | 92.2 | 0.09 | 25 | 11.5 | 0.09 | 25 | 5.36 | 0.08 | 10 |
| LBY278 | 98737.1 | 80.3 | 0.19 | 9 | 10.0 | 0.19 | 9 | 5.23 | 0.06 | 8 |
| LBY278 | 98737.2 | 83.9 | 0.22 | 13 | 10.5 | 0.22 | 13 | 5.15 | 0.16 | 6 |
| LBY272 | 98645.2 | 86.1 | 0.11 | 16 | 10.8 | 0.11 | 16 | 5.21 | 0.09 | 7 |
| LBY269 | 98775.5 | 81.1 | 0.15 | 10 | 10.1 | 0.15 | 10 | 5.13 | 0.15 | 6 |
| LBY269 | 98775.6 | 87.0 | 0.30 | 18 | 10.9 | 0.30 | 18 | — | — | — |
| LBY269 | 98778.1 | 83.6 | 0.09 | 13 | 10.4 | 0.09 | 13 | 5.18 | 0.14 | 6 |
| LBY268 | 98597.3 | — | — | — | — | — | — | 5.06 | 0.29 | 4 |
| LBY266 | 98592.4 | 86.4 | 0.12 | 17 | 10.8 | 0.12 | 17 | 5.19 | 0.11 | 7 |
| LBY259 | 98641.2 | 86.9 | 0.10 | 18 | 10.9 | 0.10 | 18 | 5.23 | 0.11 | 8 |
| LBY248 | 98639.2 | 80.7 | 0.22 | 9 | 10.1 | 0.22 | 9 | 5.10 | 0.27 | 5 |
| LBY248 | 98639.3 | 83.7 | 0.11 | 13 | 10.5 | 0.11 | 13 | 5.24 | 0.05 | 8 |
| LBY247 | 98632.2 | 82.6 | 0.24 | 12 | 10.3 | 0.24 | 12 | 5.26 | 0.08 | 8 |
| LBY244 | 98570.1 | 82.0 | 0.12 | 11 | 10.2 | 0.12 | 11 | 5.24 | 0.06 | 8 |
| CONT. | — | 74.0 | — | — | 9.24 | — | — | 4.86 | — | — |
| LYD998 | 99034.1 | 55.9 | 0.02 | 5 | 6.99 | 0.02 | 5 | — | — | — |
| LYD995 | 99181.1 | — | — | — | — | — | — | 4.77 | 0.29 | 1 |
| LYD993 | 99437.1 | 64.9 | 0.26 | 21 | 8.11 | 0.26 | 21 | 5.21 | 0.10 | 10 |
| LYD993 | 99437.3 | 62.5 | 0.08 | 17 | 7.81 | 0.08 | 17 | 5.14 | 0.25 | 9 |
| LYD991 | 99557.2 | 57.6 | 0.17 | 8 | 7.20 | 0.17 | 8 | 4.94 | 0.12 | 5 |
| LYD991 | 99558.1 | 57.8 | 0.25 | 8 | 7.23 | 0.25 | 8 | 4.90 | L | 4 |
| LYD989 | 99179.2 | 54.4 | 0.18 | 2 | 6.80 | 0.18 | 2 | 4.78 | 0.28 | 1 |
| LYD987 | 99173.2 | 56.4 | L | 6 | 7.05 | L | 6 | 5.00 | 0.17 | 6 |
| LYD984 | 99391.1 | 66.5 | 0.05 | 24 | 8.31 | 0.05 | 24 | 5.17 | L | 10 |
| LYD979 | 99165.2 | 58.9 | 0.09 | 10 | 7.36 | 0.09 | 10 | 5.07 | 0.02 | 8 |
| LYD979 | 99168.1 | 58.0 | 0.24 | 9 | 7.25 | 0.24 | 9 | — | — | — |
| LYD978 | 99550.2 | — | — | — | — | — | — | 5.01 | L | 6 |
| LYD978 | 99550.3 | — | — | — | — | — | — | 5.00 | 0.19 | 6 |
| LYD977 | 99601.3 | — | — | — | — | — | — | 4.92 | 0.28 | 4 |
| LYD971 | 99116.2 | 58.7 | L | 10 | 7.34 | L | 10 | 5.12 | 0.17 | 8 |
| LYD971 | 99117.1 | 56.2 | 0.07 | 5 | 7.02 | 0.07 | 5 | — | — | — |
| LYD969 | 99360.2 | 60.2 | L | 13 | 7.53 | L | 13 | 4.93 | 0.23 | 5 |
| LYD969 | 99361.3 | — | — | — | — | — | — | 4.84 | 0.03 | 3 |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD969 | 99364.1 | 59.1 | 0.10 | 11 | 7.39 | 0.10 | 11 | — | — | — |
| LYD964 | 99144.3 | 58.1 | 0.05 | 9 | 7.26 | 0.05 | 9 | 5.05 | L | 7 |
| LYD963 | 99298.4 | 56.0 | 0.18 | 5 | 7.00 | 0.18 | 5 | 4.96 | 0.14 | 5 |
| LYD963 | 99299.2 | — | — | — | — | — | — | 4.97 | 0.29 | 5 |
| LYD962 | 99138.1 | — | — | — | — | — | — | 4.87 | 0.27 | 3 |
| CONT. | — | 53.5 | — | — | 6.68 | — | — | 4.72 | — | — |
| LBY457 | 99546.3 | — | — | — | — | — | — | 4.82 | 0.23 | 2 |
| LBY457 | 99547.2 | 74.9 | L | 25 | 9.37 | L | 25 | 5.33 | 0.11 | 13 |
| LBY456 | 99525.3 | 79.9 | L | 34 | 9.99 | L | 34 | 5.26 | L | 11 |
| LBY456 | 99529.1 | 71.0 | 0.02 | 19 | 8.87 | 0.02 | 19 | 5.08 | L | 7 |
| LBY454 | 99515.1 | 71.4 | L | 20 | 8.92 | L | 20 | 5.17 | L | 9 |
| LBY454 | 99517.3 | 61.9 | 0.10 | 4 | 7.73 | 0.10 | 4 | — | — | — |
| LBY454 | 99519.1 | 63.1 | 0.05 | 6 | 7.89 | 0.05 | 6 | — | — | — |
| LBY430 | 99762.1 | 96.7 | L | 62 | 12.1 | L | 62 | 6.02 | L | 27 |
| LBY430 | 99762.3 | 65.9 | 0.22 | 10 | 8.23 | 0.22 | 10 | 4.91 | 0.20 | 4 |
| LBY424 | 99696.2 | 76.2 | 0.04 | 27 | 9.52 | 0.04 | 27 | 5.38 | L | 14 |
| LBY419 | 99522.2 | 72.9 | 0.10 | 22 | 9.11 | 0.10 | 22 | 5.13 | 0.26 | 8 |
| LBY419 | 99524.3 | 68.8 | 0.08 | 15 | 8.60 | 0.08 | 15 | 5.14 | L | 9 |
| LBY412 | 99625.3 | 71.4 | L | 20 | 8.93 | L | 20 | 5.11 | 0.12 | 8 |
| LBY412 | 99629.1 | 73.0 | L | 22 | 9.12 | L | 22 | 5.29 | L | 12 |
| LBY412 | 99629.3 | 77.0 | 0.02 | 29 | 9.62 | 0.02 | 29 | 5.26 | 0.12 | 11 |
| LBY410 | 99691.1 | — | — | — | — | — | — | 4.87 | 0.08 | 3 |
| LBY410 | 99693.1 | 85.4 | L | 43 | 10.7 | L | 43 | 5.57 | L | 18 |
| LBY410 | 99693.2 | 68.4 | L | 15 | 8.56 | L | 15 | 5.08 | L | 7 |
| LBY406 | 99756.1 | 66.2 | 0.13 | 11 | 8.27 | 0.13 | 11 | 4.94 | 0.27 | 4 |
| LBY404 | 99685.3 | 75.1 | 0.17 | 26 | 9.39 | 0.17 | 26 | 5.08 | 0.22 | 7 |
| LBY404 | 99686.3 | 85.7 | 0.01 | 43 | 10.7 | 0.01 | 43 | 5.65 | 0.04 | 19 |
| LBY401 | 99701.1 | 75.4 | 0.04 | 26 | 9.42 | 0.04 | 26 | 5.29 | 0.09 | 12 |
| LBY401 | 99702.1 | 63.3 | 0.02 | 6 | 7.91 | 0.02 | 6 | 4.93 | 0.02 | 4 |
| LBY401 | 99703.2 | 64.8 | 0.12 | 8 | 8.10 | 0.12 | 8 | — | — | — |
| LBY401 | 99704.1 | 71.4 | 0.24 | 20 | 8.93 | 0.24 | 20 | — | — | — |
| LBY401 | 99704.2 | 73.8 | 0.13 | 24 | 9.23 | 0.13 | 24 | 5.19 | 0.28 | 10 |
| LBY380 | 99752.2 | 66.4 | 0.06 | 11 | 8.30 | 0.06 | 11 | 4.87 | 0.26 | 3 |
| LBY318 | 99932.1 | 70.9 | 0.28 | 19 | 8.86 | 0.28 | 19 | — | — | — |
| LBY318 | 99932.2 | 72.4 | L | 21 | 9.05 | L | 21 | 5.24 | L | 11 |
| LBY312 | 99482.1 | 66.3 | 0.15 | 11 | 8.28 | 0.15 | 11 | 4.87 | 0.08 | 3 |
| LBY312 | 99484.1 | 70.2 | 0.13 | 18 | 8.78 | 0.13 | 18 | — | — | — |
| LBY312 | 99484.2 | 69.9 | 0.15 | 17 | 8.73 | 0.15 | 17 | 5.02 | 0.22 | 6 |
| CONT. | — | 59.7 | — | — | 7.47 | — | — | 4.73 | — | — |
| LYD982 | 99041.3 | 73.7 | 0.10 | 19 | 9.21 | 0.10 | 19 | 5.20 | 0.19 | 8 |
| LYD980 | 99787.2 | 74.5 | 0.15 | 20 | 9.31 | 0.15 | 20 | 5.28 | 0.12 | 10 |
| LYD980 | 99788.2 | 72.7 | 0.12 | 17 | 9.09 | 0.12 | 17 | 5.11 | 0.21 | 7 |
| CONT. | — | 62.1 | — | — | 7.76 | — | — | 4.79 | — | — |
| LBY451 | 100171.2 | 63.6 | L | 28 | 7.95 | L | 28 | 4.78 | 0.02 | 15 |
| LBY451 | 100173.3 | 58.1 | 0.19 | 17 | 7.26 | 0.19 | 17 | 4.61 | 0.21 | 11 |
| LBY442 | 100162.2 | 53.5 | 0.30 | 8 | 6.68 | 0.30 | 8 | — | — | — |
| LBY434 | 99900.2 | 70.3 | 0.01 | 42 | 8.78 | 0.01 | 42 | 5.02 | L | 21 |
| LBY434 | 99901.3 | 66.5 | 0.03 | 34 | 8.31 | 0.03 | 34 | 4.95 | 0.01 | 19 |
| LBY427 | 100186.1 | 80.1 | 0.20 | 62 | 10.0 | 0.20 | 62 | 5.35 | 0.09 | 28 |
| LBY427 | 100186.2 | 55.8 | 0.14 | 12 | 6.97 | 0.14 | 12 | 4.38 | 0.20 | 5 |
| LBY423 | 100199.2 | 64.6 | 0.09 | 30 | 8.08 | 0.09 | 30 | 4.79 | L | 15 |
| LBY421 | 100035.3 | 67.5 | 0.02 | 36 | 8.44 | 0.02 | 36 | 4.97 | L | 19 |
| LBY421 | 100038.1 | 62.7 | 0.21 | 26 | 7.83 | 0.21 | 26 | 4.72 | 0.13 | 13 |
| LBY421 | 100039.1 | 67.6 | 0.17 | 36 | 8.45 | 0.17 | 36 | 4.90 | 0.07 | 18 |
| LBY413 | 100230.2 | 71.7 | 0.17 | 45 | 8.96 | 0.17 | 45 | 5.04 | 0.27 | 21 |
| LBY413 | 100233.2 | 64.9 | 0.17 | 31 | 8.11 | 0.17 | 31 | 4.87 | 0.10 | 17 |
| LBY409 | 99504.1 | 63.9 | 0.19 | 29 | 7.99 | 0.19 | 29 | 4.49 | 0.23 | 8 |
| LBY409 | 99504.2 | 71.3 | L | 44 | 8.91 | L | 44 | 4.76 | L | 14 |
| LBY378 | 100222.2 | — | — | — | — | — | — | 4.54 | 0.22 | 9 |
| LBY377 | 99964.2 | 62.9 | 0.30 | 27 | 7.86 | 0.30 | 27 | 4.66 | 0.19 | 12 |
| LBY364 | 100325.2 | 55.2 | 0.12 | 11 | 6.90 | 0.12 | 11 | — | — | — |
| LBY352 | 100075.1 | — | — | — | — | — | — | 4.69 | 0.28 | 13 |
| LBY352 | 100075.2 | 73.9 | 0.20 | 49 | 9.24 | 0.20 | 49 | 5.03 | 0.20 | 21 |
| LBY352 | 100078.2 | 67.5 | L | 36 | 8.43 | L | 36 | 4.79 | L | 15 |
| LBY352 | 100079.2 | 79.4 | L | 60 | 9.93 | L | 60 | 5.30 | L | 27 |
| LBY346 | 100153.1 | — | — | — | — | — | — | 4.52 | 0.08 | 9 |
| LBY331 | 100241.1 | 58.8 | 0.17 | 19 | 7.35 | 0.17 | 19 | — | — | — |
| LBY331 | 100243.3 | 57.9 | 0.25 | 17 | 7.24 | 0.25 | 17 | — | — | — |
| LBY311 | 100135.3 | 64.0 | 0.27 | 29 | 8.51 | 0.03 | 37 | 4.83 | L | 16 |
| LBY311 | 100136.3 | — | — | — | — | — | — | 4.41 | 0.29 | 6 |
| LBY311 | 100139.3 | 86.6 | 0.06 | 74 | 10.8 | 0.06 | 74 | 5.63 | 0.02 | 35 |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 49.6 | — | — | 6.20 | — | — | 4.16 | — | — |
| LBY308 | 98703.2 | — | — | — | — | — | — | 5.40 | 0.14 | 6 |
| LBY303 | 98660.3 | — | — | — | — | — | — | 5.25 | 0.30 | 3 |
| LBY303 | 98663.2 | 73.3 | 0.25 | 10 | 9.16 | 0.25 | 10 | 5.48 | 0.02 | 8 |
| LBY281 | 98744.1 | 75.0 | 0.07 | 13 | 9.37 | 0.07 | 13 | 5.41 | 0.09 | 6 |
| LBY280 | 98580.3 | 72.5 | 0.13 | 9 | 9.07 | 0.13 | 9 | 5.31 | 0.13 | 4 |
| LBY280 | 98581.3 | 71.3 | 0.25 | 7 | 8.91 | 0.25 | 7 | 5.30 | 0.12 | 4 |
| LBY278 | 98736.2 | 79.1 | 0.22 | 19 | 9.89 | 0.22 | 19 | — | — | — |
| LBY278 | 98737.2 | 78.1 | 0.21 | 17 | 9.77 | 0.21 | 17 | — | — | — |
| LBY269 | 98775.3 | 78.1 | 0.11 | 17 | 9.77 | 0.11 | 17 | 5.57 | 0.15 | 9 |
| LBY269 | 98775.5 | 78.4 | 0.09 | 18 | 9.80 | 0.09 | 18 | 5.47 | 0.07 | 7 |
| LBY269 | 98775.6 | 92.1 | 0.08 | 38 | 11.5 | 0.08 | 38 | 6.17 | L | 21 |
| LBY268 | 98597.2 | — | — | — | — | — | — | 5.28 | 0.27 | 4 |
| LBY266 | 98592.4 | — | — | — | — | — | — | 5.25 | 0.29 | 3 |
| LBY259 | 98641.2 | 79.7 | 0.04 | 20 | 9.96 | 0.04 | 20 | 5.73 | 0.05 | 12 |
| LBY252 | 98577.4 | — | — | — | — | — | — | 5.29 | 0.17 | 4 |
| LBY248 | 98639.3 | — | — | — | — | — | — | 5.25 | 0.29 | 3 |
| LBY247 | 98630.1 | 74.0 | 0.19 | 11 | 9.25 | 0.19 | 11 | 5.39 | 0.16 | 6 |
| LBY244 | 98570.1 | — | — | — | — | — | — | 5.45 | 0.29 | 7 |
| LBY244 | 98572.2 | — | — | — | — | — | — | 5.73 | 0.26 | 12 |
| LBY240 | 98566.1 | — | — | — | — | — | — | 5.26 | 0.20 | 3 |
| CONT. | — | 66.5 | — | — | 8.32 | — | — | 5.10 | — | — |
| LYD998 | 99034.1 | — | — | — | — | — | — | 5.88 | 0.28 | 4 |
| LYD996 | 99037.2 | 93.1 | 0.14 | 7 | 11.6 | 0.14 | 7 | 5.88 | 0.19 | 4 |
| LYD996 | 99038.3 | 95.1 | 0.17 | 9 | 11.9 | 0.17 | 9 | — | — | — |
| LYD996 | 99039.4 | 100.6 | 0.27 | 16 | 12.6 | 0.27 | 16 | — | — | — |
| LYD995 | 99180.1 | 99.7 | 0.13 | 15 | 12.5 | 0.13 | 15 | 6.11 | 0.17 | 8 |
| LYD993 | 99435.3 | 101.6 | 0.07 | 17 | 12.7 | 0.07 | 17 | 6.08 | 0.07 | 7 |
| LYD993 | 99436.1 | 100.7 | 0.23 | 16 | 12.6 | 0.23 | 16 | — | — | — |
| LYD993 | 99436.2 | 92.9 | 0.13 | 7 | 11.6 | 0.13 | 7 | — | — | — |
| LYD991 | 99557.2 | 91.1 | 0.28 | 5 | 11.4 | 0.28 | 5 | — | — | — |
| LYD991 | 99557.3 | 95.5 | 0.13 | 10 | 11.9 | 0.13 | 10 | 6.05 | 0.04 | 7 |
| LYD991 | 99558.1 | 97.2 | 0.28 | 12 | 12.2 | 0.28 | 12 | — | — | — |
| LYD991 | 99559.3 | 105.4 | 0.05 | 21 | 13.2 | 0.05 | 21 | 6.36 | 0.09 | 12 |
| LYD989 | 99175.2 | 106.6 | L | 22 | 13.3 | L | 22 | 6.50 | L | 15 |
| LYD987 | 99170.1 | — | — | — | — | — | — | 5.85 | 0.29 | 3 |
| LYD987 | 99172.1 | 96.1 | 0.03 | 10 | 12.0 | 0.03 | 10 | 6.16 | 0.02 | 9 |
| LYD987 | 99173.2 | 100.4 | 0.17 | 15 | 12.6 | 0.17 | 15 | 6.18 | 0.30 | 9 |
| LYD984 | 99391.3 | — | — | — | — | — | — | 5.91 | 0.15 | 4 |
| LYD979 | 99165.3 | — | — | — | — | — | — | 6.01 | 0.06 | 6 |
| LYD978 | 99552.2 | 104.1 | 0.02 | 20 | 13.0 | 0.02 | 20 | 6.28 | L | 11 |
| LYD977 | 99601.1 | 92.5 | 0.18 | 6 | 11.6 | 0.18 | 6 | — | — | — |
| LYD977 | 99601.3 | 96.9 | 0.26 | 11 | 12.1 | 0.26 | 11 | 5.92 | 0.14 | 5 |
| LYD969 | 99361.3 | 100.5 | L | 16 | 12.6 | L | 16 | 6.33 | 0.10 | 12 |
| LYD969 | 99364.1 | 100.8 | L | 16 | 12.6 | L | 16 | 5.97 | 0.08 | 5 |
| LYD962 | 99135.1 | 95.7 | 0.04 | 10 | 12.0 | 0.04 | 10 | 5.98 | 0.18 | 6 |
| LYD962 | 99138.1 | 97.5 | 0.02 | 12 | 12.2 | 0.02 | 12 | 6.08 | 0.03 | 7 |
| CONT. | — | 87.0 | — | — | 10.9 | — | — | 5.67 | — | — |
| LBY439 | 99927.2 | 75.4 | 0.01 | 23 | 9.43 | 0.01 | 23 | 5.33 | 0.05 | 9 |
| LBY439 | 99929.2 | 68.2 | 0.16 | 11 | 8.52 | 0.16 | 11 | 5.16 | 0.18 | 6 |
| LBY439 | 99929.3 | 67.4 | 0.20 | 10 | 8.43 | 0.20 | 10 | 5.11 | 0.24 | 5 |
| LBY431 | 99890.2 | 69.7 | 0.20 | 13 | 8.71 | 0.20 | 13 | — | — | — |
| LBY431 | 99894.2 | 67.8 | 0.17 | 10 | 8.47 | 0.17 | 10 | — | — | — |
| LBY418 | 99880.3 | — | — | — | — | — | — | 5.24 | 0.22 | 7 |
| LBY418 | 99881.8 | 82.8 | 0.02 | 35 | 10.4 | 0.02 | 35 | 5.65 | L | 16 |
| LBY405 | 99946.3 | 71.3 | 0.05 | 16 | 8.91 | 0.05 | 16 | — | — | — |
| LBY394 | 99936.3 | 80.0 | 0.28 | 30 | 10.0 | 0.28 | 30 | — | — | — |
| LBY394 | 99937.2 | 73.7 | 0.28 | 20 | 9.21 | 0.28 | 20 | 5.29 | 0.28 | 8 |
| LBY384 | 100166.2 | 70.5 | 0.06 | 15 | 8.81 | 0.06 | 15 | 5.15 | 0.19 | 5 |
| LBY371 | 100180.1 | 74.4 | 0.02 | 21 | 9.30 | 0.02 | 21 | 5.38 | 0.03 | 10 |
| LBY366 | 99860.3 | 68.7 | 0.17 | 12 | 8.59 | 0.17 | 12 | — | — | — |
| LBY366 | 99861.1 | 75.2 | 0.08 | 22 | 9.40 | 0.08 | 22 | 5.25 | 0.13 | 8 |
| LBY366 | 99861.3 | 68.0 | 0.15 | 11 | 8.50 | 0.15 | 11 | — | — | — |
| LBY366 | 99862.2 | — | — | — | — | — | — | 5.25 | 0.28 | 8 |
| LBY362 | 99858.2 | 70.2 | 0.08 | 14 | 8.78 | 0.08 | 14 | 5.13 | 0.24 | 5 |
| LBY349 | 100126.3 | 68.0 | 0.28 | 11 | 8.50 | 0.28 | 11 | — | — | — |
| LBY340 | 99488.2 | 68.4 | 0.22 | 11 | 8.56 | 0.22 | 11 | 5.17 | 0.25 | 6 |
| LBY332 | 99820.1 | 73.2 | 0.09 | 19 | 9.15 | 0.09 | 19 | 5.46 | 0.07 | 12 |
| LBY332 | 99823.3 | 71.8 | 0.05 | 17 | 8.98 | 0.05 | 17 | 5.20 | 0.12 | 6 |
| LBY332 | 99824.3 | 71.5 | 0.09 | 16 | 8.93 | 0.09 | 16 | 5.35 | 0.04 | 9 |
| CONT. | — | 61.4 | — | — | 7.68 | — | — | 4.88 | — | — |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD997 | 99563.1 | 60.8 | L | 15 | 7.60 | L | 15 | 5.31 | L | 10 |
| LYD988 | 99048.1 | 62.4 | L | 18 | 7.79 | L | 18 | 5.26 | 0.02 | 9 |
| LYD986 | 99021.3 | 63.9 | 0.26 | 21 | 7.98 | 0.26 | 21 | 5.13 | 0.04 | 6 |
| LYD986 | 99023.2 | 68.2 | 0.09 | 29 | 8.53 | 0.09 | 29 | 5.56 | 0.02 | 15 |
| LYD975 | 99157.1 | 67.7 | L | 28 | 8.46 | L | 28 | 5.56 | L | 15 |
| LYD974 | 99058.2 | 69.4 | 0.22 | 31 | 8.67 | 0.22 | 31 | 5.47 | 0.27 | 14 |
| LYD973 | 99150.2 | — | — | — | — | — | — | 4.98 | 0.03 | 3 |
| LYD973 | 99152.1 | 58.3 | 0.04 | 10 | 7.29 | 0.04 | 10 | 5.23 | 0.07 | 9 |
| LYD970 | 99381.1 | 61.3 | 0.22 | 16 | 7.67 | 0.22 | 16 | — | — | — |
| LYD967 | 99149.1 | 67.5 | 0.09 | 27 | 8.44 | 0.09 | 27 | 5.55 | 0.10 | 15 |
| LYD960 | 99635.4 | — | — | — | — | — | — | 5.17 | 0.18 | 7 |
| LYD960 | 99638.3 | — | — | — | — | — | — | 5.18 | 0.28 | 7 |
| LYD958 | 99132.1 | 65.9 | L | 24 | 8.24 | L | 24 | 5.32 | 0.09 | 10 |
| LYD957 | 99018.4 | 61.1 | 0.05 | 15 | 7.63 | 0.05 | 15 | 5.21 | 0.06 | 8 |
| LYD952 | 98255.3 | 61.8 | L | 17 | 7.73 | L | 17 | 5.22 | 0.01 | 8 |
| LYD949 | 98218.2 | 64.6 | 0.21 | 22 | 8.08 | 0.21 | 22 | — | — | — |
| LYD941 | 98985.1 | 55.0 | 0.15 | 4 | 6.88 | 0.15 | 4 | — | — | — |
| LYD941 | 98988.1 | 65.3 | L | 23 | 8.16 | L | 23 | 5.41 | L | 12 |
| LYD941 | 98988.3 | 60.6 | 0.12 | 15 | 7.58 | 0.12 | 15 | 5.21 | 0.18 | 8 |
| LYD937 | 98272.1 | 55.7 | 0.21 | 5 | 6.97 | 0.21 | 5 | — | — | — |
| CONT. | | 53.0 | — | — | 6.62 | — | — | 4.82 | — | — |
| NUE543 | 94149.1 | 40.9 | 0.08 | 15 | 5.11 | 0.08 | 15 | 3.85 | 0.15 | 3 |
| CONT. | | 35.5 | — | — | 4.44 | — | — | 3.73 | — | — |
| LBY304 | 99094.3 | 74.2 | 0.17 | 34 | 9.28 | 0.17 | 34 | — | — | — |
| LBY299_H1 | 99807.1 | 61.6 | 0.08 | 11 | 7.70 | 0.08 | 11 | 4.88 | 0.10 | 5 |
| LBY291 | 99767.2 | 60.7 | 0.10 | 9 | 7.59 | 0.10 | 9 | — | — | — |
| LBY283 | 99060.2 | 61.9 | 0.07 | 12 | 7.73 | 0.07 | 12 | 5.00 | 0.07 | 8 |
| LBY283 | 99062.2 | 70.2 | 0.26 | 27 | 8.78 | 0.26 | 27 | — | — | — |
| LBY283 | 99063.2 | 66.2 | 0.07 | 19 | 8.28 | 0.07 | 19 | 4.94 | 0.06 | 7 |
| LBY274 | 99345.2 | 67.3 | 0.09 | 21 | 8.42 | 0.09 | 21 | 4.98 | 0.21 | 7 |
| LBY264 | 99509.2 | 61.4 | 0.08 | 11 | 7.68 | 0.08 | 11 | 4.89 | 0.09 | 5 |
| LBY263 | 98973.3 | 60.2 | 0.15 | 8 | 7.52 | 0.15 | 8 | 4.82 | 0.21 | 4 |
| CONT. | | 55.5 | — | — | 6.93 | — | — | 4.64 | — | — |
| LBY310 | 98923.1 | 79.0 | L | 21 | 9.88 | L | 21 | 5.14 | 0.05 | 10 |
| LBY305 | 98842.1 | 84.4 | L | 29 | 10.5 | L | 29 | 5.40 | L | 15 |
| LBY296 | 98857.2 | 72.8 | 0.15 | 12 | 9.10 | 0.15 | 12 | 5.12 | 0.06 | 9 |
| LBY295 | 98803.1 | 71.5 | 0.22 | 10 | 8.94 | 0.22 | 10 | — | — | — |
| LBY290 | 98929.2 | 70.7 | 0.13 | 8 | 8.84 | 0.13 | 8 | — | — | — |
| LBY289 | 98963.1 | — | — | — | — | — | — | 4.88 | 0.25 | 4 |
| LBY275 | 98911.1 | 73.3 | 0.04 | 12 | 9.16 | 0.04 | 12 | 4.86 | 0.15 | 4 |
| LBY275 | 98914.1 | — | — | — | — | — | — | 4.88 | 0.07 | 4 |
| LBY275 | 98914.3 | — | — | — | — | — | — | 4.86 | 0.11 | 4 |
| LBY270 | 98978.3 | 77.1 | 0.15 | 18 | 9.63 | 0.15 | 18 | 4.93 | 0.03 | 5 |
| LBY270 | 98979.2 | 72.3 | 0.08 | 11 | 9.04 | 0.08 | 11 | 4.90 | 0.05 | 4 |
| LBY258 | 98957.1 | 76.2 | 0.22 | 17 | 9.52 | 0.22 | 17 | — | — | — |
| LBY258 | 98959.3 | 75.3 | 0.07 | 16 | 9.41 | 0.07 | 16 | 5.20 | L | 11 |
| LBY246 | 98830.1 | 82.1 | 0.23 | 26 | 10.3 | 0.23 | 26 | — | — | — |
| LBY237 | 98901.4 | 70.6 | 0.10 | 8 | 8.83 | 0.10 | 8 | — | — | — |
| CONT. | | 65.2 | — | — | 8.15 | — | — | 4.69 | — | — |
| LYD997 | 99560.3 | — | — | — | — | — | — | 5.86 | 0.27 | 3 |
| LYD997 | 99562.2 | — | — | — | — | — | — | 6.26 | 0.14 | 10 |
| LYD997 | 99563.1 | 107.0 | L | 20 | 13.4 | L | 20 | 6.19 | L | 8 |
| LYD988 | 99048.4 | 97.5 | 0.05 | 9 | 12.2 | 0.05 | 9 | 5.97 | 0.05 | 5 |
| LYD986 | 99023.2 | 95.4 | 0.14 | 7 | 11.9 | 0.14 | 7 | 5.90 | 0.22 | 3 |
| LYD976 | 99164.3 | 108.7 | L | 22 | 13.6 | L | 22 | 6.15 | 0.05 | 8 |
| LYD975 | 99156.3 | 99.4 | 0.01 | 11 | 12.4 | 0.01 | 11 | 6.17 | 0.12 | 8 |
| LYD975 | 99156.4 | 100.6 | L | 13 | 12.6 | L | 13 | 6.32 | L | 11 |
| LYD974 | 99056.1 | 94.7 | 0.19 | 6 | 11.8 | 0.19 | 6 | — | — | — |
| LYD974 | 99056.3 | 93.8 | 0.28 | 5 | 11.7 | 0.28 | 5 | — | — | — |
| LYD974 | 99059.1 | 102.6 | L | 15 | 12.8 | L | 15 | 6.24 | 0.07 | 9 |
| LYD970 | 99381.1 | 112.6 | 0.09 | 26 | 14.1 | 0.09 | 26 | 6.34 | L | 11 |
| LYD970 | 99384.2 | — | — | — | — | — | — | 6.22 | 0.19 | 9 |
| LYD967 | 99148.3 | 94.8 | 0.30 | 6 | 11.8 | 0.30 | 6 | — | — | — |
| LYD958 | 99130.2 | 96.8 | 0.10 | 8 | 12.1 | 0.10 | 8 | — | — | — |
| LYD957 | 99019.3 | 105.5 | 0.13 | 18 | 13.2 | 0.13 | 18 | 6.65 | L | 16 |
| LYD949 | 98215.2 | — | — | — | — | — | — | 6.21 | 0.30 | 9 |
| LYD941 | 98989.1 | 99.1 | 0.18 | 11 | 12.4 | 0.18 | 11 | 6.19 | 0.18 | 8 |
| LYD937 | 98270.1 | 96.6 | 0.04 | 8 | 12.1 | 0.04 | 8 | 6.00 | 0.09 | 5 |
| LYD937 | 98272.2 | 105.7 | 0.27 | 18 | 13.2 | 0.27 | 18 | 6.27 | 0.18 | 10 |
| CONT. | | 89.4 | — | — | 11.2 | — | — | 5.71 | — | — |
| LBY441 | 99819.3 | 96.8 | L | 20 | 12.1 | L | 20 | 6.45 | L | 13 |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY439 | 99927.2 | 91.9 | 0.08 | 14 | 11.5 | 0.08 | 14 | 5.96 | 0.24 | 4 |
| LBY431 | 99891.2 | 101.9 | 0.06 | 26 | 12.7 | 0.06 | 26 | 6.41 | 0.01 | 12 |
| LBY431 | 99893.2 | — | — | — | — | — | — | 5.99 | 0.20 | 5 |
| LBY418 | 99883.3 | 110.1 | 0.18 | 36 | 13.8 | 0.18 | 36 | 6.56 | 0.12 | 15 |
| LBY405 | 99946.3 | 86.2 | 0.25 | 6 | 10.8 | 0.25 | 6 | — | — | — |
| LBY394 | 99936.2 | 89.3 | 0.09 | 10 | 11.2 | 0.09 | 10 | — | — | — |
| LBY369 | 99915.1 | 88.8 | 0.11 | 10 | 11.1 | 0.11 | 10 | — | — | — |
| LBY369 | 99918.2 | 87.1 | 0.19 | 8 | 10.9 | 0.19 | 8 | — | — | — |
| LBY369 | 99919.3 | 97.4 | 0.04 | 20 | 12.2 | 0.04 | 20 | 6.43 | 0.11 | 13 |
| LBY366 | 99861.1 | 93.7 | 0.09 | 16 | 11.7 | 0.09 | 16 | 6.19 | 0.09 | 8 |
| LBY366 | 99861.3 | 89.0 | 0.23 | 10 | 11.1 | 0.23 | 10 | 6.12 | 0.17 | 7 |
| LBY362 | 99856.1 | 87.1 | 0.19 | 8 | 10.9 | 0.19 | 8 | 6.00 | 0.22 | 5 |
| LBY362 | 99858.2 | 86.7 | 0.26 | 7 | 10.8 | 0.26 | 7 | 5.97 | 0.23 | 5 |
| LBY339 | 100120.3 | 88.3 | 0.25 | 9 | 11.0 | 0.25 | 9 | 6.05 | 0.29 | 6 |
| LBY319 | 100159.3 | 93.0 | 0.17 | 15 | 11.6 | 0.17 | 15 | — | — | — |
| CONT. | — | 81.0 | — | — | 10.1 | — | — | 5.71 | — | — |
| LBY455 | 100043.2 | 59.8 | 0.30 | 11 | 7.48 | 0.30 | 11 | 4.59 | 0.19 | 7 |
| LBY398 | 100089.2 | — | — | — | — | — | — | 4.56 | 0.23 | 6 |
| LBY398 | 100089.3 | 66.9 | 0.15 | 24 | 8.36 | 0.15 | 24 | 4.97 | 0.04 | 16 |
| LBY387 | 99570.2 | — | — | — | — | — | — | 4.65 | 0.24 | 9 |
| LBY383 | 100024.1 | 67.0 | 0.25 | 24 | 8.38 | 0.25 | 24 | 4.94 | 0.25 | 15 |
| LBY368 | 100105.1 | 65.8 | 0.25 | 22 | 8.22 | 0.25 | 22 | 4.81 | 0.12 | 12 |
| LBY368 | 100108.3 | 61.2 | 0.23 | 14 | 7.65 | 0.23 | 14 | — | — | — |
| LBY328 | 99981.3 | — | — | — | — | — | — | 4.75 | 0.12 | 11 |
| LBY327 | 100113.3 | — | — | — | — | — | — | 4.68 | 0.23 | 9 |
| LBY327 | 100114.1 | 71.6 | 0.02 | 33 | 8.95 | 0.02 | 33 | 5.20 | 0.01 | 21 |
| LBY325 | 100146.3 | 68.4 | 0.29 | 27 | 8.55 | 0.29 | 27 | 4.86 | 0.18 | 13 |
| LBY325 | 100149.2 | — | — | — | — | — | — | 4.71 | 0.20 | 10 |
| CONT. | — | 53.9 | — | — | 6.74 | — | — | 4.28 | — | — |
| LBY304 | 99094.3 | 59.8 | L | 18 | 7.48 | L | 18 | 4.85 | L | 10 |
| LBY301 | 98980.1 | 59.6 | 0.16 | 18 | 7.45 | 0.16 | 18 | 4.91 | 0.11 | 12 |
| LBY299_H1 | 99809.2 | 57.7 | L | 14 | 7.21 | L | 14 | 4.90 | 0.08 | 12 |
| LBY298 | 99068.2 | 55.0 | L | 9 | 6.88 | L | 9 | 4.50 | 0.21 | 3 |
| LBY297 | 99776.3 | 59.0 | 0.13 | 17 | 7.37 | 0.13 | 17 | 4.83 | L | 10 |
| LBY294 | 99770.3 | 57.5 | L | 14 | 7.18 | L | 14 | 4.72 | L | 7 |
| LBY294 | 99771.3 | 60.3 | 0.16 | 19 | 7.53 | 0.16 | 19 | 4.81 | 0.08 | 10 |
| LBY288 | 99187.2 | 56.8 | 0.19 | 12 | 7.09 | 0.19 | 12 | 4.63 | L | 5 |
| LBY288 | 99187.3 | 52.4 | 0.12 | 4 | 6.55 | 0.12 | 4 | 4.47 | 0.17 | 2 |
| LBY288 | 99188.1 | 54.4 | L | 8 | 6.80 | L | 8 | 4.49 | 0.23 | 2 |
| LBY283 | 99060.2 | 62.8 | 0.28 | 24 | 7.85 | 0.28 | 24 | — | — | — |
| LBY283 | 99062.1 | 71.8 | L | 42 | 8.98 | L | 42 | 5.24 | L | 19 |
| LBY283 | 99062.2 | 54.5 | 0.06 | 8 | 6.81 | 0.06 | 8 | — | — | — |
| LBY277 | 99124.3 | 56.8 | 0.14 | 13 | 7.10 | 0.14 | 13 | 4.74 | 0.02 | 8 |
| LBY274 | 99345.2 | 64.0 | L | 27 | 8.00 | L | 27 | 4.78 | 0.06 | 9 |
| LBY274 | 99345.3 | 61.0 | 0.06 | 21 | 7.63 | 0.06 | 21 | 4.77 | L | 9 |
| LBY274 | 99346.1 | 57.8 | 0.26 | 15 | 7.22 | 0.26 | 15 | 4.76 | L | 8 |
| LBY274 | 99346.3 | 51.9 | 0.22 | 3 | — | — | — | — | — | — |
| LBY274 | 99349.1 | 57.4 | L | 14 | 7.17 | L | 14 | 4.62 | 0.04 | 5 |
| LBY264 | 99508.2 | 56.0 | 0.25 | 11 | 7.00 | 0.25 | 11 | 4.70 | 0.26 | 7 |
| LBY263 | 98971.2 | 53.0 | 0.23 | 5 | 6.62 | 0.23 | 5 | 4.53 | 0.15 | 3 |
| LBY263 | 98972.2 | 57.0 | L | 13 | 7.13 | L | 13 | 4.62 | L | 5 |
| LBY250 | 99052.1 | — | — | — | — | — | — | 4.55 | 0.03 | 4 |
| LBY242 | 99631.3 | 62.9 | 0.27 | 25 | 7.86 | 0.27 | 25 | 5.07 | 0.25 | 15 |
| LBY242 | 99634.3 | 57.0 | 0.21 | 13 | 7.12 | 0.21 | 13 | 4.63 | 0.27 | 6 |
| CONT. | — | 50.5 | — | — | 6.31 | — | — | 4.39 | — | — |
| LBY451 | 100173.3 | 65.6 | 0.11 | 42 | 8.20 | 0.11 | 42 | 4.80 | 0.19 | 16 |
| LBY427 | 100186.4 | 62.4 | 0.19 | 35 | 7.80 | 0.19 | 35 | 4.78 | 0.23 | 16 |
| LBY423 | 100198.2 | 52.3 | 0.15 | 13 | 6.54 | 0.15 | 13 | 4.37 | 0.19 | 6 |
| LBY421 | 100035.3 | — | — | — | — | — | — | 4.35 | 0.26 | 5 |
| LBY421 | 100039.1 | 65.6 | 0.22 | 42 | 8.20 | 0.22 | 42 | 4.96 | 0.15 | 20 |
| LBY377 | 99961.2 | 55.9 | 0.14 | 21 | 6.99 | 0.14 | 21 | 4.53 | 0.24 | 10 |
| LBY377 | 99964.3 | 66.7 | 0.12 | 44 | 8.34 | 0.12 | 44 | 4.86 | 0.13 | 18 |
| LBY346 | 100150.2 | 64.4 | 0.23 | 39 | 8.05 | 0.23 | 39 | — | — | — |
| LBY311 | 100139.3 | — | — | — | — | — | — | 4.55 | 0.14 | 11 |
| CONT. | — | 46.3 | — | — | 5.79 | — | — | 4.12 | — | — |
| LGA3 | 96419.2 | 48.7 | 0.27 | 10 | 6.09 | 0.27 | 10 | — | — | — |
| CONT. | — | 44.3 | — | — | 5.54 | — | — | — | — | — |
| LBY383 | 100024.3 | 74.7 | 0.14 | 24 | 9.34 | 0.14 | 24 | 5.10 | 0.12 | 10 |
| LBY379 | 100083.1 | 71.9 | 0.26 | 19 | 8.99 | 0.26 | 19 | 5.21 | 0.15 | 13 |
| LBY353 | 100014.1 | 84.5 | 0.11 | 40 | 10.6 | 0.11 | 40 | 5.61 | 0.07 | 21 |
| LBY350 | 100115.2 | — | — | — | — | — | — | 5.02 | 0.18 | 9 |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY342 | 100003.3 | 70.3 | 0.25 | 16 | 8.79 | 0.25 | 16 | — | — | — |
| LBY328 | 99984.1 | — | — | — | — | — | — | 4.98 | 0.24 | 8 |
| LBY327 | 100113.3 | 69.6 | 0.27 | 15 | 8.70 | 0.27 | 15 | 5.06 | 0.15 | 9 |
| LBY327 | 100114.1 | 85.8 | 0.04 | 42 | 10.7 | 0.04 | 42 | 5.37 | 0.06 | 16 |
| LBY326 | 100101.1 | 80.3 | 0.06 | 33 | 10.0 | 0.06 | 33 | 5.31 | 0.05 | 15 |
| LBY326 | 100102.2 | 80.6 | 0.04 | 33 | 10.1 | 0.04 | 33 | 5.47 | 0.03 | 18 |
| LBY326 | 100104.1 | — | — | — | — | — | — | 5.00 | 0.22 | 8 |
| LBY325 | 100146.2 | 81.0 | 0.03 | 34 | 10.1 | 0.03 | 34 | 5.45 | 0.02 | 18 |
| CONT. | — | 60.4 | — | — | 7.56 | — | — | 4.63 | — | — |
| LGA10 | 96401.2 | 50.2 | 0.06 | 19 | 6.27 | 0.06 | 19 | 4.54 | 0.07 | 9 |
| CONT. | — | 42.3 | — | — | 5.29 | — | — | 4.16 | — | — |
| LBY453 | 100511.3 | 63.7 | 0.21 | 9 | 7.96 | 0.21 | 9 | 4.72 | 0.21 | 5 |
| LBY453 | 100512.3 | 68.7 | 0.25 | 17 | 8.58 | 0.25 | 17 | 4.96 | 0.16 | 10 |
| LBY453 | 100513.1 | 79.7 | L | 36 | 9.96 | L | 36 | 5.25 | L | 17 |
| LBY428 | 100190.4 | 66.7 | L | 14 | 8.34 | L | 14 | 4.88 | 0.01 | 8 |
| LBY414 | 99965.2 | — | — | — | — | — | — | 4.62 | 0.15 | 3 |
| LBY414 | 99966.3 | 63.2 | 0.20 | 8 | 7.90 | 0.20 | 8 | 4.69 | 0.19 | 4 |
| LBY414 | 99967.3 | 67.2 | 0.25 | 15 | 8.41 | 0.25 | 15 | 4.98 | 0.22 | 11 |
| LBY414 | 99969.3 | 69.6 | L | 19 | 8.70 | L | 19 | 4.96 | L | 10 |
| LBY408 | 99511.2 | 77.0 | 0.03 | 32 | 9.63 | 0.03 | 32 | 4.94 | 0.25 | 10 |
| LBY408 | 99512.1 | 73.2 | 0.09 | 25 | 9.15 | 0.09 | 25 | 5.00 | 0.04 | 11 |
| LBY408 | 99512.6 | 62.1 | 0.01 | 6 | 7.77 | 0.01 | 6 | 4.60 | 0.22 | 2 |
| LBY408 | 99513.3 | 71.7 | 0.04 | 22 | 8.96 | 0.04 | 22 | 4.91 | L | 9 |
| LBY407 | 99495.1 | 70.9 | 0.01 | 21 | 8.86 | 0.01 | 21 | 5.11 | L | 14 |
| LBY407 | 99496.3 | 63.7 | 0.08 | 9 | 7.96 | 0.08 | 9 | 4.80 | 0.23 | 7 |
| LBY407 | 99497.2 | 72.1 | 0.02 | 23 | 9.02 | 0.02 | 23 | 4.92 | L | 10 |
| LBY407 | 99497.3 | 70.0 | 0.27 | 20 | 8.76 | 0.27 | 20 | 4.97 | 0.19 | 11 |
| LBY407 | 99499.3 | 64.5 | 0.19 | 10 | 8.06 | 0.19 | 10 | 4.75 | 0.02 | 6 |
| LBY392 | 99491.1 | 68.6 | 0.03 | 17 | 8.57 | 0.03 | 17 | 4.93 | L | 10 |
| LBY392 | 99491.3 | 63.3 | L | 8 | 7.92 | L | 8 | 4.86 | 0.21 | 8 |
| LBY392 | 99493.1 | 61.8 | 0.04 | 6 | 7.72 | 0.04 | 6 | 4.63 | 0.14 | 3 |
| LBY392 | 99494.3 | 71.4 | L | 22 | 8.93 | L | 22 | 5.05 | L | 12 |
| LBY363 | 100323.2 | — | — | — | — | — | — | 4.79 | L | 7 |
| LBY358 | 100252.1 | 63.0 | 0.20 | 8 | 7.87 | 0.20 | 8 | 4.66 | 0.27 | 4 |
| LBY358 | 100254.2 | 73.8 | 0.19 | 26 | 9.22 | 0.19 | 26 | 5.13 | 0.27 | 14 |
| LBY356 | 100016.2 | 67.5 | 0.12 | 15 | 8.44 | 0.12 | 15 | 4.92 | L | 10 |
| LBY356 | 100016.3 | 69.9 | L | 19 | 8.74 | L | 19 | 4.89 | L | 9 |
| LBY356 | 100018.2 | 69.5 | L | 19 | 8.69 | L | 19 | 4.95 | L | 10 |
| LBY356 | 100019.2 | — | — | — | — | — | — | 4.74 | 0.23 | 5 |
| LBY336 | 100495.2 | 65.2 | 0.30 | 11 | 8.15 | 0.30 | 11 | — | — | — |
| LBY336 | 100496.1 | — | — | — | — | — | — | 4.79 | 0.06 | 6 |
| LBY336 | 100496.3 | — | — | — | — | — | — | 4.64 | 0.28 | 3 |
| LBY336 | 100499.1 | — | — | — | — | — | — | 4.67 | 0.20 | 4 |
| LBY335_H3 | 100546.2 | 71.4 | 0.08 | 22 | 8.92 | 0.08 | 22 | 4.88 | 0.12 | 8 |
| LBY335_H3 | 100548.1 | 70.1 | 0.14 | 20 | 8.76 | 0.14 | 20 | 5.02 | 0.04 | 12 |
| LBY335_H3 | 100549.1 | 71.9 | 0.06 | 23 | 8.98 | 0.06 | 23 | 5.01 | 0.04 | 12 |
| LBY335_H3 | 100549.3 | 65.9 | 0.16 | 13 | 8.24 | 0.16 | 13 | 5.00 | L | 11 |
| LBY324 | 100095.2 | 65.6 | 0.05 | 12 | 8.20 | 0.05 | 12 | 4.96 | 0.03 | 10 |
| LBY324 | 100096.2 | 60.1 | 0.19 | 3 | 7.51 | 0.19 | 3 | — | — | — |
| LBY324 | 100099.2 | 72.0 | 0.05 | 23 | 8.99 | 0.05 | 23 | 5.10 | 0.01 | 13 |
| LBY324 | 100099.3 | 68.6 | L | 17 | 8.57 | L | 17 | 4.93 | L | 10 |
| LBY322 | 100556.3 | — | — | — | — | — | — | 4.72 | L | 5 |
| LBY271 | 100236.1 | 69.9 | 0.29 | 19 | 8.74 | 0.29 | 19 | 4.99 | 0.13 | 11 |
| LBY271 | 100236.2 | 63.9 | 0.11 | 9 | 7.99 | 0.11 | 9 | 4.78 | 0.19 | 6 |
| LBY271 | 100237.2 | 68.8 | 0.12 | 17 | 8.60 | 0.12 | 17 | 4.94 | 0.21 | 10 |
| LBY271 | 100237.3 | 77.4 | 0.10 | 32 | 9.67 | 0.10 | 32 | 5.32 | 0.12 | 18 |
| CONT. | — | 58.5 | — | — | 7.32 | — | — | 4.50 | — | — |
| LBY453 | 100511.3 | 83.4 | 0.27 | 12 | 10.4 | 0.27 | 12 | 5.82 | 0.23 | 8 |
| LBY453 | 100513.2 | 84.2 | 0.21 | 13 | 10.5 | 0.21 | 13 | 5.76 | 0.13 | 7 |
| LBY414 | 99965.2 | — | — | — | — | — | — | 5.64 | 0.19 | 5 |
| LBY414 | 99967.3 | 92.3 | 0.14 | 24 | 11.5 | 0.14 | 24 | 5.86 | 0.04 | 9 |
| LBY407 | 99495.1 | — | — | — | — | — | — | 5.73 | 0.17 | 6 |
| LBY407 | 99499.3 | 85.4 | 0.12 | 15 | 10.7 | 0.12 | 15 | 5.81 | 0.05 | 8 |
| LBY392 | 99494.3 | 89.9 | 0.20 | 21 | 11.2 | 0.20 | 21 | — | — | — |
| LBY376 | 99922.1 | 87.5 | 0.21 | 18 | 10.9 | 0.21 | 18 | 5.78 | 0.27 | 7 |
| LBY376 | 99922.2 | 87.1 | 0.06 | 17 | 10.9 | 0.06 | 17 | 5.80 | 0.06 | 8 |
| LBY376 | 99923.1 | 96.0 | L | 29 | 12.0 | L | 29 | 6.24 | L | 16 |
| LBY356 | 100016.3 | 85.8 | 0.08 | 16 | 10.7 | 0.08 | 16 | 5.82 | 0.05 | 8 |
| LBY335_H3 | 100548.1 | — | — | — | — | — | — | 5.66 | 0.22 | 5 |
| LBY324 | 100095.2 | 83.1 | 0.16 | 12 | 10.4 | 0.16 | 12 | 5.74 | 0.08 | 6 |
| LBY324 | 100099.2 | 83.8 | 0.13 | 13 | 10.5 | 0.13 | 13 | 5.96 | 0.02 | 11 |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY324 | 100099.3 | — | — | — | 10.7 | 0.08 | 15 | 6.16 | 0.01 | 14 |
| LBY322 | 100556.3 | 80.8 | 0.27 | 9 | 10.1 | 0.27 | 9 | 5.63 | 0.22 | 4 |
| LBY271 | 100236.2 | 82.8 | 0.18 | 12 | 10.3 | 0.18 | 12 | 5.83 | 0.15 | 8 |
| LBY271 | 100237.3 | 99.5 | L | 34 | 12.4 | L | 34 | 6.38 | L | 18 |
| CONT. | — | 74.2 | — | — | 9.28 | — | — | 5.39 | — | — |
| LBY460 | 100486.2 | — | — | — | — | — | — | 6.66 | 0.25 | 17 |
| LBY458 | 100470.2 | 104.2 | 0.05 | 17 | 13.0 | 0.05 | 17 | 6.58 | 0.16 | 16 |
| LBY458 | 100472.3 | 103.7 | 0.06 | 16 | 13.0 | 0.06 | 16 | 6.30 | 0.01 | 11 |
| LBY458 | 100473.2 | 99.5 | 0.20 | 12 | 12.4 | 0.20 | 12 | — | — | — |
| LBY452 | 100399.2 | — | — | — | — | — | — | 5.95 | 0.24 | 5 |
| LBY447 | 100466.2 | 129.8 | 0.03 | 45 | 16.2 | 0.03 | 45 | 7.33 | 0.01 | 29 |
| LBY447 | 100468.3 | 105.8 | 0.27 | 19 | 13.2 | 0.27 | 19 | 6.45 | L | 14 |
| LBY443 | 100401.1 | 101.5 | 0.05 | 14 | 12.7 | 0.05 | 14 | 6.17 | 0.04 | 9 |
| LBY440 | 100575.3 | 101.2 | 0.05 | 13 | 12.7 | 0.05 | 13 | 6.23 | 0.09 | 10 |
| LBY440 | 100578.2 | — | — | — | — | — | — | 6.22 | 0.23 | 10 |
| LBY440 | 100579.1 | 105.6 | 0.11 | 18 | 13.2 | 0.11 | 18 | 6.27 | 0.11 | 10 |
| LBY433 | 100561.3 | 106.4 | 0.01 | 19 | 13.3 | 0.01 | 19 | 6.20 | 0.02 | 9 |
| LBY426 | 100464.1 | 95.0 | 0.30 | 7 | 11.9 | 0.30 | 7 | 6.00 | 0.26 | 6 |
| LBY402 | 100573.2 | 98.8 | 0.12 | 11 | 12.3 | 0.12 | 11 | 6.25 | 0.02 | 10 |
| LBY402 | 100574.3 | — | — | — | — | — | — | 6.05 | 0.15 | 6 |
| LBY393_H1 | 100539.2 | 98.6 | 0.25 | 11 | 12.3 | 0.25 | 11 | 6.05 | 0.13 | 7 |
| LBY389 | 100551.3 | 96.5 | 0.19 | 8 | 12.1 | 0.19 | 8 | 5.92 | 0.21 | 4 |
| LBY389 | 100552.1 | — | — | — | — | — | — | 5.99 | 0.21 | 5 |
| LBY389 | 100554.3 | 97.3 | 0.15 | 9 | 12.2 | 0.15 | 9 | 6.03 | 0.12 | 6 |
| LBY382 | 100376.2 | 109.9 | 0.07 | 23 | 13.7 | 0.07 | 23 | 6.66 | 0.06 | 17 |
| LBY382 | 100378.2 | 96.6 | 0.21 | 8 | 12.1 | 0.21 | 8 | 6.02 | 0.19 | 6 |
| LBY375 | 100317.3 | — | — | — | — | — | — | 6.00 | 0.14 | 6 |
| LBY375 | 100318.3 | 97.6 | 0.20 | 9 | 12.2 | 0.20 | 9 | 6.05 | 0.24 | 7 |
| LBY359_H13 | 100533.2 | — | — | — | — | — | — | 5.97 | 0.18 | 5 |
| LBY341 | 100380.2 | 99.5 | 0.09 | 12 | 12.4 | 0.09 | 12 | — | — | — |
| LBY323 | 100540.3 | — | — | — | — | — | — | 5.96 | 0.16 | 5 |
| LBY323 | 100541.1 | 109.3 | 0.17 | 23 | 13.7 | 0.17 | 23 | 6.57 | 0.01 | 16 |
| LBY323 | 100544.3 | 100.5 | 0.24 | 13 | 12.6 | 0.24 | 13 | 6.16 | 0.11 | 8 |
| LBY317 | 100056.3 | — | — | — | — | — | — | 6.05 | 0.19 | 7 |
| CONT. | — | 89.2 | — | — | 11.2 | — | — | 5.68 | — | — |
| LBY460 | 100488.3 | 77.8 | 0.25 | 14 | 9.72 | 0.25 | 14 | 5.24 | 0.09 | 9 |
| LBY458 | 100470.2 | 82.8 | 0.01 | 22 | 10.4 | 0.01 | 22 | 5.42 | 0.01 | 13 |
| LBY452 | 100397.2 | 73.8 | 0.07 | 8 | 9.22 | 0.07 | 8 | 4.93 | 0.25 | 3 |
| LBY447 | 100465.3 | 76.2 | 0.16 | 12 | 9.52 | 0.16 | 12 | 5.17 | 0.14 | 7 |
| LBY447 | 100466.2 | 90.6 | L | 33 | 11.3 | L | 33 | 5.68 | L | 18 |
| LBY447 | 100468.1 | — | — | — | — | — | — | 5.14 | 0.18 | 7 |
| LBY445 | 100392.1 | 73.7 | 0.14 | 8 | 9.21 | 0.14 | 8 | 4.99 | 0.19 | 4 |
| LBY445 | 100392.2 | 75.3 | 0.03 | 11 | 9.42 | 0.03 | 11 | 5.14 | 0.02 | 7 |
| LBY443 | 100403.2 | 75.3 | 0.06 | 10 | 9.41 | 0.06 | 10 | 5.09 | 0.02 | 6 |
| LBY440 | 100575.3 | 75.0 | 0.27 | 10 | 9.38 | 0.27 | 10 | 5.09 | 0.02 | 6 |
| LBY440 | 100579.1 | 76.8 | 0.02 | 13 | 9.60 | 0.02 | 13 | 5.09 | 0.13 | 6 |
| LBY433 | 100563.3 | — | — | — | — | — | — | 5.04 | 0.05 | 5 |
| LBY426 | 100464.1 | 85.1 | 0.07 | 25 | 10.6 | 0.07 | 25 | 5.32 | L | 11 |
| LBY426 | 100464.3 | 77.5 | 0.02 | 14 | 9.68 | 0.02 | 14 | 5.25 | 0.20 | 9 |
| LBY402 | 100572.2 | — | — | — | — | — | — | 5.16 | 0.15 | 7 |
| LBY402 | 100573.2 | — | — | — | — | — | — | 5.29 | 0.29 | 10 |
| LBY402 | 100574.2 | — | — | — | — | — | — | 5.09 | 0.30 | 6 |
| LBY393_H1 | 100535.3 | 73.5 | 0.12 | 8 | 9.18 | 0.12 | 8 | 5.07 | 0.25 | 5 |
| LBY389 | 100551.3 | 73.0 | 0.14 | 7 | 9.12 | 0.14 | 7 | 5.08 | 0.14 | 5 |
| LBY382 | 100376.2 | 83.6 | 0.01 | 23 | 10.5 | 0.01 | 23 | 5.53 | L | 15 |
| LBY375 | 100316.2 | 79.3 | 0.09 | 16 | 9.92 | 0.09 | 16 | — | — | — |
| LBY375 | 100317.3 | — | — | — | — | — | — | 5.02 | 0.07 | 4 |
| LBY375 | 100318.3 | 83.6 | 0.25 | 23 | 10.5 | 0.25 | 23 | 5.33 | 0.25 | 11 |
| LBY359_H13 | 100530.2 | 83.0 | 0.29 | 22 | 10.4 | 0.29 | 22 | — | — | — |
| LBY359_H13 | 100531.3 | 86.3 | 0.02 | 27 | 10.8 | 0.02 | 27 | 5.43 | 0.03 | 13 |
| LBY341 | 100380.2 | 86.4 | 0.07 | 27 | 10.8 | 0.07 | 27 | 5.49 | L | 14 |
| LBY323 | 100542.2 | 78.6 | 0.14 | 15 | 9.83 | 0.14 | 15 | 5.29 | 0.13 | 10 |
| LBY323 | 100542.3 | 75.7 | 0.23 | 11 | 9.47 | 0.23 | 11 | — | — | — |
| LBY323 | 100544.3 | 73.0 | 0.18 | 7 | 9.13 | 0.18 | 7 | 5.04 | 0.27 | 5 |
| LBY317 | 100056.3 | 76.5 | 0.02 | 12 | 9.57 | 0.02 | 12 | 5.17 | 0.01 | 7 |
| LBY317 | 100059.3 | 81.8 | L | 20 | 10.2 | L | 20 | 5.29 | L | 10 |
| CONT. | — | 68.1 | — | — | 8.52 | — | — | 4.81 | — | — |
| LBY300 | 99790.3 | 69.3 | 0.01 | 11 | 8.66 | 0.01 | 11 | 4.89 | 0.05 | 4 |
| LBY300 | 99791.3 | 73.3 | L | 17 | 9.17 | L | 17 | 5.04 | 0.09 | 7 |
| LBY287 | 99616.3 | 76.9 | 0.24 | 23 | 9.62 | 0.24 | 23 | 5.23 | 0.15 | 11 |
| LBY287 | 99617.3 | 76.3 | 0.10 | 22 | 9.54 | 0.10 | 22 | 5.38 | L | 15 |

TABLE 305-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY279 | 99951.1 | 68.8 | 0.02 | 10 | 8.60 | 0.02 | 10 | 4.87 | 0.09 | 4 |
| LBY279 | 99951.2 | 72.9 | L | 16 | 9.11 | L | 16 | 4.99 | 0.18 | 6 |
| LBY279 | 99954.1 | 73.5 | L | 17 | 9.18 | L | 17 | 5.17 | 0.08 | 10 |
| LBY261_H1 | 99975.1 | 65.4 | 0.23 | 4 | 8.17 | 0.23 | 4 | — | — | — |
| LBY261_H1 | 99979.2 | 69.0 | 0.06 | 10 | 8.63 | 0.06 | 10 | 5.00 | L | 7 |
| LBY257 | 99988.1 | — | — | — | — | — | — | 4.89 | 0.17 | 4 |
| LBY257 | 99989.3 | 66.5 | 0.10 | 6 | 8.31 | 0.10 | 6 | 4.82 | 0.17 | 3 |
| LBY255 | 100212.2 | 65.7 | 0.17 | 5 | 8.22 | 0.17 | 5 | — | — | — |
| LBY245 | 99804.3 | 65.9 | 0.15 | 5 | 8.24 | 0.15 | 5 | 4.84 | 0.13 | 3 |
| LBY236 | 100134.3 | 73.8 | 0.19 | 18 | 9.23 | 0.19 | 18 | 5.09 | 0.13 | 8 |
| CONT. | — | 62.6 | — | — | 7.83 | — | — | 4.70 | — | — |
| LBY307 | 100176.1 | 78.2 | 0.26 | 4 | 9.77 | 0.26 | 4 | — | — | — |
| LBY307 | 100178.3 | — | — | — | — | — | — | 5.16 | 0.20 | 3 |
| LBY300 | 99790.3 | — | — | — | — | — | — | 5.29 | 0.01 | 5 |
| LBY293_H1 | 99958.3 | 97.4 | 0.19 | 30 | 12.2 | 0.19 | 30 | 5.64 | 0.18 | 12 |
| LBY287 | 99618.2 | 94.9 | L | 27 | 11.9 | L | 27 | 5.62 | 0.07 | 12 |
| LBY261_H1 | 99977.3 | 81.4 | 0.30 | 9 | 10.2 | 0.30 | 9 | 5.28 | 0.02 | 5 |
| LBY261_H1 | 99979.2 | 83.0 | 0.02 | 11 | 10.4 | 0.02 | 11 | 5.36 | L | 6 |
| LBY257 | 99986.3 | 90.3 | 0.13 | 20 | 11.3 | 0.13 | 20 | 5.64 | L | 12 |
| LBY257 | 99987.1 | 79.0 | 0.23 | 5 | 9.87 | 0.23 | 5 | 5.22 | 0.06 | 4 |
| LBY257 | 99988.1 | 81.4 | 0.26 | 9 | 10.2 | 0.26 | 9 | 5.31 | L | 5 |
| LBY245 | 99803.1 | 79.3 | 0.17 | 6 | 9.91 | 0.17 | 6 | 5.19 | 0.09 | 3 |
| LBY245 | 99804.3 | 88.6 | L | 18 | 11.1 | L | 18 | 5.54 | L | 10 |
| LBY236 | 100130.1 | 90.7 | 0.18 | 21 | 11.3 | 0.18 | 21 | 5.59 | 0.25 | 11 |
| LBY236 | 100132.2 | — | — | — | — | — | — | 5.41 | L | 7 |
| LBY236 | 100133.3 | 86.7 | L | 16 | 10.8 | L | 16 | 5.44 | L | 8 |
| LBY236 | 100134.3 | 89.6 | L | 19 | 11.2 | L | 19 | 5.55 | L | 10 |
| CONT. | — | 75.0 | — | — | 9.37 | — | — | 5.03 | — | — |

Table 305.
"CONT."—Control;
"Ave."—Average;
"% Incr." = % increment;
"p-val."—p-value, L - p < 0.01.

TABLE 306

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| MGP36 | 96699.1 | — | — | — | 7.84 | 0.28 | 10 | — | — | — |
| MGP36 | 96699.5 | 0.858 | 0.03 | 17 | — | — | — | — | — | — |
| CONT. | — | 0.736 | — | — | 7.13 | — | — | — | — | — |
| MGP91 | 99108.3 | — | — | — | 11.6 | 0.07 | 29 | 0.554 | 0.18 | 14 |
| MGP82 | 99190.1 | — | — | — | 11.0 | 0.16 | 21 | 0.575 | 0.07 | 18 |
| MGP82 | 99190.3 | — | — | — | 10.5 | 0.27 | 17 | — | — | — |
| MGP82 | 99194.1 | — | — | — | 11.5 | 0.10 | 27 | 0.550 | 0.25 | 13 |
| MGP66 | 99095.1 | — | — | — | 10.9 | 0.16 | 21 | 0.546 | 0.20 | 12 |
| MGP66 | 99098.2 | — | — | — | 12.2 | 0.03 | 35 | 0.550 | 0.18 | 13 |
| MGP62 | 99258.1 | — | — | — | 11.0 | 0.16 | 22 | — | — | — |
| MGP59 | 98102.7 | 0.737 | 0.27 | 18 | 11.0 | 0.15 | 22 | — | — | — |
| MGP53 | 97720.1 | — | — | — | 12.9 | L | 43 | 0.619 | L | 27 |
| MGP52 | 97956.2 | — | — | — | 10.7 | 0.23 | 19 | — | — | — |
| MGP52 | 97960.1 | — | — | — | 11.0 | 0.19 | 22 | 0.558 | 0.24 | 15 |
| MGP52 | 97960.2 | — | — | — | 10.5 | 0.28 | 17 | — | — | — |
| MGP51 | 98786.2 | 0.830 | 0.07 | 33 | — | — | — | — | — | — |
| MGP51 | 98786.3 | 0.789 | 0.13 | 27 | — | — | — | — | — | — |
| MGP49 | 98051.2 | — | — | — | — | — | — | 0.567 | 0.10 | 17 |
| MGP48 | 97796.1 | — | — | — | 10.9 | 0.18 | 20 | 0.541 | 0.25 | 11 |
| MGP48 | 97799.4 | — | — | — | 11.8 | 0.05 | 31 | 0.556 | 0.14 | 14 |
| MGP46 | 97885.3 | — | — | — | — | — | — | 0.541 | 0.25 | 11 |
| MGP32 | 97790.4 | 0.773 | 0.15 | 24 | 12.2 | 0.03 | 35 | 0.570 | 0.09 | 17 |
| CONT. | — | 0.623 | — | — | 9.03 | — | — | 0.486 | — | — |

TABLE 306-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| MGP43 | 96049.1 | 0.865 | 0.15 | 6 | — | — | — | — | — | — |
| CONT. | — | 0.816 | — | — | — | — | — | — | — | — |
| MGP43 | 96048.1 | 0.976 | 0.01 | 11 | — | — | — | — | — | — |
| MGP43 | 96048.3 | 0.970 | 0.10 | 11 | — | — | — | — | — | — |
| MGP43 | 96049.1 | 1.04 | L | 19 | — | — | — | — | — | — |
| CONT. | — | 0.876 | — | — | — | — | — | — | — | — |
| NUE543 | 94149.1 | — | — | — | 8.69 | 0.10 | 13 | — | — | — |
| NUE543 | 94151.1 | 0.901 | 0.28 | 8 | — | — | — | — | — | — |
| NUE543 | 94153.2 | 0.930 | 0.11 | 11 | — | — | — | — | — | — |
| NUE543 | 94153.3 | 0.886 | 0.29 | 6 | — | — | — | — | — | — |
| CONT. | — | 0.834 | — | — | 7.66 | — | — | — | — | — |
| NUE543 | 94149.1 | — | — | — | 7.64 | 0.06 | 16 | 0.462 | L | 7 |
| CONT. | — | — | — | — | 6.60 | — | — | 0.432 | — | — |
| MGP36 | 96696.1 | — | — | — | — | — | — | 0.477 | 0.15 | 3 |
| MGP36 | 96699.2 | — | — | — | — | — | — | 0.499 | 0.21 | 8 |
| MGP36 | 96699.5 | 0.975 | 0.12 | 16 | — | — | — | — | — | — |
| CONT. | — | 0.844 | — | — | — | — | — | 0.461 | — | — |
| MGP92 | 99112.3 | — | — | — | 11.9 | 0.14 | 20 | 0.585 | 0.10 | 20 |
| MGP92 | 99113.3 | 0.814 | 0.26 | 21 | 11.7 | 0.16 | 18 | 0.556 | 0.20 | 14 |
| MGP91 | 99105.2 | — | — | — | 11.4 | 0.25 | 15 | — | — | — |
| MGP91 | 99108.3 | — | — | — | 11.6 | 0.19 | 17 | — | — | — |
| MGP82 | 99191.2 | 0.820 | 0.24 | 22 | 12.0 | 0.10 | 21 | — | — | — |
| MGP67 | 99102.3 | — | — | — | 13.8 | L | 39 | 0.590 | 0.06 | 21 |
| MGP67 | 99103.2 | — | — | — | 13.8 | L | 39 | 0.555 | 0.22 | 14 |
| MGP66 | 99096.2 | — | — | — | 12.2 | 0.08 | 23 | — | — | — |
| MGP59 | 98102.7 | — | — | — | 13.6 | L | 37 | 0.599 | 0.05 | 23 |
| MGP52 | 97956.2 | — | — | — | 12.9 | 0.03 | 30 | 0.561 | 0.19 | 15 |
| MGP52 | 97958.1 | — | — | — | 11.4 | 0.25 | 15 | — | — | — |
| MGP52 | 97960.1 | — | — | — | 13.9 | L | 40 | 0.624 | 0.02 | 28 |
| MGP50 | 98463.3 | — | — | — | 14.1 | L | 42 | 0.611 | 0.03 | 26 |
| MGP48 | 97795.1 | — | — | — | 13.0 | 0.03 | 31 | 0.562 | 0.18 | 15 |
| MGP48 | 97796.1 | — | — | — | 14.0 | L | 41 | 0.565 | 0.18 | 16 |
| MGP48 | 97799.4 | — | — | — | 11.4 | 0.26 | 15 | — | — | — |
| MGP45 | 99014.1 | — | — | — | — | — | — | 0.555 | 0.25 | 14 |
| MGP32 | 97788.3 | — | — | — | 11.4 | 0.25 | 15 | — | — | — |
| CONT. | — | 0.672 | — | — | 9.92 | — | — | 0.486 | — | — |
| LYD999 | 100311.3 | — | — | — | 6.97 | 0.22 | 17 | — | — | — |
| LYD999 | 100312.1 | — | — | — | 6.85 | 0.28 | 15 | 0.416 | 0.12 | 11 |
| LYD999 | 100314.1 | — | — | — | 7.27 | 0.12 | 22 | — | — | — |
| LYD992 | 100364.3 | — | — | — | 6.99 | 0.22 | 17 | 0.406 | 0.24 | 9 |
| LYD983 | 99388.2 | 0.670 | 0.23 | 24 | — | — | — | — | — | — |
| LYD983 | 99388.3 | — | — | — | 6.87 | 0.27 | 15 | — | — | — |
| LYD982 | 99040.2 | — | — | — | 7.82 | 0.05 | 31 | 0.444 | 0.05 | 19 |
| LYD982 | 99041.2 | — | — | — | 7.83 | 0.03 | 31 | 0.428 | 0.05 | 15 |
| LYD982 | 99041.4 | — | — | — | 7.85 | 0.03 | 31 | 0.421 | 0.08 | 13 |
| LYD981 | 99607.3 | — | — | — | 7.18 | 0.15 | 20 | 0.422 | 0.12 | 13 |
| LYD980 | 99786.1 | — | — | — | 7.01 | 0.24 | 17 | — | — | — |
| LYD966 | 100358.2 | — | — | — | 8.66 | L | 45 | 0.444 | 0.02 | 19 |
| LYD966 | 100359.1 | 0.680 | 0.18 | 26 | — | — | — | — | — | — |
| LYD965_H1 | 100229.1 | — | — | — | 7.04 | 0.20 | 18 | — | — | — |
| LYD961 | 99784.3 | — | — | — | 7.50 | 0.07 | 26 | 0.406 | 0.22 | 9 |
| LYD959 | 100308.3 | — | — | — | 7.13 | 0.16 | 19 | 0.425 | 0.07 | 14 |
| CONT. | — | 0.539 | — | — | 5.98 | — | — | 0.374 | — | — |
| LBY305 | 98842.3 | — | — | — | 9.22 | 0.10 | 23 | 0.544 | 0.11 | 15 |
| LBY296 | 98857.3 | — | — | — | 8.86 | 0.16 | 18 | 0.546 | 0.07 | 16 |
| LBY290 | 98925.1 | — | — | — | 8.75 | 0.21 | 17 | 0.517 | 0.27 | 10 |
| LBY289 | 98963.2 | — | — | — | — | — | — | 0.517 | 0.28 | 10 |
| LBY258 | 98955.1 | — | — | — | 8.59 | 0.28 | 15 | 0.522 | 0.22 | 11 |
| LBY258 | 98959.2 | — | — | — | — | — | — | 0.530 | 0.16 | 12 |
| LBY258 | 98959.3 | — | — | — | — | — | — | 0.522 | 0.29 | 11 |
| LBY246 | 98830.1 | — | — | — | 9.16 | 0.11 | 22 | 0.528 | 0.19 | 12 |
| CONT. | — | — | — | — | 7.48 | — | — | 0.472 | — | — |
| NUE543 | 94149.1 | — | — | — | 8.69 | 0.10 | 13 | — | — | — |
| NUE543 | 94151.1 | 0.901 | 0.28 | 8 | — | — | — | — | — | — |
| NUE543 | 94153.2 | 0.930 | 0.11 | 11 | — | — | — | — | — | — |
| NUE543 | 94153.3 | 0.886 | 0.29 | 6 | — | — | — | — | — | — |
| CONT. | — | 0.834 | — | — | 7.66 | — | — | — | — | — |
| LBY457 | 99546.1 | 0.812 | 0.27 | 17 | — | — | — | — | — | — |
| LBY456 | 99525.3 | — | — | — | 13.9 | 0.09 | 20 | 0.611 | 0.07 | 15 |
| LBY456 | 99527.1 | — | — | — | 13.5 | 0.15 | 17 | — | — | — |
| LBY454 | 99516.1 | 0.828 | 0.26 | 19 | — | — | — | — | — | — |

TABLE 306-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY454 | 99517.3 | — | — | — | — | — | — | 0.588 | 0.20 | 10 |
| LBY454 | 99518.1 | — | — | — | 13.0 | 0.27 | 13 | — | — | — |
| LBY454 | 99519.1 | — | — | — | 13.7 | 0.11 | 19 | 0.604 | 0.12 | 13 |
| LBY438 | 99811.1 | 0.817 | 0.25 | 17 | — | — | — | — | — | — |
| LBY438 | 99811.3 | 0.827 | 0.21 | 19 | — | — | — | — | — | — |
| LBY430 | 99762.1 | 0.836 | 0.20 | 20 | — | — | — | — | — | — |
| LBY430 | 99762.3 | 0.847 | 0.15 | 22 | 13.0 | 0.27 | 13 | — | — | — |
| LBY430 | 99763.2 | 0.819 | 0.27 | 18 | — | — | — | — | — | — |
| LBY424 | 99699.3 | — | — | — | 13.3 | 0.19 | 15 | — | — | — |
| LBY419 | 99520.3 | 0.811 | 0.29 | 17 | — | — | — | — | — | — |
| LBY419 | 99522.3 | — | — | — | 13.0 | 0.28 | 13 | 0.593 | 0.17 | 11 |
| LBY419 | 99524.3 | — | — | — | 13.0 | 0.28 | 12 | 0.589 | 0.20 | 11 |
| LBY412 | 99626.3 | 0.882 | 0.09 | 27 | — | — | — | — | — | — |
| LBY412 | 99629.1 | — | — | — | 13.4 | 0.17 | 16 | — | — | — |
| LBY410 | 99693.1 | — | — | — | — | — | — | 0.585 | 0.24 | 10 |
| LBY410 | 99693.3 | — | — | — | 13.7 | 0.12 | 18 | 0.579 | 0.27 | 9 |
| LBY404 | 99686.1 | — | — | — | 13.1 | 0.25 | 13 | — | — | — |
| LBY404 | 99687.1 | — | — | — | — | — | — | 0.598 | 0.14 | 12 |
| LBY401 | 99704.1 | 0.818 | 0.25 | 18 | — | — | — | — | — | — |
| LBY401 | 99704.2 | — | — | — | 13.5 | 0.15 | 17 | — | — | — |
| LBY380 | 99753.1 | 0.838 | 0.18 | 21 | — | — | — | — | — | — |
| LBY357 | 99540.1 | — | — | — | 13.2 | 0.21 | 14 | — | — | — |
| LBY357 | 99542.2 | — | — | — | 14.6 | 0.06 | 26 | 0.602 | 0.17 | 13 |
| LBY355 | 99539.1 | 0.845 | 0.18 | 22 | 12.9 | 0.29 | 12 | 0.594 | 0.15 | 11 |
| LBY312 | 99482.1 | 0.815 | 0.29 | 17 | 13.4 | 0.18 | 16 | — | — | — |
| CONT. | — | 0.696 | — | — | 11.5 | — | — | 0.533 | — | — |
| LBY308 | 98702.2 | 0.864 | 0.15 | 24 | — | — | — | — | — | — |
| LBY278 | 98735.3 | — | — | — | 10.7 | 0.17 | 24 | — | — | — |
| LBY278 | 98736.2 | — | — | — | 10.7 | 0.20 | 23 | — | — | — |
| LBY269 | 98776.4 | 0.804 | 0.30 | 16 | — | — | — | — | — | — |
| LBY259 | 98642.1 | 0.816 | 0.27 | 17 | — | — | — | — | — | — |
| LBY249 | 98668.2 | 0.818 | 0.25 | 18 | — | — | — | — | — | — |
| LBY240 | 98566.1 | 0.873 | 0.14 | 26 | — | — | — | — | — | — |
| CONT. | — | 0.695 | — | — | 8.66 | — | — | — | — | — |
| LYD996 | 99038.2 | — | — | — | — | — | — | 0.442 | 0.22 | 9 |
| LYD993 | 99437.1 | — | — | — | 8.17 | 0.05 | 23 | 0.468 | 0.01 | 15 |
| LYD993 | 99437.3 | — | — | — | 7.84 | 0.08 | 18 | 0.452 | 0.08 | 11 |
| LYD991 | 99557.3 | 0.668 | 0.17 | 23 | 7.67 | 0.19 | 15 | 0.448 | 0.22 | 10 |
| LYD987 | 99173.2 | — | — | — | — | — | — | 0.470 | 0.02 | 15 |
| LYD984 | 99391.1 | — | — | — | 8.26 | 0.03 | 24 | 0.460 | 0.04 | 13 |
| LYD979 | 99165.2 | — | — | — | — | — | — | 0.439 | 0.20 | 8 |
| LYD979 | 99168.1 | — | — | — | 7.37 | 0.28 | 11 | 0.441 | 0.18 | 8 |
| LYD978 | 99550.2 | — | — | — | — | — | — | 0.434 | 0.25 | 6 |
| LYD978 | 99550.3 | — | — | — | — | — | — | 0.457 | 0.05 | 12 |
| LYD971 | 99116.2 | — | — | — | 7.34 | 0.29 | 10 | 0.452 | 0.06 | 11 |
| LYD971 | 99119.3 | 0.650 | 0.23 | 20 | — | — | — | — | — | — |
| LYD969 | 99360.2 | — | — | — | 7.45 | 0.24 | 12 | — | — | — |
| LYD969 | 99361.3 | — | — | — | — | — | — | 0.433 | 0.29 | 6 |
| LYD969 | 99364.1 | — | — | — | 7.39 | 0.27 | 11 | 0.434 | 0.26 | 6 |
| LYD968 | 99127.3 | — | — | — | — | — | — | 0.451 | 0.14 | 11 |
| LYD964 | 99144.3 | — | — | — | — | — | — | 0.447 | 0.11 | 10 |
| LYD963 | 99295.1 | — | — | — | — | — | — | 0.441 | 0.22 | 8 |
| LYD963 | 99299.2 | — | — | — | — | — | — | 0.434 | 0.30 | 7 |
| CONT. | — | 0.541 | — | — | 6.66 | — | — | 0.408 | — | — |
| LBY457 | 99547.2 | — | — | — | 9.80 | 0.04 | 25 | 0.493 | 0.09 | 11 |
| LBY456 | 99525.3 | — | — | — | 10.4 | 0.01 | 33 | 0.481 | 0.16 | 8 |
| LBY456 | 99529.1 | — | — | — | 9.32 | 0.12 | 19 | 0.476 | 0.23 | 7 |
| LBY454 | 99515.1 | 0.755 | 0.25 | 18 | 9.31 | 0.12 | 19 | 0.484 | 0.13 | 9 |
| LBY438 | 99814.3 | 0.749 | 0.28 | 17 | — | — | — | — | — | — |
| LBY430 | 99762.1 | 0.843 | 0.03 | 32 | 12.6 | L | 62 | 0.571 | L | 29 |
| LBY430 | 99763.2 | 0.769 | 0.16 | 21 | — | — | — | — | — | — |
| LBY430 | 99764.1 | 0.762 | 0.18 | 19 | — | — | — | — | — | — |
| LBY424 | 99696.1 | 0.747 | 0.26 | 17 | — | — | — | — | — | — |
| LBY424 | 99696.2 | 0.766 | 0.17 | 20 | 9.98 | 0.03 | 27 | 0.510 | 0.02 | 15 |
| LBY419 | 99522.2 | — | — | — | 9.46 | 0.09 | 21 | — | — | — |
| LBY419 | 99524.3 | — | — | — | 8.98 | 0.21 | 15 | 0.481 | 0.15 | 8 |
| LBY412 | 99625.3 | — | — | — | 9.36 | 0.11 | 20 | 0.484 | 0.15 | 9 |
| LBY412 | 99629.1 | — | — | — | 9.57 | 0.06 | 22 | 0.494 | 0.06 | 11 |
| LBY412 | 99629.2 | 0.831 | 0.03 | 30 | 10.1 | 0.02 | 29 | 0.497 | 0.05 | 12 |
| LBY410 | 99693.1 | 0.919 | L | 44 | 11.1 | L | 42 | 0.515 | 0.01 | 16 |
| LBY410 | 99693.2 | — | — | — | 8.85 | 0.25 | 13 | 0.477 | 0.19 | 8 |

TABLE 306-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY410 | 99694.2 | 0.766 | 0.18 | 20 | 9.04 | 0.20 | 15 | — | — | — |
| LBY406 | 99756.1 | 0.813 | 0.07 | 28 | — | — | — | 0.474 | 0.24 | 7 |
| LBY404 | 99685.3 | 0.853 | 0.02 | 34 | 9.82 | 0.04 | 26 | — | — | — |
| LBY404 | 99686.1 | 0.756 | 0.21 | 19 | 9.97 | 0.05 | 27 | 0.503 | 0.07 | 13 |
| LBY404 | 99686.3 | 0.879 | L | 38 | 11.3 | L | 44 | 0.543 | L | 22 |
| LBY404 | 99687.1 | 0.755 | 0.23 | 18 | — | — | — | — | — | — |
| LBY401 | 99701.1 | — | — | — | 9.97 | 0.03 | 27 | 0.511 | 0.02 | 15 |
| LBY401 | 99704.1 | 0.772 | 0.16 | 21 | 9.32 | 0.13 | 19 | — | — | — |
| LBY401 | 99704.2 | 0.836 | 0.04 | 31 | 9.64 | 0.06 | 23 | 0.494 | 0.09 | 11 |
| LBY357 | 99540.1 | 0.754 | 0.20 | 18 | — | — | — | — | — | — |
| LBY357 | 99543.2 | — | — | — | 9.63 | 0.10 | 23 | — | — | — |
| LBY355 | 99537.1 | 0.766 | 0.19 | 20 | — | — | — | — | — | — |
| LBY318 | 99932.1 | — | — | — | 9.25 | 0.14 | 18 | — | — | — |
| LBY318 | 99932.2 | 0.763 | 0.16 | 20 | 9.48 | 0.09 | 21 | 0.501 | 0.04 | 13 |
| LBY312 | 99482.1 | 0.742 | 0.25 | 16 | — | — | — | — | — | — |
| LBY312 | 99484.1 | 0.754 | 0.22 | 18 | 9.19 | 0.15 | 17 | — | — | — |
| LBY312 | 99484.2 | 0.751 | 0.23 | 18 | 9.20 | 0.15 | 18 | 0.476 | 0.24 | 7 |
| CONT. | — | 0.638 | — | — | 7.83 | — | — | 0.444 | — | — |
| LYD983 | 99386.1 | 0.763 | 0.27 | 23 | — | — | — | — | — | — |
| LYD982 | 99041.3 | — | — | — | 9.62 | 0.28 | 19 | — | — | — |
| LYD980 | 99787.2 | — | — | — | 9.78 | 0.23 | 21 | 0.500 | 0.29 | 13 |
| LYD965_H1 | 100229.1 | 0.775 | 0.26 | 25 | — | — | — | — | — | — |
| CONT. | — | 0.621 | — | — | 8.07 | — | — | 0.443 | — | — |
| LBY461 | 100215.2 | — | — | — | — | — | — | 0.392 | 0.23 | 17 |
| LBY451 | 100171.2 | — | — | — | 7.66 | 0.06 | 28 | 0.401 | 0.09 | 20 |
| LBY451 | 100173.3 | — | — | — | 7.00 | 0.24 | 17 | 0.384 | 0.20 | 15 |
| LBY434 | 99900.2 | — | — | — | 8.52 | L | 42 | 0.420 | 0.04 | 25 |
| LBY434 | 99901.3 | — | — | — | 8.13 | 0.02 | 35 | 0.402 | 0.09 | 20 |
| LBY427 | 100186.1 | — | — | — | 9.60 | L | 60 | 0.428 | 0.03 | 28 |
| LBY423 | 100199.2 | 0.745 | 0.17 | 19 | 7.94 | 0.03 | 32 | 0.399 | 0.11 | 19 |
| LBY421 | 100035.3 | — | — | — | 8.15 | 0.02 | 36 | 0.400 | 0.11 | 19 |
| LBY421 | 100036.2 | — | — | — | 7.62 | 0.11 | 27 | 0.385 | 0.27 | 15 |
| LBY421 | 100038.1 | — | — | — | 7.46 | 0.11 | 24 | 0.380 | 0.27 | 13 |
| LBY421 | 100039.1 | — | — | — | 8.19 | 0.02 | 36 | 0.411 | 0.06 | 23 |
| LBY413 | 100230.2 | — | — | — | 8.63 | L | 44 | 0.411 | 0.08 | 23 |
| LBY413 | 100233.2 | — | — | — | 7.89 | 0.04 | 31 | 0.401 | 0.10 | 20 |
| LBY409 | 99504.1 | — | — | — | 7.68 | 0.06 | 28 | — | — | — |
| LBY409 | 99504.2 | — | — | — | 8.68 | L | 45 | — | — | — |
| LBY388 | 100028.3 | — | — | — | 7.33 | 0.14 | 22 | 0.391 | 0.18 | 17 |
| LBY377 | 99960.2 | — | — | — | — | — | — | 0.377 | 0.29 | 13 |
| LBY377 | 99964.2 | — | — | — | 7.59 | 0.09 | 26 | — | — | — |
| LBY377 | 99964.3 | — | — | — | 6.98 | 0.29 | 16 | — | — | — |
| LBY352 | 100075.1 | — | — | — | 7.47 | 0.11 | 24 | 0.392 | 0.17 | 17 |
| LBY352 | 100075.2 | — | — | — | 8.83 | L | 47 | 0.403 | 0.11 | 20 |
| LBY352 | 100078.2 | — | — | — | 8.14 | 0.02 | 35 | 0.382 | 0.23 | 14 |
| LBY352 | 100079.2 | — | — | — | 9.65 | L | 61 | 0.439 | 0.01 | 31 |
| LBY346 | 100151.2 | — | — | — | 7.61 | 0.10 | 27 | 0.400 | 0.15 | 19 |
| LBY346 | 100153.1 | — | — | — | — | — | — | 0.389 | 0.17 | 16 |
| LBY331 | 100241.1 | — | — | — | 6.99 | 0.24 | 16 | — | — | — |
| LBY331 | 100243.3 | — | — | — | 7.11 | 0.21 | 18 | 0.377 | 0.30 | 13 |
| LBY311 | 100135.3 | — | — | — | 7.76 | 0.06 | 29 | 0.411 | 0.05 | 23 |
| LBY311 | 100136.3 | — | — | — | — | — | — | 0.382 | 0.23 | 14 |
| LBY311 | 100139.3 | — | — | — | 10.4 | L | 72 | 0.448 | L | 34 |
| CONT. | — | 0.626 | — | — | 6.00 | — | — | 0.335 | — | — |
| LBY308 | 98703.2 | — | — | — | — | — | — | 0.497 | 0.29 | 8 |
| LBY303 | 98660.3 | — | — | — | — | — | — | 0.502 | 0.22 | 9 |
| LBY303 | 98663.2 | — | — | — | — | — | — | 0.510 | 0.14 | 10 |
| LBY281 | 98744.1 | — | — | — | — | — | — | 0.497 | 0.29 | 7 |
| LBY278 | 98736.2 | — | — | — | 10.2 | 0.15 | 20 | 0.524 | 0.10 | 13 |
| LBY278 | 98737.2 | — | — | — | 10.0 | 0.21 | 18 | — | — | — |
| LBY269 | 98775.3 | — | — | — | 10.1 | 0.18 | 19 | 0.521 | 0.08 | 13 |
| LBY269 | 98775.5 | — | — | — | 10.1 | 0.19 | 18 | — | — | — |
| LBY269 | 98775.6 | — | — | — | 11.9 | L | 39 | 0.568 | L | 23 |
| LBY259 | 98641.2 | — | — | — | 10.3 | 0.14 | 20 | 0.534 | 0.03 | 16 |
| LBY252 | 98577.4 | — | — | — | — | — | — | 0.497 | 0.29 | 8 |
| LBY249 | 98668.1 | — | — | — | — | — | — | 0.502 | 0.24 | 9 |
| LBY247 | 98630.1 | — | — | — | — | — | — | 0.498 | 0.29 | 8 |
| LBY244 | 98570.1 | — | — | — | — | — | — | 0.510 | 0.17 | 10 |
| LBY244 | 98572.2 | — | — | — | 10.5 | 0.12 | 23 | 0.521 | 0.10 | 13 |
| CONT. | — | — | — | — | 8.53 | — | — | 0.462 | — | — |
| LYD996 | 99037.3 | 0.778 | 0.15 | 25 | — | — | — | — | — | — |

TABLE 306-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD996 | 99039.4 | — | — | — | 13.3 | 0.24 | 16 | — | — | — |
| LYD993 | 99435.3 | — | — | — | 13.3 | 0.23 | 16 | — | — | — |
| LYD993 | 99436.1 | — | — | — | 13.2 | 0.27 | 16 | — | — | — |
| LYD993 | 99436.2 | 0.746 | 0.20 | 20 | — | — | — | — | — | — |
| LYD991 | 99559.3 | — | — | — | 14.0 | 0.12 | 22 | 0.616 | 0.10 | 15 |
| LYD989 | 99175.2 | 0.761 | 0.18 | 23 | 14.2 | 0.09 | 24 | 0.645 | 0.02 | 20 |
| LYD989 | 99179.3 | 0.783 | 0.13 | 26 | — | — | — | — | — | — |
| LYD987 | 99170.2 | 0.776 | 0.15 | 25 | — | — | — | — | — | — |
| LYD987 | 99172.1 | — | — | — | — | — | — | 0.616 | 0.08 | 15 |
| LYD987 | 99173.2 | — | — | — | 13.1 | 0.27 | 15 | — | — | — |
| LYD985 | 99612.2 | 0.775 | 0.15 | 25 | — | — | — | — | — | — |
| LYD984 | 99393.2 | 0.821 | 0.08 | 32 | — | — | — | — | — | — |
| LYD979 | 99167.1 | 0.811 | 0.06 | 31 | — | — | — | — | — | — |
| LYD978 | 99552.2 | — | — | — | 13.9 | 0.12 | 22 | 0.608 | 0.13 | 13 |
| LYD978 | 99554.3 | 0.752 | 0.20 | 21 | — | — | — | — | — | — |
| LYD971 | 99117.1 | 0.983 | L | 58 | 13.4 | 0.25 | 17 | — | — | — |
| LYD971 | 99118.2 | 0.739 | 0.29 | 19 | — | — | — | 0.598 | 0.22 | 11 |
| LYD969 | 99360.2 | 0.769 | 0.14 | 24 | — | — | — | — | — | — |
| LYD969 | 99361.3 | — | — | — | 13.4 | 0.22 | 17 | 0.632 | 0.05 | 18 |
| LYD969 | 99364.1 | 0.744 | 0.24 | 20 | 13.3 | 0.23 | 17 | — | — | — |
| LYD964 | 99143.2 | 0.757 | 0.18 | 22 | — | — | — | — | — | — |
| LYD963 | 99295.1 | 0.761 | 0.18 | 23 | 13.3 | 0.26 | 16 | — | — | — |
| LYD963 | 99298.2 | 0.745 | 0.21 | 20 | 13.2 | 0.27 | 16 | — | — | — |
| LYD962 | 99135.1 | 0.761 | 0.18 | 23 | — | — | — | — | — | — |
| LYD962 | 99135.3 | — | — | — | 13.8 | 0.16 | 21 | 0.602 | 0.21 | 12 |
| LYD962 | 99138.1 | — | — | — | — | — | — | 0.594 | 0.23 | 10 |
| CONT. | — | 0.620 | — | — | 11.4 | — | — | 0.538 | — | — |
| LBY439 | 99927.2 | — | — | — | 9.74 | 0.11 | 23 | 0.489 | 0.25 | 11 |
| LBY439 | 99929.2 | 0.792 | 0.25 | 15 | — | — | — | — | — | — |
| LBY439 | 99929.3 | — | — | — | — | — | — | 0.489 | 0.25 | 12 |
| LBY431 | 99890.2 | — | — | — | 9.13 | 0.28 | 16 | — | — | — |
| LBY431 | 99891.2 | — | — | — | 9.44 | 0.24 | 20 | — | — | — |
| LBY431 | 99893.2 | — | — | — | 9.69 | 0.14 | 23 | — | — | — |
| LBY418 | 99880.3 | — | — | — | 9.36 | 0.22 | 19 | 0.490 | 0.25 | 12 |
| LBY418 | 99881.2 | — | — | — | 10.7 | 0.02 | 35 | 0.520 | 0.07 | 19 |
| LBY418 | 99883.3 | — | — | — | 9.57 | 0.21 | 21 | — | — | — |
| LBY405 | 99946.3 | — | — | — | 9.28 | 0.23 | 18 | — | — | — |
| LBY394 | 99936.3 | — | — | — | 10.3 | 0.05 | 31 | 0.514 | 0.12 | 17 |
| LBY394 | 99937.2 | — | — | — | 9.52 | 0.17 | 21 | — | — | — |
| LBY384 | 100166.2 | 0.779 | 0.29 | 13 | 9.12 | 0.28 | 15 | — | — | — |
| LBY371 | 100180.1 | — | — | — | 9.69 | 0.12 | 23 | 0.515 | 0.09 | 17 |
| LBY369 | 99919.3 | — | — | — | 9.42 | 0.20 | 19 | — | — | — |
| LBY366 | 99860.3 | 0.801 | 0.19 | 16 | — | — | — | — | — | — |
| LBY366 | 99861.1 | — | — | — | 9.63 | 0.13 | 22 | — | — | — |
| LBY362 | 99858.2 | — | — | — | 9.13 | 0.28 | 16 | — | — | — |
| LBY349 | 100127.3 | 0.786 | 0.27 | 14 | — | — | — | — | — | — |
| LBY332 | 99820.1 | — | — | — | 9.35 | 0.20 | 18 | 0.485 | 0.29 | 11 |
| LBY332 | 99823.3 | — | — | — | 9.26 | 0.22 | 17 | — | — | — |
| LBY332 | 99824.2 | — | — | — | 9.23 | 0.26 | 17 | — | — | — |
| LBY332 | 99824.3 | — | — | — | 9.30 | 0.22 | 18 | 0.507 | 0.12 | 16 |
| CONT. | — | 0.690 | — | — | 7.89 | — | — | 0.438 | — | — |
| LYD997 | 99563.1 | — | — | — | 7.54 | 0.19 | 14 | 0.459 | 0.20 | 8 |
| LYD988 | 99048.1 | — | — | — | 7.90 | 0.08 | 20 | 0.481 | 0.04 | 13 |
| LYD988 | 99049.3 | — | — | — | 7.39 | 0.29 | 12 | — | — | — |
| LYD986 | 99021.1 | — | — | — | 7.53 | 0.25 | 14 | 0.472 | 0.12 | 11 |
| LYD986 | 99021.3 | — | — | — | 8.03 | 0.08 | 21 | 0.466 | 0.15 | 10 |
| LYD986 | 99023.2 | — | — | — | 8.33 | 0.02 | 26 | 0.472 | 0.08 | 11 |
| LYD976 | 99161.2 | — | — | — | — | — | — | 0.490 | 0.02 | 16 |
| LYD975 | 99157.1 | — | — | — | 8.50 | 0.01 | 29 | 0.492 | 0.02 | 16 |
| LYD974 | 99058.2 | — | — | — | 8.78 | L | 33 | 0.481 | 0.10 | 13 |
| LYD973 | 99152.1 | — | — | — | — | — | — | 0.463 | 0.16 | 9 |
| LYD972 | 99303.2 | — | — | — | — | — | — | 0.459 | 0.20 | 8 |
| LYD970 | 99381.1 | — | — | — | 7.65 | 0.16 | 16 | — | — | — |
| LYD967 | 99149.1 | — | — | — | 8.41 | 0.02 | 27 | 0.478 | 0.06 | 13 |
| LYD960 | 99635.4 | — | — | — | — | — | — | 0.468 | 0.12 | 10 |
| LYD960 | 99638.3 | — | — | — | — | — | — | 0.464 | 0.16 | 9 |
| LYD958 | 99131.1 | — | — | — | 7.43 | 0.29 | 12 | 0.498 | 0.04 | 17 |
| LYD958 | 99132.1 | — | — | — | 8.27 | 0.02 | 25 | 0.454 | 0.27 | 7 |
| LYD957 | 99018.4 | — | — | — | 7.66 | 0.14 | 16 | 0.465 | 0.15 | 9 |
| LYD957 | 99019.1 | — | — | — | — | — | — | 0.479 | 0.17 | 13 |
| LYD957 | 99019.3 | — | — | — | 8.28 | 0.04 | 25 | 0.488 | 0.05 | 15 |

TABLE 306-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD952 | 98254.2 | 0.654 | 0.25 | 18 | — | — | — | — | — | — |
| LYD952 | 98255.3 | 0.646 | 0.30 | 17 | 7.79 | 0.10 | 18 | 0.470 | 0.10 | 11 |
| LYD949 | 98216.2 | — | — | — | 7.43 | 0.27 | 12 | 0.460 | 0.21 | 8 |
| LYD949 | 98218.2 | — | — | — | 8.18 | 0.04 | 24 | — | — | — |
| LYD941 | 98985.1 | — | — | — | — | — | — | 0.460 | 0.19 | 8 |
| LYD941 | 98988.1 | — | — | — | 8.35 | 0.03 | 26 | 0.501 | L | 18 |
| LYD941 | 98988.3 | — | — | — | 7.63 | 0.16 | 15 | 0.460 | 0.20 | 8 |
| LYD937 | 98270.1 | — | — | — | — | — | — | 0.462 | 0.24 | 9 |
| LYD937 | 98273.3 | — | — | — | — | — | — | 0.454 | 0.28 | 7 |
| CONT. | — | 0.553 | — | — | 6.61 | — | — | 0.424 | — | — |
| NUE543 | 94149.1 | — | — | — | 7.64 | 0.06 | 16 | 0.462 | L | 7 |
| CONT. | — | — | — | — | 6.60 | — | — | 0.432 | — | — |
| LBY304 | 99094.3 | — | — | — | 9.65 | 0.03 | 35 | — | — | — |
| LBY283 | 99060.2 | — | — | — | — | — | — | 0.462 | 0.26 | 12 |
| LBY283 | 99062.2 | — | — | — | 9.16 | 0.07 | 29 | 0.483 | 0.12 | 18 |
| LBY283 | 99063.2 | — | — | — | 8.45 | 0.21 | 19 | — | — | — |
| LBY274 | 99345.2 | — | — | — | 8.58 | 0.17 | 20 | — | — | — |
| LBY262 | 99568.1 | — | — | — | 8.45 | 0.23 | 19 | — | — | — |
| CONT. | — | — | — | — | 7.13 | — | — | 0.410 | — | — |
| LBY310 | 98923.1 | 0.828 | 0.15 | 17 | 9.30 | 0.16 | 23 | — | — | — |
| LBY305 | 98842.1 | — | — | — | 9.96 | 0.06 | 32 | 0.378 | 0.28 | 11 |
| LBY305 | 98843.2 | — | — | — | 9.27 | 0.21 | 23 | — | — | — |
| LBY305 | 98843.4 | 0.809 | 0.20 | 14 | — | — | — | — | — | — |
| LBY302 | 98839.2 | 0.791 | 0.30 | 12 | — | — | — | — | — | — |
| LBY296 | 98857.2 | — | — | — | — | — | — | 0.382 | 0.24 | 13 |
| LBY292 | 98932.2 | 0.797 | 0.28 | 12 | — | — | — | — | — | — |
| LBY270 | 98978.1 | 0.789 | 0.28 | 11 | — | — | — | — | — | — |
| LBY270 | 98978.3 | 0.823 | 0.17 | 16 | 8.99 | 0.25 | 19 | — | — | — |
| LBY270 | 98979.1 | 0.820 | 0.15 | 16 | — | — | — | — | — | — |
| LBY270 | 98979.2 | 0.843 | 0.11 | 19 | — | — | — | — | — | — |
| LBY260 | 98947.2 | 0.811 | 0.24 | 14 | — | — | — | — | — | — |
| LBY258 | 98957.1 | 0.833 | 0.13 | 17 | 8.90 | 0.27 | 18 | — | — | — |
| LBY258 | 98959.3 | — | — | — | — | — | — | 0.381 | 0.28 | 12 |
| LBY246 | 98830.1 | 0.795 | 0.27 | 12 | 9.69 | 0.10 | 28 | — | — | — |
| CONT. | — | 0.709 | — | — | 7.55 | — | — | 0.340 | — | — |
| LYD997 | 99562.2 | — | — | — | — | — | — | 0.626 | 0.07 | 14 |
| LYD997 | 99563.1 | — | — | — | 14.1 | 0.12 | 20 | 0.590 | 0.27 | 8 |
| LYD976 | 99164.3 | — | — | — | 14.3 | 0.11 | 22 | — | — | — |
| LYD975 | 99156.3 | — | — | — | — | — | — | 0.590 | 0.28 | 8 |
| LYD975 | 99156.4 | 0.855 | 0.08 | 22 | 13.4 | 0.29 | 14 | 0.646 | 0.02 | 18 |
| LYD974 | 99058.2 | — | — | — | — | — | — | 0.591 | 0.30 | 8 |
| LYD974 | 99059.1 | — | — | — | 13.5 | 0.24 | 15 | — | — | — |
| LYD972 | 99303.2 | — | — | — | 13.8 | 0.24 | 17 | — | — | — |
| LYD970 | 99381.1 | — | — | — | 14.8 | 0.06 | 25 | 0.603 | 0.14 | 10 |
| LYD970 | 99381.3 | — | — | — | — | — | — | 0.593 | 0.26 | 8 |
| LYD970 | 99384.2 | — | — | — | — | — | — | 0.599 | 0.20 | 10 |
| LYD967 | 99148.3 | — | — | — | — | — | — | 0.599 | 0.19 | 10 |
| LYD960 | 99638.4 | 0.905 | 0.04 | 29 | — | — | — | — | — | — |
| LYD957 | 99019.3 | — | — | — | 14.0 | 0.16 | 19 | 0.673 | L | 23 |
| LYD956 | 99681.2 | 0.796 | 0.27 | 14 | — | — | — | — | — | — |
| LYD949 | 98215.2 | — | — | — | — | — | — | 0.609 | 0.13 | 11 |
| LYD941 | 98988.1 | 0.823 | 0.20 | 18 | — | — | — | — | — | — |
| LYD941 | 98988.2 | — | — | — | 13.7 | 0.23 | 16 | 0.647 | 0.04 | 18 |
| LYD941 | 98989.1 | — | — | — | — | — | — | 0.592 | 0.25 | 8 |
| LYD937 | 98272.2 | — | — | — | 14.1 | 0.14 | 20 | 0.622 | 0.07 | 14 |
| CONT. | — | 0.699 | — | — | 11.8 | — | — | 0.547 | — | — |
| LBY441 | 99819.3 | — | — | — | 12.3 | 0.14 | 20 | 0.591 | 0.11 | 18 |
| LBY439 | 99927.2 | 0.782 | 0.24 | 14 | 11.8 | 0.28 | 15 | — | — | — |
| LBY439 | 99929.3 | 0.869 | 0.04 | 26 | — | — | — | — | — | — |
| LBY431 | 99891.2 | — | — | — | 13.0 | 0.07 | 27 | 0.586 | 0.12 | 17 |
| LBY431 | 99894.2 | 0.773 | 0.28 | 12 | — | — | — | — | — | — |
| LBY418 | 99883.3 | — | — | — | 13.9 | 0.02 | 35 | 0.571 | 0.20 | 14 |
| LBY417 | 99942.2 | 0.827 | 0.09 | 20 | — | — | — | — | — | — |
| LBY417 | 99944.2 | 0.848 | 0.04 | 23 | — | — | — | — | — | — |
| LBY369 | 99915.1 | 0.770 | 0.24 | 12 | — | — | — | — | — | — |
| LBY369 | 99919.3 | — | — | — | 12.3 | 0.15 | 20 | 0.581 | 0.15 | 16 |
| LBY366 | 99861.1 | — | — | — | 11.9 | 0.24 | 16 | 0.558 | 0.30 | 11 |
| LBY366 | 99861.3 | — | — | — | — | — | — | 0.572 | 0.21 | 14 |
| LBY362 | 99856.1 | — | — | — | — | — | — | 0.560 | 0.28 | 12 |
| LBY339 | 100120.3 | 0.794 | 0.17 | 15 | — | — | — | — | — | — |
| LBY339 | 100121.2 | 0.783 | 0.24 | 14 | — | — | — | — | — | — |

TABLE 306-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY319 | 100159.3 | — | — | — | 11.9 | 0.25 | 16 | — | — | — |
| CONT. | — | 0.688 | — | — | 10.3 | — | — | 0.501 | — | — |
| LBY446 | 99971.1 | — | — | — | 8.11 | 0.22 | 25 | — | — | — |
| LBY398 | 100089.2 | 0.794 | 0.23 | 16 | — | — | — | — | — | — |
| LBY398 | 100089.3 | — | — | — | 8.11 | 0.18 | 25 | 0.427 | 0.12 | 25 |
| LBY383 | 100024.1 | — | — | — | 8.12 | 0.18 | 25 | 0.410 | 0.22 | 20 |
| LBY368 | 100105.1 | — | — | — | 7.91 | 0.24 | 22 | — | — | — |
| LBY353 | 100014.1 | — | — | — | 8.23 | 0.18 | 27 | 0.413 | 0.22 | 21 |
| LBY328 | 99980.1 | — | — | — | 8.33 | 0.17 | 29 | 0.415 | 0.25 | 21 |
| LBY327 | 100114.1 | — | — | — | 8.65 | 0.07 | 34 | 0.445 | 0.06 | 30 |
| LBY325 | 100146.3 | — | — | — | 8.25 | 0.16 | 27 | — | — | — |
| CONT. | — | 0.687 | — | — | 6.47 | — | — | 0.343 | — | — |
| LBY304 | 99094.3 | — | — | — | 7.68 | 0.11 | 21 | 0.437 | 0.03 | 16 |
| LBY304 | 99094.4 | — | — | — | 8.76 | 0.02 | 38 | 0.462 | 0.02 | 22 |
| LBY301 | 98980.1 | — | — | — | 7.64 | 0.13 | 20 | 0.443 | 0.03 | 17 |
| LBY301 | 98984.1 | 0.643 | 0.28 | 20 | — | — | — | — | — | — |
| LBY299_H1 | 99809.2 | — | — | — | 7.40 | 0.20 | 16 | 0.440 | 0.03 | 17 |
| LBY298 | 99069.1 | — | — | — | 7.84 | 0.11 | 23 | — | — | — |
| LBY297 | 99775.2 | — | — | — | — | — | — | 0.435 | 0.07 | 15 |
| LBY297 | 99776.2 | — | — | — | 7.57 | 0.17 | 19 | 0.436 | 0.05 | 15 |
| LBY297 | 99776.3 | 0.665 | 0.24 | 24 | 7.54 | 0.16 | 19 | 0.448 | 0.01 | 19 |
| LBY294 | 99770.1 | — | — | — | 7.48 | 0.20 | 18 | 0.440 | 0.07 | 16 |
| LBY294 | 99770.3 | — | — | — | 7.44 | 0.19 | 17 | 0.431 | 0.05 | 14 |
| LBY294 | 99771.3 | — | — | — | 7.78 | 0.10 | 22 | 0.431 | 0.06 | 14 |
| LBY294 | 99772.1 | — | — | — | — | — | — | 0.415 | 0.22 | 10 |
| LBY291 | 99766.3 | — | — | — | — | — | — | 0.435 | 0.09 | 15 |
| LBY291 | 99767.2 | — | — | — | 7.69 | 0.14 | 21 | 0.437 | 0.09 | 16 |
| LBY288 | 99187.2 | — | — | — | 7.27 | 0.27 | 14 | 0.414 | 0.18 | 10 |
| LBY288 | 99188.2 | — | — | — | — | — | — | 0.418 | 0.17 | 11 |
| LBY283 | 99060.2 | — | — | — | 8.03 | 0.06 | 26 | 0.441 | 0.05 | 17 |
| LBY283 | 99062.1 | 0.746 | 0.04 | 40 | 9.29 | L | 46 | 0.480 | L | 27 |
| LBY283 | 99063.2 | — | — | — | 8.28 | 0.04 | 30 | 0.440 | 0.06 | 16 |
| LBY277 | 99121.2 | — | — | — | — | — | — | 0.419 | 0.18 | 11 |
| LBY277 | 99122.3 | — | — | — | — | — | — | 0.409 | 0.24 | 8 |
| LBY277 | 99124.3 | — | — | — | 7.32 | 0.25 | 15 | 0.435 | 0.04 | 15 |
| LBY274 | 99345.2 | — | — | — | 8.03 | 0.05 | 26 | — | — | — |
| LBY274 | 99345.3 | — | — | — | 7.83 | 0.08 | 23 | 0.428 | 0.07 | 13 |
| LBY274 | 99346.1 | — | — | — | 7.35 | 0.23 | 16 | 0.428 | 0.07 | 13 |
| LBY274 | 99346.3 | — | — | — | — | — | — | 0.417 | 0.18 | 10 |
| LBY274 | 99349.1 | 0.669 | 0.19 | 25 | 7.26 | 0.26 | 14 | — | — | — |
| LBY264 | 99508.2 | — | — | — | — | — | — | 0.413 | 0.20 | 9 |
| LBY264 | 99509.2 | — | — | — | 7.35 | 0.25 | 16 | 0.418 | 0.22 | 11 |
| LBY263 | 98972.2 | — | — | — | 7.32 | 0.25 | 15 | 0.413 | 0.18 | 9 |
| LBY263 | 98973.3 | 0.675 | 0.19 | 26 | — | — | — | — | — | — |
| LBY250 | 99052.1 | — | — | — | — | — | — | 0.411 | 0.23 | 9 |
| LBY250 | 99053.3 | — | — | — | — | — | — | 0.415 | 0.24 | 10 |
| LBY242 | 99631.3 | — | — | — | 8.11 | 0.05 | 28 | 0.473 | L | 25 |
| LBY242 | 99634.3 | — | — | — | 7.34 | 0.24 | 15 | 0.409 | 0.25 | 8 |
| CONT. | — | 0.534 | — | — | 6.36 | — | — | 0.378 | — | — |
| LBY451 | 100173.3 | — | — | — | 7.90 | 0.02 | 41 | 0.396 | 0.19 | 19 |
| LBY442 | 100163.1 | 0.694 | 0.29 | 15 | — | — | — | — | — | — |
| LBY427 | 100186.4 | — | — | — | 7.41 | 0.05 | 33 | — | — | — |
| LBY421 | 100039.1 | — | — | — | 7.88 | 0.02 | 41 | 0.411 | 0.12 | 24 |
| LBY413 | 100230.3 | 0.717 | 0.21 | 19 | — | — | — | — | — | — |
| LBY409 | 99504.2 | 0.720 | 0.16 | 19 | — | — | — | — | — | — |
| LBY388 | 100029.3 | — | — | — | 6.65 | 0.25 | 19 | — | — | — |
| LBY377 | 99961.2 | — | — | — | 6.66 | 0.23 | 19 | — | — | — |
| LBY377 | 99964.3 | — | — | — | 7.91 | 0.02 | 41 | — | — | — |
| LBY352 | 100075.2 | — | — | — | 7.11 | 0.15 | 27 | — | — | — |
| LBY352 | 100079.3 | — | — | — | 7.06 | 0.15 | 26 | — | — | — |
| LBY346 | 100150.2 | — | — | — | 7.79 | 0.03 | 39 | 0.405 | 0.19 | 22 |
| LBY311 | 100135.3 | 0.694 | 0.25 | 15 | — | — | — | — | — | — |
| LBY311 | 100139.3 | — | — | — | 6.70 | 0.23 | 20 | — | — | — |
| CONT. | — | 0.603 | — | — | 5.59 | — | — | 0.332 | — | — |
| LGA3 | 96419.2 | 0.624 | 0.18 | 5 | 7.15 | 0.27 | 9 | — | — | — |
| LGA3 | 96419.3 | 0.691 | L | 16 | — | — | — | — | — | — |
| CONT. | — | 0.595 | — | — | 6.58 | — | — | — | — | — |
| LBY446 | 99972.3 | 0.798 | 0.27 | 19 | — | — | — | — | — | — |
| LBY353 | 100014.1 | — | — | — | 10.1 | 0.09 | 39 | 0.477 | 0.19 | 25 |
| LBY327 | 100114.1 | — | — | — | 10.4 | 0.06 | 43 | — | — | — |
| LBY326 | 100101.1 | — | — | — | 9.67 | 0.15 | 33 | — | — | — |

TABLE 306-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY326 | 100102.2 | — | — | — | 9.64 | 0.16 | 32 | 0.457 | 0.29 | 19 |
| LBY325 | 100146.2 | — | — | — | 9.86 | 0.12 | 35 | — | — | — |
| LBY320 | 100141.1 | — | — | — | 9.89 | 0.15 | 36 | — | — | — |
| CONT. | — | 0.669 | — | — | 7.30 | — | — | 0.383 | — | — |
| LGA10 | 96396.5 | 0.803 | 0.08 | 19 | — | — | — | — | — | — |
| LGA10 | 96399.2 | — | — | — | — | — | — | 0.410 | 0.18 | 8 |
| LGA10 | 96401.2 | — | — | — | 7.72 | 0.04 | 22 | 0.472 | 0.04 | 24 |
| CONT. | — | 0.672 | — | — | 6.32 | — | — | 0.381 | — | — |
| LBY453 | 100512.2 | — | — | — | 7.53 | 0.29 | 13 | — | — | — |
| LBY453 | 100512.3 | — | — | — | 7.76 | 0.17 | 16 | — | — | — |
| LBY453 | 100513.1 | — | — | — | 9.23 | L | 38 | 0.401 | 0.04 | 23 |
| LBY428 | 100190.4 | — | — | — | 7.72 | 0.20 | 16 | 0.369 | 0.24 | 13 |
| LBY414 | 99967.3 | — | — | — | 7.54 | 0.27 | 13 | — | — | — |
| LBY414 | 99969.3 | — | — | — | 8.01 | 0.10 | 20 | 0.363 | 0.30 | 12 |
| LBY408 | 99511.2 | — | — | — | 8.88 | 0.01 | 33 | — | — | — |
| LBY408 | 99512.1 | — | — | — | 8.37 | 0.04 | 25 | — | — | — |
| LBY408 | 99513.3 | — | — | — | 8.11 | 0.09 | 21 | — | — | — |
| LBY407 | 99495.1 | — | — | — | 8.19 | 0.07 | 23 | 0.388 | 0.09 | 19 |
| LBY407 | 99496.3 | — | — | — | — | — | — | 0.373 | 0.20 | 14 |
| LBY407 | 99497.2 | — | — | — | 8.23 | 0.07 | 23 | — | — | — |
| LBY407 | 99497.3 | — | — | — | 8.07 | 0.11 | 21 | 0.377 | 0.19 | 16 |
| LBY392 | 99491.1 | — | — | — | 7.74 | 0.19 | 16 | — | — | — |
| LBY392 | 99494.3 | — | — | — | 8.03 | 0.10 | 20 | — | — | — |
| LBY358 | 100252.1 | 0.892 | 0.20 | 19 | — | — | — | — | — | — |
| LBY358 | 100254.2 | — | — | — | 8.29 | 0.05 | 24 | 0.371 | 0.22 | 14 |
| LBY356 | 100016.2 | — | — | — | 7.70 | 0.20 | 15 | 0.368 | 0.23 | 13 |
| LBY356 | 100016.3 | — | — | — | 8.06 | 0.09 | 21 | — | — | — |
| LBY356 | 100018.2 | — | — | — | 8.00 | 0.11 | 20 | — | — | — |
| LBY356 | 100019.1 | — | — | — | 8.05 | 0.12 | 21 | — | — | — |
| LBY336 | 100495.2 | — | — | — | 7.58 | 0.28 | 14 | 0.383 | 0.14 | 18 |
| LBY335_H3 | 100546.2 | 0.878 | 0.21 | 17 | 8.15 | 0.07 | 22 | — | — | — |
| LBY335_H3 | 100548.1 | — | — | — | 8.04 | 0.11 | 20 | 0.376 | 0.18 | 15 |
| LBY335_H3 | 100549.1 | — | — | — | 8.17 | 0.07 | 22 | 0.374 | 0.19 | 15 |
| LBY335_H3 | 100549.3 | — | — | — | 7.58 | 0.26 | 14 | 0.389 | 0.11 | 19 |
| LBY324 | 100095.2 | — | — | — | 7.51 | 0.29 | 13 | 0.381 | 0.14 | 17 |
| LBY324 | 100099.2 | — | — | — | 8.05 | 0.09 | 21 | 0.366 | 0.25 | 12 |
| LBY324 | 100099.3 | — | — | — | 7.77 | 0.17 | 16 | — | — | — |
| LBY271 | 100236.1 | — | — | — | 8.07 | 0.10 | 21 | 0.371 | 0.23 | 14 |
| LBY271 | 100237.2 | — | — | — | 7.96 | 0.12 | 19 | — | — | — |
| LBY271 | 100237.3 | — | — | — | 8.84 | 0.01 | 32 | 0.395 | 0.07 | 21 |
| CONT. | — | 0.751 | — | — | 6.68 | — | — | 0.326 | — | — |
| LBY414 | 99967.3 | — | — | — | 11.1 | 0.15 | 23 | — | — | — |
| LBY408 | 99511.2 | — | — | — | 10.9 | 0.23 | 20 | — | — | — |
| LBY408 | 99512.6 | 0.852 | 0.26 | 17 | — | — | — | — | — | — |
| LBY392 | 99494.3 | — | — | — | 11.1 | 0.16 | 22 | — | — | — |
| LBY376 | 99922.1 | — | — | — | 10.7 | 0.24 | 18 | — | — | — |
| LBY376 | 99923.1 | — | — | — | 11.7 | 0.07 | 29 | 0.542 | 0.10 | 15 |
| LBY356 | 100016.3 | — | — | — | 10.5 | 0.29 | 16 | — | — | — |
| LBY324 | 100099.3 | — | — | — | — | — | — | 0.517 | 0.30 | 9 |
| LBY271 | 100237.3 | — | — | — | 12.0 | 0.05 | 32 | 0.553 | 0.06 | 17 |
| CONT. | — | 0.730 | — | — | 9.06 | — | — | 0.473 | — | — |
| LBY460 | 100485.2 | 0.829 | 0.22 | 17 | — | — | — | — | — | — |
| LBY460 | 100486.2 | — | — | — | — | — | — | 0.568 | 0.07 | 18 |
| LBY458 | 100470.2 | — | — | — | 12.9 | 0.13 | 19 | 0.582 | 0.03 | 21 |
| LBY458 | 100471.3 | 0.831 | 0.21 | 17 | — | — | — | — | — | — |
| LBY458 | 100472.3 | — | — | — | 13.0 | 0.11 | 20 | 0.569 | 0.04 | 18 |
| LBY452 | 100396.1 | 0.810 | 0.30 | 14 | — | — | — | — | — | — |
| LBY447 | 100466.2 | — | — | — | 15.7 | L | 44 | 0.631 | L | 31 |
| LBY447 | 100468.3 | — | — | — | 12.8 | 0.15 | 18 | 0.535 | 0.21 | 11 |
| LBY445 | 100390.1 | 0.814 | 0.30 | 14 | — | — | — | — | — | — |
| LBY445 | 100394.1 | 0.867 | 0.08 | 22 | — | — | — | — | — | — |
| LBY443 | 100401.1 | — | — | — | 12.3 | 0.29 | 13 | 0.527 | 0.27 | 10 |
| LBY440 | 100575.3 | — | — | — | — | — | — | 0.532 | 0.24 | 11 |
| LBY440 | 100578.2 | — | — | — | — | — | — | 0.532 | 0.26 | 10 |
| LBY440 | 100579.1 | — | — | — | 12.9 | 0.12 | 19 | 0.531 | 0.24 | 10 |
| LBY433 | 100561.3 | 0.815 | 0.25 | 15 | 13.0 | 0.11 | 19 | — | — | — |
| LBY402 | 100573.2 | — | — | — | — | — | — | 0.540 | 0.16 | 12 |
| LBY402 | 100574.3 | — | — | — | — | — | — | 0.529 | 0.27 | 10 |
| LBY382 | 100376.2 | — | — | — | 13.5 | 0.05 | 24 | 0.570 | 0.05 | 19 |
| LBY382 | 100378.2 | 0.885 | 0.07 | 24 | — | — | — | — | — | — |
| LBY382 | 100378.3 | 0.853 | 0.14 | 20 | — | — | — | — | — | — |

TABLE 306-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY323 | 100541.1 | — | — | — | 13.2 | 0.09 | 21 | 0.553 | 0.10 | 15 |
| LBY323 | 100544.3 | — | — | — | 12.3 | 0.29 | 13 | — | — | — |
| LBY317 | 100058.2 | 0.860 | 0.14 | 21 | — | — | — | — | — | — |
| CONT. | — | 0.711 | — | — | 10.9 | — | — | 0.481 | — | — |
| LBY460 | 100488.3 | — | — | — | 8.80 | 0.24 | 13 | — | — | — |
| LBY458 | 100470.2 | — | — | — | 9.63 | 0.06 | 24 | 0.412 | 0.06 | 22 |
| LBY452 | 100396.1 | — | — | — | — | — | — | 0.379 | 0.28 | 13 |
| LBY447 | 100465.3 | — | — | — | 8.88 | 0.22 | 14 | 0.387 | 0.19 | 15 |
| LBY447 | 100466.2 | — | — | — | 10.4 | L | 34 | 0.418 | 0.03 | 24 |
| LBY443 | 100400.2 | — | — | — | 8.92 | 0.23 | 15 | — | — | — |
| LBY440 | 100579.1 | — | — | — | 8.75 | 0.27 | 13 | — | — | — |
| LBY426 | 100464.1 | — | — | — | 9.45 | 0.06 | 22 | — | — | — |
| LBY426 | 100464.3 | — | — | — | 8.92 | 0.19 | 15 | 0.402 | 0.09 | 19 |
| LBY402 | 100573.2 | — | — | — | 8.85 | 0.25 | 14 | 0.401 | 0.10 | 19 |
| LBY402 | 100574.2 | — | — | — | — | — | — | 0.383 | 0.23 | 14 |
| LBY389 | 100551.3 | — | — | — | — | — | — | 0.389 | 0.17 | 16 |
| LBY382 | 100376.2 | — | — | — | 9.46 | 0.07 | 22 | 0.402 | 0.08 | 19 |
| LBY375 | 100316.2 | — | — | — | 8.96 | 0.18 | 15 | — | — | — |
| LBY375 | 100317.3 | — | — | — | — | — | — | 0.378 | 0.26 | 12 |
| LBY375 | 100318.3 | — | — | — | 9.69 | 0.06 | 25 | 0.391 | 0.19 | 16 |
| LBY359_H13 | 100530.2 | — | — | — | 9.49 | 0.07 | 22 | 0.378 | 0.29 | 12 |
| LBY359_H13 | 100531.3 | — | — | — | 9.99 | 0.02 | 29 | 0.404 | 0.08 | 20 |
| LBY359_H13 | 100532.2 | — | — | — | 9.06 | 0.20 | 17 | 0.380 | 0.30 | 13 |
| LBY341 | 100380.2 | — | — | — | 9.75 | 0.04 | 26 | 0.384 | 0.21 | 14 |
| LBY323 | 100542.2 | — | — | — | 9.00 | 0.18 | 16 | 0.394 | 0.14 | 17 |
| LBY317 | 100056.3 | — | — | — | 8.81 | 0.23 | 13 | 0.376 | 0.29 | 12 |
| LBY317 | 100059.3 | — | — | — | 9.26 | 0.10 | 19 | 0.377 | 0.27 | 12 |
| CONT. | — | — | — | — | 7.76 | — | — | 0.337 | — | — |
| LBY300 | 99790.3 | 0.817 | 0.12 | 25 | 8.34 | 0.19 | 13 | — | — | — |
| LBY300 | 99791.3 | — | — | — | 8.59 | 0.10 | 17 | — | — | — |
| LBY287 | 99616.3 | — | — | — | 9.04 | 0.04 | 23 | — | — | — |
| LBY287 | 99617.3 | — | — | — | 9.02 | 0.04 | 23 | 0.429 | 0.04 | 18 |
| LBY279 | 99951.1 | — | — | — | 8.17 | 0.28 | 11 | — | — | — |
| LBY279 | 99951.2 | — | — | — | 8.63 | 0.10 | 17 | — | — | — |
| LBY279 | 99954.1 | — | — | — | 8.55 | 0.12 | 16 | 0.402 | 0.21 | 11 |
| LBY261_H1 | 99979.2 | — | — | — | 8.15 | 0.29 | 11 | 0.400 | 0.24 | 10 |
| LBY257 | 99986.3 | — | — | — | 8.65 | 0.11 | 18 | — | — | — |
| LBY257 | 99987.2 | — | — | — | 8.22 | 0.26 | 12 | — | — | — |
| LBY236 | 100134.3 | — | — | — | 8.73 | 0.08 | 19 | — | — | — |
| CONT. | — | 0.653 | — | — | 7.35 | — | — | 0.363 | — | — |
| LBY300 | 99790.3 | — | — | — | — | — | — | 0.377 | 0.18 | 11 |
| LBY293_H1 | 99958.3 | 0.711 | 0.29 | 17 | 10.9 | 0.01 | 32 | 0.380 | 0.18 | 12 |
| LBY287 | 99617.2 | 0.758 | 0.12 | 25 | — | — | — | — | — | — |
| LBY287 | 99617.3 | 0.720 | 0.29 | 19 | — | — | — | — | — | — |
| LBY287 | 99618.2 | — | — | — | 10.5 | 0.02 | 27 | 0.384 | 0.11 | 13 |
| LBY261_H1 | 99979.2 | — | — | — | 9.25 | 0.28 | 12 | 0.378 | 0.16 | 11 |
| LBY257 | 99986.3 | — | — | — | 9.98 | 0.08 | 21 | 0.391 | 0.07 | 15 |
| LBY245 | 99804.3 | — | — | — | 9.52 | 0.17 | 15 | 0.374 | 0.21 | 10 |
| LBY236 | 100130.1 | — | — | — | 10.1 | 0.07 | 22 | 0.389 | 0.10 | 15 |
| LBY236 | 100132.2 | — | — | — | — | — | — | 0.393 | 0.05 | 16 |
| LBY236 | 100133.3 | — | — | — | 9.63 | 0.13 | 17 | — | — | — |
| LBY236 | 100134.3 | — | — | — | 9.77 | 0.10 | 18 | — | — | — |
| CONT. | — | 0.608 | — | — | 8.26 | — | — | 0.340 | — | — |

Table 306.
"CONT."—Control;
"Ave."—Average;
"% Incr." = % increment;
"p-val."—p-value,
L - p < 0.01.
"RGR" = relative growth rate.

Example 31

Evaluation of Transgenic *Arabidopsis* for Seed Yield and Plant Growth Rate Under Normal, Drought and Nitrogen Deficient Conditions in Greenhouse Assays Until Flowering (GH-Flowering Assays)

Each validation trait assay measures the efficacy of specific traits as describe in the Table below. In addition to those traits, the genes of some embodiments of the invention improve yield under various conditions (e.g., normal growth conditions, as well as abiotic stress conditions such as nitrogen deficiency and drought stress).

TABLE 307

Allocation of *Arabidopsis* parameters to specific traits

| # | Parameters | Traits |
|---|---|---|
| 1 | Flowering | Flowering* |
| 2 | Dry weight | Flowering, Plant biomass and Seed yield |
| 3 | Rosette area | Flowering, Plant biomass and Grain filling period |
| 4 | Leaf blade area | Flowering, Plant biomass and Grain filling period |
| 5 | Leaf petiole length | Flowering and Plant biomass |
| 6 | Seed filling period | Grain filling period |
| 7 | Seed yield | Seed Yield and Grain filling period |
| 8 | Harvest Index | Seed Yield and Harvest Index |

Table 307. *The flowering trait refers to early flowering. Some of the parameters are indirect but will affect the trait, for example, "Dry weight" is effected by "flowering" and can also effect "seed yield". Usually, decrease in time to flowering reduces the "dry weight", and on the other hand, a reduce in "dry weight" can effect "seed yield".

Assay 2: Plant Performance Improvement Measured Until Flowering Stage: Plant Biomass and Plant Growth Rate in Greenhouse Conditions (GH-Flowering Assays)

Under normal (standard conditions)—This assay follows the plant biomass formation and the rosette area growth of plants grown in the greenhouse under normal growth conditions. Transgenic *Arabidopsis* seeds were sown in agar media supplemented with 2 Murashige-Skoog medium (MS) medium and and a selection agent (Kanamycin). The $T_2$ transgenic seedlings were then transplanted to 1.7 trays filled with peat and perlite in a 1:2 ratio. Plants were grown under normal conditions which included irrigation of the trays with a solution containing of 6 mM inorganic nitrogen in the form of $KNO_3$ supplemented with 1 mM $KH_2PO_4$, 1 mM $MgSO_4$, 1.5 mM $CaCl_2$ and microelements. Under normal conditions grow in a controlled environment in a closed transgenic greenhouse; temperature was 18-22° C., humidity around 70%; Irrigation was done by flooding with a water solution containing 6 mM N (nitrogen) (as described hereinabove), and flooding was repeated whenever water loss reached 50%. All plants were grown in the greenhouse until flowering stage. Plant biomass (the above ground tissue) was weighted directly after harvesting the rosette (plant fresh weight [FW]). Following plants were dried in an oven at 50° C. for 48 hours and weighted (plant dry weight [DW]).

Under drought and standard growth conditions—This assay follows the plant biomass formation and the rosette area growth of plants grown in the greenhouse under drought conditions and standard growth conditions. Transgenic *Arabidopsis* seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress (drought conditions). All plants were grown in the greenhouse until flowering stage. At harvest, plant biomass (the above ground tissue) was weighted directly after harvesting the rosette (plant fresh weight [FW]). Thereafter, plants were dried in an oven at 50° C. for 48 hours and weighted (plant dry weight [DW]).

Under limited and optimal nitrogen concentration—This assay follows the plant biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 2.8 mM inorganic nitrogen in the form of $KNO_3$, supplemented with 1 mM $KH_2PO_4$, 1 mM $MgSO_4$, 1.5 mM $CaCl_2$ and microelements, while normal nitrogen levels were achieved by applying a solution of 5.5 mM inorganic nitrogen also in the form of $KNO_3$ supplemented with 1 mM $KH_2PO_4$, 1 mM $MgSO_4$, 1.5 mM $CaCl_2$ and microelements. All plants were grown in the greenhouse until flowering stage. Plant biomass (the above ground tissue) was weighted directly after harvesting the rosette (plant fresh weight [FW]). Following, plants were dried in an oven at 50° C. for 48 hours and weighted (plant dry weight [DW]).

Each construct was validated at its $T_2$ generation. Transgenic plants transformed with a construct conformed by an empty vector carrying a promoter and the selectable marker were used as control [The promoters which are described in Example 25 above, e.g., the At6669 promoter (SEQ ID NO: 25) or the 35S promoter (SEQ ID NO: 37)]. Additionally or alternatively, Mock-transgenic plants expressing the uidA reporter gene (GUS-Intron) or with no gene at all, under the same promoter were used as control.

The plants were analyzed for their overall size, growth rate, fresh weight and dry matter. Transgenic plants performance was compared to control plants grown in parallel under the same conditions. The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S.

National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, leaf blade area, petiole relative area and leaf petiole length.

Vegetative growth rate: the relative growth rate (RGR) of leaf blade area (Formula 12), leaf number (Formula 8), rosette area (Formula 9), rosette diameter (Formula 10), plot coverage (Formula 11) and Petiole Relative Area (Formula 25) as described above.

Plant Fresh and Dry weight—On about day 80 from sowing, the plants were harvested and directly weighted for the determination of the plant fresh weight (FW) and left to dry at 50° C. in a drying chamber for about 48 hours before weighting to determine plant dry weight (DW).

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Example 32

Evaluating Transgenic *Arabidopsis* Under Normal and Low Nitrogen Conditions Using Seedling Analyses of T2 and T1 Plants Seedling analysis of plants growth under low and favorable nitrogen concentration levels—Low nitrogen is an abiotic stress that impacts root growth and seedling growth. Therefore, an assay that examines plant performance under low (0.75 mM Nitrogen) and favorable (15 mM Nitrogen) nitrogen concentrations was performed, as follows.

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing/2 MS media (15 mM N) for the normal nitrogen concentration treatment and 0.75 mM nitrogen for the low nitrogen (nitrogen deficiency) concentration treatments. For experiments performed in T2 lines, each plate contained 5 seedlings of the same transgenic event, and 3-4 different plates (replicates) for each event. For each polynucleotide of the invention at least four-five independent transformation events were analyzed from each construct. For experiments performed in T1 lines, each plate contained 5 seedlings of 5 independent transgenic events and 3-4 different plates (replicates) were planted. In total, for T1 lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F).

An image analysis system was used, which consists of a personal desktop computer (Intel P4 3.0 GHz processor) and a public domain program—ImageJ 1.39 (Java based image processing program which is developed at the U.S. National Institutes of Health and freely available on the internet at rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate (RGR) for the various seedling parameters was calculated according to Formulas 13 (RGR leaf area), 6 (RGR root length) and 28 (RGR root coverage) as described above.

At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor, under nitrogen deficiency stress (low nitrogen), as well as under optimal conditions. Similarly, the effect of the gene introduced on biomass accumulation, under nitrogen deficiency stress as well as under optimal conditions was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved tolerance to abiotic stresses or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if $p<0.1$. The JMP statistics software package was used (Version 5.2.1, SAS Institute Inc., Cary, N.C., USA).

Experimental Results

Tables 308-309 summarize the observed phenotypes of transgenic plants exogenously expressing the gene constructs using the seedling assays under non-stress (normal, standard) growth conditions. The genes listed in these Tables show increased biomass (e.g., increased dry weight, fresh weight), photosynthetic area (e.g., increased leaf area), increased root biomass (e.g., root length and root coverage) and increased growth rate (e.g., increased growth rate of leaf area, root coverage and root length) under non-stress growth conditions. The evaluation of each gene was performed by testing the performance of different number of events. Event with p-value <0.1 was considered statistically significant.

TABLE 308

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| MGP54 | 97831.4 | 7.68 | 0.07 | 19 | 126.6 | 0.24 | 14 |
| MGP54 | 97833.1 | 8.70 | 0.06 | 35 | 153.1 | 0.10 | 37 |
| MGP54 | 97834.3 | — | — | — | 130.8 | 0.24 | 17 |
| MGP54 | 97835.3 | 7.52 | 0.25 | 17 | 142.5 | 0.02 | 28 |
| CONT. | — | 6.44 | — | — | 111.5 | — | — |
| NUE510 | 97027.1 | 10.4 | 0.22 | 42 | 227.0 | 0.25 | 60 |
| CONT. | — | 7.37 | — | — | 142.0 | — | — |
| MGP58 | 98249.1 | 9.25 | 0.03 | 16 | 175.2 | 0.08 | 15 |
| MGP58 | 98250.1 | 9.20 | 0.18 | 15 | — | — | — |
| MGP54 | 97833.1 | 9.40 | 0.07 | 18 | 190.0 | 0.08 | 25 |
| MGP54 | 97835.4 | 9.05 | 0.27 | 13 | — | — | — |
| CONT. | — | 7.97 | — | — | 152.2 | — | — |
| NUE510 | 97027.4 | 11.1 | 0.15 | 16 | 198.2 | 0.04 | 18 |
| CONT. | — | 9.49 | — | — | 168.4 | — | — |
| LGA27 | 96394.1 | 12.6 | 0.26 | 41 | — | — | — |
| LGA27 | 96394.4 | — | — | — | 175.6 | 0.24 | 15 |
| CONT. | — | 8.94 | — | — | 152.3 | — | — |
| LGD30 | 96228.1 | 12.5 | 0.06 | 31 | 196.9 | 0.13 | 23 |
| LGD30 | 96233.1 | 11.2 | 0.10 | 18 | 193.8 | 0.04 | 21 |
| LGD30 | 96233.4 | 11.7 | 0.16 | 23 | 195.3 | 0.11 | 22 |
| LGD28 | 96212.3 | 12.5 | 0.28 | 31 | 224.7 | 0.21 | 41 |
| LGD28 | 96212.4 | 11.9 | 0.22 | 25 | 191.6 | 0.24 | 20 |
| LGD28 | 96215.1 | — | — | — | 189.4 | 0.16 | 19 |
| LGD27 | 96223.2 | 12.4 | 0.09 | 30 | 204.4 | 0.10 | 28 |
| LGD27 | 96223.4 | 12.0 | 0.10 | 25 | 203.7 | 0.10 | 28 |
| LGD27 | 96224.3 | 10.7 | 0.26 | 12 | 184.2 | 0.16 | 15 |
| CONT. | — | 9.53 | — | — | 159.6 | — | — |
| MGP79 | 100370.1 | 8.95 | 0.13 | 17 | — | — | — |
| CONT. | — | 7.64 | — | — | — | — | — |
| LYM402 | 63778.2 | 4.62 | 0.22 | 29 | — | — | — |
| LYM402 | 63778.4 | 4.62 | 0.03 | 29 | — | — | — |
| LYM402 | 63780.1 | 6.40 | 0.02 | 79 | 135.3 | 0.29 | 49 |
| CONT. | — | 3.58 | — | — | 90.5 | — | — |
| MGP79 | 100370.1 | 13.7 | 0.05 | 85 | 249.2 | 0.06 | 90 |
| MGP79 | 100370.2 | 10.4 | 0.15 | 41 | 180.9 | 0.14 | 38 |
| MGP79 | 100372.3 | 13.4 | 0.02 | 81 | 231.4 | 0.02 | 77 |
| MGP79 | 100374.3 | 13.0 | L | 75 | 253.6 | L | 94 |
| CONT. | — | 7.42 | — | — | 130.9 | — | — |
| MGP54 | 97833.1 | 8.60 | 0.07 | 15 | 170.3 | L | 35 |
| MGP54 | 97834.3 | — | — | — | 165.9 | 0.23 | 32 |
| CONT. | — | 7.46 | — | — | 126.0 | — | — |
| LGD30 | 96229.2 | 9.40 | 0.14 | 15 | 179.2 | 0.03 | 25 |

TABLE 308-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LGD30 | 96233.1 | — | — | — | 167.3 | 0.05 | 17 |
| LGD30 | 96233.4 | 9.85 | 0.12 | 20 | 162.1 | 0.20 | 13 |
| LGD28 | 96210.4 | 9.45 | 0.09 | 15 | 174.8 | 0.06 | 22 |
| LGD28 | 96215.1 | 9.90 | 0.09 | 21 | 174.2 | 0.09 | 22 |
| LGD27 | 96224.3 | 10.5 | L | 28 | 175.3 | 0.03 | 22 |
| CONT. | — | 8.19 | — | — | 143.2 | — | — |
| MGP44 | 97258.2 | 10.9 | 0.09 | 14 | 176.1 | 0.10 | 19 |
| MGP44 | 97258.5 | — | — | — | 168.5 | 0.19 | 14 |
| CONT. | — | 9.64 | — | — | 147.4 | — | — |
| MGP58 | 98249.1 | 9.55 | 0.07 | 22 | 179.8 | 0.25 | 30 |
| MGP58 | 98250.1 | 9.00 | 0.05 | 15 | — | — | — |
| MGP54 | 97833.1 | 10.4 | 0.28 | 33 | 191.9 | 0.26 | 39 |
| MGP54 | 97835.3 | 9.72 | 0.10 | 25 | 167.9 | 0.22 | 21 |
| CONT. | — | 7.80 | — | — | 138.2 | — | — |
| MGP44 | 97254.1 | 8.82 | 0.07 | 28 | 148.9 | 0.18 | 17 |
| MGP44 | 97257.1 | 7.85 | 0.10 | 14 | — | — | — |
| MGP44 | 97258.2 | 8.55 | 0.03 | 24 | — | — | — |
| CONT. | — | 6.89 | — | — | 127.6 | — | — |
| LBY449 | 100909.2 | 10.2 | L | 45 | 157.5 | 0.29 | 25 |
| LBY449 | 100909.3 | 9.83 | 0.11 | 39 | 242.6 | 0.08 | 92 |
| LBY385 | 100641.3 | 10.0 | 0.05 | 42 | 183.3 | 0.05 | 45 |
| LBY385 | 100643.2 | 10.6 | 0.07 | 50 | 191.6 | 0.02 | 52 |
| LBY385 | 100644.1 | 8.43 | 0.03 | 19 | — | — | — |
| LBY373 | 100565.3 | — | — | — | 156.0 | 0.28 | 23 |
| LBY373 | 100568.3 | 11.4 | 0.26 | 61 | 225.9 | L | 79 |
| LBY348 | 100841.3 | 10.7 | 0.15 | 51 | 172.9 | 0.28 | 37 |
| LBY348 | 100842.3 | 8.68 | 0.04 | 23 | — | — | — |
| LBY348 | 100843.3 | 8.62 | 0.14 | 22 | — | — | — |
| CONT. | — | 7.06 | — | — | 126.3 | — | — |
| LBY449 | 100905.2 | 7.97 | 0.17 | 22 | 166.4 | L | 58 |
| LBY449 | 100909.3 | — | — | — | 141.0 | 0.25 | 34 |
| LBY385 | 100640.2 | 7.60 | 0.26 | 16 | 148.4 | 0.06 | 41 |
| LBY385 | 100641.2 | 9.40 | 0.14 | 44 | 196.2 | 0.08 | 86 |
| LBY385 | 100641.3 | 11.2 | 0.04 | 71 | 219.8 | 0.03 | 108 |
| LBY385 | 100643.2 | 10.3 | 0.07 | 57 | 208.7 | 0.02 | 98 |
| LBY385 | 100644.1 | 8.15 | 0.16 | 24 | 159.5 | 0.05 | 51 |
| LBY373 | 100565.3 | — | — | — | 132.3 | 0.26 | 25 |
| LBY373 | 100567.2 | — | — | — | 142.0 | 0.09 | 35 |
| LBY373 | 100567.3 | — | — | — | 140.7 | 0.22 | 33 |
| LBY373 | 100569.1 | 8.07 | 0.26 | 23 | 153.0 | 0.05 | 45 |
| LBY348 | 100840.1 | 8.33 | 0.10 | 27 | 162.6 | 0.09 | 54 |
| LBY348 | 100841.3 | 8.18 | 0.10 | 25 | 163.3 | L | 55 |
| LBY348 | 100843.3 | 8.47 | 0.14 | 29 | 152.3 | 0.06 | 44 |
| CONT. | — | 6.55 | — | — | 105.6 | — | — |

Table 308.
"CONT." = Control;
"Ave." = Average;
"% Incr." = % increment;
"p-val." = p-value,
L = p < 0.01.

TABLE 309

Genes showing improved plant performance at Normal growth conditions under regulation of At6669 promoter

| Gene Name | Event # | Leaf Area [$cm^2$] | | | Roots Coverage [$cm^2$] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| MGP54 | 97831.4 | 0.930 | L | 35 | 10.2 | 0.25 | 11 | — | — | — |
| MGP54 | 97833.1 | 0.963 | L | 39 | — | — | — | — | — | — |
| MGP54 | 97835.3 | 0.853 | 0.03 | 23 | 11.0 | 0.11 | 21 | 8.19 | 0.05 | 6 |
| CONT. | — | 0.691 | — | — | 9.16 | — | — | 7.74 | — | — |
| NUE510 | 97026.1 | — | — | — | — | — | — | 7.44 | L | 10 |
| NUE510 | 97026.4 | — | — | — | 10.6 | 0.05 | 23 | 7.22 | 0.06 | 7 |
| NUE510 | 97027.1 | 0.770 | 0.11 | 24 | 10.1 | 0.18 | 17 | 7.37 | 0.03 | 9 |

TABLE 309-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| NUE510 | 97027.4 | — | — | — | 9.60 | 0.09 | 12 | 7.42 | L | 10 |
| CONT. | — | 0.622 | — | — | 8.60 | — | — | 6.76 | — | — |
| MGP58 | 98249.1 | 0.851 | L | 26 | 10.3 | L | 19 | — | — | — |
| MGP58 | 98250.1 | 0.836 | 0.02 | 24 | — | — | — | — | — | — |
| MGP58 | 98250.3 | 0.777 | L | 15 | 9.33 | 0.20 | 8 | — | — | — |
| MGP54 | 97831.1 | 0.749 | 0.14 | 11 | — | — | — | 7.55 | 0.01 | 7 |
| MGP54 | 97833.1 | 0.857 | L | 27 | 10.5 | 0.05 | 22 | 7.56 | 0.06 | 7 |
| MGP54 | 97835.2 | 0.706 | 0.29 | 5 | 9.68 | 0.16 | 12 | — | — | — |
| MGP54 | 97835.3 | — | — | — | — | — | — | 7.26 | 0.11 | 3 |
| MGP54 | 97835.4 | 0.744 | 0.18 | 10 | — | — | — | — | — | — |
| CONT. | — | 0.675 | — | — | 8.62 | — | — | 7.04 | — | — |
| LGA27 | 96391.3 | — | — | — | — | — | — | 8.02 | L | 6 |
| LGA27 | 96394.1 | 1.06 | 0.24 | 24 | — | — | — | — | — | — |
| LGA27 | 96394.4 | 0.977 | 0.02 | 15 | 13.2 | 0.27 | 12 | 7.95 | L | 5 |
| CONT. | — | 0.852 | — | — | 11.8 | — | — | 7.56 | — | — |
| NUE543 | 10051.6 | 0.530 | 0.03 | 22 | — | — | — | — | — | — |
| NUE543 | 10052.3 | 0.556 | 0.20 | 28 | 4.37 | 0.05 | 42 | 4.80 | L | 26 |
| CONT. | — | 0.433 | — | — | 3.07 | — | — | 3.80 | — | — |
| LGD30 | 96228.1 | 1.08 | 0.02 | 25 | 15.0 | 0.02 | 29 | 7.70 | 0.26 | 5 |
| LGD30 | 96229.1 | — | — | — | 13.0 | 0.10 | 12 | 8.05 | 0.05 | 9 |
| LGD30 | 96233.1 | 0.935 | 0.14 | 8 | 16.0 | 0.05 | 37 | — | — | — |
| LGD30 | 96233.4 | 1.07 | 0.07 | 23 | 15.9 | 0.05 | 37 | — | — | — |
| LGD28 | 96212.3 | 1.10 | 0.16 | 27 | 15.1 | 0.13 | 30 | 7.80 | 0.28 | 6 |
| LGD28 | 96212.4 | 1.07 | 0.02 | 23 | 14.5 | 0.14 | 25 | 7.99 | 0.11 | 9 |
| LGD28 | 96215.1 | 1.04 | 0.17 | 19 | — | — | — | — | — | — |
| LGD28 | 96215.2 | 0.983 | 0.25 | 13 | 14.8 | 0.16 | 27 | 7.82 | 0.21 | 6 |
| LGD27 | 96223.2 | 1.04 | 0.09 | 19 | 15.3 | 0.02 | 31 | 7.95 | 0.08 | 8 |
| LGD27 | 96223.4 | 1.07 | 0.01 | 24 | 17.9 | L | 54 | 8.11 | 0.04 | 10 |
| LGD27 | 96224.3 | 0.961 | 0.25 | 11 | 12.7 | 0.26 | 10 | — | — | — |
| CONT. | — | 0.869 | — | — | 11.6 | — | — | 7.35 | — | — |
| MGP79 | 100370.1 | 0.798 | 0.10 | 15 | 10.4 | 0.03 | 32 | — | — | — |
| MGP79 | 100370.2 | — | — | — | 9.63 | 0.23 | 22 | — | — | — |
| MGP79 | 100374.3 | 0.747 | 0.19 | 7 | 9.04 | 0.24 | 15 | 7.69 | 0.03 | 12 |
| CONT. | — | 0.697 | — | — | 7.87 | — | — | 6.90 | — | — |
| LYM402 | 63778.2 | 0.514 | 0.26 | 14 | 6.86 | 0.24 | 6 | — | — | — |
| LYM402 | 63778.4 | 0.544 | 0.07 | 21 | 7.35 | 0.08 | 14 | 7.54 | 0.08 | 9 |
| LYM402 | 63780.1 | 0.661 | 0.19 | 47 | — | — | — | — | — | — |
| CONT. | — | 0.450 | — | — | 6.45 | — | — | 6.91 | — | — |
| MGP79 | 100370.1 | 1.21 | L | 48 | 12.8 | 0.13 | 42 | — | — | — |
| MGP79 | 100370.2 | 1.07 | 0.08 | 32 | 11.3 | 0.18 | 25 | 7.76 | 0.03 | 8 |
| MGP79 | 100372.3 | 1.11 | L | 36 | 12.9 | 0.03 | 43 | 7.58 | 0.18 | 5 |
| MGP79 | 100374.3 | 1.16 | L | 43 | 14.0 | L | 55 | 8.17 | L | 14 |
| CONT. | — | 0.815 | — | — | 9.00 | — | — | 7.19 | — | — |
| MGP54 | 97831.4 | — | — | — | — | — | — | 7.58 | 0.13 | 7 |
| MGP54 | 97833.1 | 0.861 | 0.09 | 15 | — | — | — | 7.82 | 0.01 | 10 |
| MGP54 | 97834.3 | — | — | — | 9.86 | 0.19 | 20 | 7.73 | 0.05 | 9 |
| MGP54 | 97835.3 | — | — | — | — | — | — | 7.57 | 0.30 | 6 |
| CONT. | — | 0.746 | — | — | 8.23 | — | — | 7.11 | — | — |
| LGA27 | 96394.1 | — | — | — | 12.6 | 0.22 | 18 | 7.88 | 0.01 | 7 |
| CONT. | — | — | — | — | 10.7 | — | — | 7.35 | — | — |
| LGD30 | 96229.1 | — | — | — | — | — | — | 7.95 | 0.09 | 6 |
| LGD30 | 96229.2 | 0.747 | 0.11 | 10 | — | — | — | — | — | — |
| LGD30 | 96233.1 | — | — | — | — | — | — | 7.92 | 0.10 | 6 |
| LGD30 | 96233.4 | — | — | — | 13.0 | 0.26 | 23 | — | — | — |
| LGD28 | 96210.4 | 0.786 | 0.02 | 15 | — | — | — | — | — | — |
| LGD28 | 96215.1 | 0.776 | 0.10 | 14 | — | — | — | 7.81 | 0.18 | 4 |
| LGD28 | 96215.2 | 0.781 | 0.14 | 15 | — | — | — | — | — | — |
| LGD27 | 96223.2 | 0.767 | 0.25 | 13 | — | — | — | — | — | — |
| LGD27 | 96224.3 | 0.722 | 0.26 | 6 | — | — | — | — | — | — |
| CONT. | — | 0.681 | — | — | 10.6 | — | — | 7.49 | — | — |
| LYM402 | 63780.1 | — | — | — | — | — | — | 6.76 | 0.29 | 7 |
| CONT. | — | — | — | — | — | — | — | 6.31 | — | — |
| MGP44 | 97258.2 | 0.826 | 0.28 | 10 | — | — | — | — | — | — |
| MGP44 | 97258.3 | — | — | — | 16.9 | 0.28 | 15 | 8.25 | 0.25 | 7 |
| CONT. | — | 0.750 | — | — | 14.7 | — | — | 7.68 | — | — |
| MGP58 | 98249.1 | 1.01 | 0.11 | 21 | 10.8 | 0.28 | 12 | 7.52 | 0.12 | 5 |
| MGP58 | 98250.1 | 0.921 | 0.08 | 11 | — | — | — | — | — | — |
| MGP58 | 98250.3 | — | — | — | 11.1 | 0.12 | 15 | 7.59 | 0.09 | 6 |
| MGP58 | 98250.4 | — | — | — | 10.9 | 0.03 | 13 | 7.56 | 0.10 | 6 |
| MGP58 | 98252.2 | — | — | — | — | — | — | 7.39 | 0.24 | 4 |
| MGP54 | 97833.1 | 1.16 | 0.16 | 39 | — | — | — | — | — | — |

TABLE 309-continued

Genes showing improved plant performance at Normal growth
conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| MGP54 | 97835.2 | — | — | — | — | — | — | 7.56 | 0.05 | 6 |
| MGP54 | 97835.3 | 0.909 | 0.28 | 9 | 11.1 | 0.22 | 15 | 7.61 | 0.07 | 7 |
| MGP54 | 97835.4 | — | — | — | — | — | — | 7.57 | 0.27 | 6 |
| CONT. | — | 0.832 | — | — | 9.66 | — | — | 7.14 | — | — |
| MGP44 | 97254.1 | 0.683 | 0.19 | 13 | 12.5 | 0.02 | 29 | — | — | — |
| MGP44 | 97257.1 | — | — | — | 11.6 | 0.04 | 19 | 7.84 | 0.07 | 4 |
| MGP44 | 97258.2 | 0.669 | 0.15 | 11 | 12.0 | 0.06 | 24 | — | — | — |
| MGP44 | 97258.3 | — | — | — | 11.4 | 0.06 | 18 | 8.04 | 0.01 | 7 |
| MGP44 | 97258.5 | — | — | — | 10.5 | 0.28 | 9 | 7.85 | 0.19 | 4 |
| CONT. | — | 0.602 | — | — | 9.67 | — | — | 7.53 | — | — |
| LBY449 | 100909.2 | 0.751 | 0.01 | 34 | 9.32 | 0.03 | 23 | — | — | — |
| LBY449 | 100909.3 | — | — | — | 9.71 | 0.29 | 28 | — | — | — |
| LBY385 | 100641.2 | — | — | — | — | — | — | 7.52 | 0.09 | 5 |
| LBY385 | 100641.3 | 0.709 | L | 27 | — | — | — | — | — | — |
| LBY385 | 100643.2 | 0.698 | 0.11 | 25 | 9.62 | 0.08 | 27 | 7.65 | 0.07 | 7 |
| LBY373 | 100568.3 | 0.701 | 0.11 | 25 | — | — | — | — | — | — |
| LBY373 | 100569.1 | — | — | — | — | — | — | 7.65 | 0.06 | 7 |
| LBY348 | 100840.1 | — | — | — | — | — | — | 7.48 | 0.26 | 5 |
| LBY348 | 100841.3 | 0.698 | 0.19 | 25 | 10.5 | 0.11 | 38 | 7.84 | 0.01 | 10 |
| LBY348 | 100842.3 | 0.675 | 0.02 | 21 | 8.87 | 0.07 | 17 | — | — | — |
| LBY348 | 100843.3 | 0.672 | 0.27 | 20 | 9.02 | 0.11 | 19 | 7.39 | 0.28 | 4 |
| CONT. | — | 0.559 | — | — | 7.59 | — | — | 7.14 | — | — |
| LBY444 | 99907.2 | 0.749 | 0.23 | 15 | — | — | — | — | — | — |
| LBY385 | 100641.3 | 0.961 | 0.03 | 47 | 11.7 | 0.12 | 33 | — | — | — |
| LBY385 | 100643.2 | 0.851 | 0.08 | 30 | 10.7 | 0.12 | 21 | — | — | — |
| LBY385 | 100644.1 | 0.831 | 0.05 | 27 | — | — | — | — | — | — |
| LBY373 | 100565.3 | 0.843 | 0.02 | 29 | 10.2 | 0.23 | 16 | 7.84 | 0.09 | 7 |
| LBY373 | 100567.2 | — | — | — | 10.4 | 0.22 | 19 | — | — | — |
| LBY373 | 100567.3 | 0.782 | 0.21 | 20 | — | — | — | — | — | — |
| LBY348 | 100840.1 | 0.792 | 0.08 | 21 | 11.4 | 0.04 | 30 | 7.97 | 0.01 | 8 |
| LBY348 | 100841.3 | 0.802 | 0.06 | 23 | 10.2 | 0.28 | 16 | — | — | — |
| LBY348 | 100843.2 | — | — | — | — | — | — | 7.60 | 0.29 | 3 |
| LBY348 | 100843.3 | 0.816 | 0.05 | 25 | 10.6 | 0.20 | 21 | 7.80 | 0.10 | 6 |
| CONT. | — | 0.654 | — | — | 8.79 | — | — | 7.35 | — | — |

Table 309.
"CONT." = Control;
"Ave." = Average;
"% Incr." = % increment;
"p-val." = p- value,
L = p < 0.01.

TABLE 310

Genes showing improved plant performance at Normal growth conditions
under regulation of At6669 promoter

| Gene Name | Event # | RGR Of Leaf Area Ave. | P-Val. | % Incr. | RGR Of Roots Coverage Ave. | P-Val. | % Incr. | RGR Of Root Length Ave. | P-Val. | % Incr. |
|---|---|---|---|---|---|---|---|---|---|---|
| NUE510 | 97026.1 | — | — | — | — | — | — | 0.758 | L | 12 |
| NUE510 | 97026.4 | — | — | — | 1.47 | 0.05 | 26 | 0.724 | 0.02 | 7 |
| NUE510 | 97027.1 | 0.0869 | 0.18 | 22 | 1.36 | 0.22 | 16 | 0.716 | 0.07 | 5 |
| NUE510 | 97027.4 | — | — | — | 1.27 | 0.20 | 9 | — | — | — |
| CONT. | — | 0.0714 | — | — | 1.17 | — | — | 0.680 | — | — |
| LGA27 | 96391.3 | 0.0949 | 0.21 | 8 | — | — | — | 0.739 | L | 10 |
| LGA27 | 96392.2 | — | — | — | — | — | — | 0.727 | 0.01 | 9 |
| LGA27 | 96394.1 | 0.113 | 0.21 | 28 | — | — | — | 0.690 | 0.12 | 3 |
| LGA27 | 96394.4 | 0.102 | 0.04 | 16 | 1.58 | 0.28 | 13 | — | — | — |
| CONT. | — | 0.0882 | — | — | 1.40 | — | — | 0.669 | — | — |
| NUE543 | 10051.6 | 0.0576 | 0.02 | 34 | — | — | — | — | — | — |
| NUE543 | 10052.3 | 0.0601 | 0.03 | 40 | 0.505 | L | 45 | 0.420 | 0.14 | 17 |
| CONT. | — | 0.0430 | — | — | 0.349 | — | — | 0.360 | — | — |
| LGD30 | 96228.1 | 0.111 | 0.02 | 27 | 1.79 | 0.03 | 30 | — | — | — |
| LGD30 | 96233.1 | 0.0994 | 0.19 | 14 | 1.91 | 0.02 | 39 | — | — | — |
| LGD30 | 96233.4 | 0.110 | 0.04 | 26 | 1.90 | 0.01 | 38 | — | — | — |

TABLE 310-continued

Genes showing improved plant performance at Normal growth conditions under regulation of At6669 promoter

| Gene Name | Event # | RGR Of Leaf Area Ave. | P-Val. | % Incr. | RGR Of Roots Coverage Ave. | P-Val. | % Incr. | RGR Of Root Length Ave. | P-Val. | % Incr. |
|---|---|---|---|---|---|---|---|---|---|---|
| LGD28 | 96212.3 | 0.110 | 0.09 | 26 | 1.79 | 0.07 | 30 | — | — | — |
| LGD28 | 96212.4 | 0.109 | 0.03 | 26 | 1.72 | 0.11 | 25 | — | — | — |
| LGD28 | 96215.1 | 0.107 | 0.08 | 23 | — | — | — | — | — | — |
| LGD28 | 96215.2 | 0.0993 | 0.23 | 14 | 1.77 | 0.08 | 28 | — | — | — |
| LGD27 | 96223.2 | 0.106 | 0.06 | 22 | 1.84 | 0.02 | 34 | 0.738 | 0.14 | 15 |
| LGD27 | 96223.4 | 0.112 | L | 29 | 2.14 | L | 55 | — | — | — |
| LGD27 | 96224.1 | 0.100 | 0.24 | 15 | — | — | — | — | — | — |
| CONT. | — | 0.0869 | — | — | 1.38 | — | — | 0.642 | — | — |
| LYM402 | 63778.2 | 0.0500 | 0.23 | 14 | — | — | — | — | — | — |
| LYM402 | 63778.4 | 0.0508 | 0.17 | 16 | 0.864 | 0.06 | 13 | 0.641 | 0.13 | 10 |
| LYM402 | 63780.1 | 0.0610 | 0.03 | 39 | — | — | — | — | — | — |
| CONT. | — | 0.0437 | — | — | 0.766 | — | — | 0.583 | — | — |
| LGA27 | 96394.1 | — | — | — | 1.54 | 0.21 | 18 | 0.760 | 0.06 | 5 |
| LGA27 | 96394.2 | — | — | — | — | — | — | 0.765 | 0.20 | 6 |
| LGA27 | 96394.4 | 0.0855 | 0.28 | 9 | — | — | — | — | — | — |
| CONT. | — | 0.0786 | — | — | 1.30 | — | — | 0.723 | — | — |
| LGD30 | 96229.1 | — | — | — | — | — | — | 0.780 | 0.23 | 8 |
| LGD30 | 96229.2 | 0.0821 | 0.25 | 13 | — | — | — | — | — | — |
| LGD30 | 96233.1 | — | — | — | — | — | — | 0.782 | 0.18 | 9 |
| LGD30 | 96233.4 | — | — | — | 1.59 | 0.15 | 23 | — | — | — |
| LGD28 | 96210.4 | 0.0817 | 0.27 | 13 | — | — | — | — | — | — |
| LGD28 | 96215.1 | 0.0838 | 0.20 | 16 | — | — | — | 0.769 | 0.27 | 7 |
| LGD28 | 96215.2 | 0.0846 | 0.21 | 17 | — | — | — | — | — | — |
| CONT. | — | 0.0726 | — | — | 1.29 | — | — | 0.719 | — | — |
| LYM402 | 63780.1 | — | — | — | — | — | — | 0.640 | 0.10 | 16 |
| CONT. | — | — | — | — | — | — | — | 0.550 | — | — |
| MGP44 | 97258.2 | 0.0888 | 0.29 | 15 | — | — | — | — | — | — |
| MGP44 | 97258.3 | — | — | — | — | — | — | 0.688 | 0.23 | 11 |
| CONT. | — | 0.0772 | — | — | — | — | — | 0.621 | — | — |
| MGP44 | 97254.1 | 0.0731 | 0.17 | 20 | 1.54 | 0.03 | 30 | — | — | — |
| MGP44 | 97257.1 | — | — | — | 1.42 | 0.12 | 20 | 0.758 | 0.22 | 7 |
| MGP44 | 97258.2 | 0.0703 | 0.25 | 15 | 1.47 | 0.08 | 25 | — | — | — |
| MGP44 | 97258.3 | — | — | — | 1.41 | 0.12 | 19 | 0.772 | 0.23 | 9 |
| MGP44 | 97258.5 | — | — | — | — | — | — | 0.756 | 0.29 | 7 |
| CONT. | — | 0.0611 | — | — | 1.18 | — | — | 0.706 | — | — |

Table 310.
"CONT." = Control;
"Ave." = Average;
"% Incr." = % increment;
"p-val." = p-value,
L = p < 0.01.

Tables 311-313 summarize the observed phenotypes of transgenic plants exogenously expressing the gene constructs using the seedling assays under nitrogen deficient growth conditions. The genes listed in these Tables show increased biomass (e.g., increased dry weight, fresh weight), photosynthetic area (e.g., increased leaf area), increased root biomass (e.g., root length and root coverage) and increased growth rate (e.g., increased growth rate of leaf area, root coverage and root length) under nitrogen deficient growth conditions. The evaluation of each gene was performed by testing the performance of different number of events. Event with p-value <0.1 was considered statistically significant.

TABLE 311

Genes showing improved plant performance at Low Nitrogen growth conditions under regulation of Ar6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| NUE510 | 97027.1 | 5.15 | 0.18 | 20 | — | — | — |
| NUE510 | 97027.4 | 4.80 | 0.21 | 11 | — | — | — |
| CONT. | — | 4.31 | — | — | — | — | — |
| LGA27 | 96392.2 | 5.45 | 0.15 | 21 | 91.1 | 0.06 | 23 |
| LGA27 | 96394.3 | 5.20 | 0.18 | 16 | — | — | — |
| LGA27 | 96394.4 | 4.88 | 0.24 | 8 | 88.3 | 0.20 | 19 |
| CONT. | — | 4.50 | — | — | 74.0 | — | — |

Table 311.
"CONT." = Control;
"Ave." = Average;
"% Incr." = % increment;
"p-val." = p-value,
L = p < 0.01.

TABLE 312

Genes showing improved plant performance at Low Nitrogen growth conditions under regulation of At6669 promoter

| Gene Name | Event # | Leaf Area [cm$^2$] Ave. | P-Val. | % Incr. | Roots Coverage [cm$^2$] Ave. | P-Val. | % Incr. | Roots Length [cm] Ave. | P-Val. | % Incr. |
|---|---|---|---|---|---|---|---|---|---|---|
| NUE510 | 97026.4 | — | — | — | 14.6 | 0.26 | 20 | — | — | — |
| NUE510 | 97027.1 | 0.380 | 0.11 | 7 | 15.4 | 0.14 | 27 | — | — | — |
| CONT. | — | 0.356 | — | — | 12.1 | — | — | — | — | — |
| NUE510 | 97027.1 | 0.449 | 0.22 | 9 | — | — | — | — | — | — |
| CONT. | — | 0.411 | — | — | — | — | — | — | — | — |
| LGA27 | 96394.1 | — | — | — | 16.5 | 0.27 | 14 | — | — | — |
| CONT. | — | — | — | — | 14.4 | — | — | — | — | — |
| LGA27 | 96392.2 | 0.447 | 0.17 | 23 | 14.8 | 0.27 | 8 | — | — | — |
| LGA27 | 96394.3 | — | — | — | 15.8 | 0.15 | 15 | 7.97 | 0.26 | 3 |
| LGA27 | 96394.4 | 0.404 | 0.02 | 11 | 15.8 | 0.11 | 16 | 8.07 | 0.09 | 4 |
| CONT. | — | 0.363 | — | — | 13.7 | — | — | 7.76 | — | — |

Table 312.
"CONT." = Control;
"Ave." = Average;
"% Incr." = % increment;
"p-val." = p-value,
L = p < 0.01.

TABLE 313

Genes showing improved plant performance at Low Nitrogen growth conditions under regulation of At6669 promoter

| Gene Name | Event # | RGR Of Leaf Area Ave. | P-Val. | % Incr. | RGR Of Roots Coverage Ave. | P-Val. | % Incr. | RGR Of Root Length Ave. | P-Val. | % Incr. |
|---|---|---|---|---|---|---|---|---|---|---|
| NUE510 | 97026.4 | — | — | — | 2.06 | 0.24 | 22 | — | — | — |
| NUE510 | 97027.1 | — | — | — | 2.14 | 0.15 | 27 | — | — | — |
| CONT. | — | — | — | — | 1.68 | — | — | — | — | — |
| NUE510 | 97027.1 | 0.0357 | 0.19 | 14 | — | — | — | — | — | — |
| NUE510 | 97027.4 | — | — | — | — | — | — | 0.770 | 0.14 | 7 |
| CONT. | — | 0.0312 | — | — | — | — | — | 0.722 | — | — |
| LGA27 | 96394.1 | — | — | — | 2.00 | 0.25 | 15 | 0.809 | 0.14 | 10 |
| LGA27 | 96394.3 | — | — | — | — | — | — | 0.767 | 0.22 | 4 |
| CONT. | — | — | — | — | 1.74 | — | — | 0.737 | — | — |
| LGA27 | 96392.2 | 0.0410 | 0.19 | 23 | 1.82 | 0.22 | 9 | 0.815 | 0.03 | 5 |
| LGA27 | 96394.2 | — | — | — | — | — | — | 0.806 | 0.19 | 4 |
| LGA27 | 96394.3 | — | — | — | 1.95 | 0.12 | 17 | 0.863 | L | 11 |
| LGA27 | 96394.4 | 0.0388 | L | 17 | 1.93 | 0.13 | 15 | 0.819 | 0.08 | 6 |
| CONT. | — | 0.0333 | — | — | 1.68 | — | — | 0.776 | — | — |

Table 313.
"CONT." = Control;
"Ave." = Average;
"% Incr." = % increment;
"p-val." = p-value,
L = p < 0.01.

Example 33

Evaluation of Transgenic Brachypoium for Seed Yield in Validation Spike (SP) Assay and Harvest Index Assay Under Normal, Drought and Nitrogen Deficient Conditions Grown in Greenhouse Until Seed Maturation (GH-SM Assays)

Each validation assay measures the efficacy of specific traits as describe in the Table below. In addition to those traits, the genes of some embodiments of the invention improve yield under various conditions (normal conditions as well as under abiotic stress conditions such as nitrogen deficiency and drought stress).

TABLE 314

Allocation of *Brachypodium* parameters to specific traits

| # | Parameters | Traits |
|---|---|---|
| 1 | Time to heading | Plant biomass and Grain filling period |
| 2 | Grain filling period | Grain filling period |
| 3 | 1000 grain weight | Harvest index and seed yield |
| 4 | Plant height | Plant height, Harvest index |
| 5 | Vegetative Dry Weight | Plant biomass |
| 6 | Harvest Index | Harvest index and Seed Yield |
| 7 | Inflorescence node number | Harvest index and Seed Yield |
| 8 | Grain number | Harvest index and Seed Yield |
| 9 | Spikelet's dry weight (gr.) | Harvest index and Seed Yield |

TABLE 314-continued

Allocation of *Brachypodium* parameters to specific traits

| # | Parameters | Traits |
|---|---|---|
| 10 | Total dry mater per plant | Plant biomass |
| 11 | Total Grains yield per plant (gr.) | Harvest index and Seed Yield |
| 12 | Rachis diameter | Harvest index, Grain filling period |

Table 314. Some of the parameters affect the trait indirectly, for example, "Dry weight" is effected by "time to heading" and can also effect "seed yield". Usually, decrease in "time to heading" reduces the "dry weight", on the other hand, the reduce in "dry weight" can effect "seed yield". The trait "Harvest index" is influenced by yield component, plant biomass and indirectly by all tissues participant in remobilization of nutrients and carbohydrates in the plants such as stem width, rachis width and plant height.

Validation assay of transgenic plants grown under normal conditions—This assay continues till seed maturation (when the plant and grains/seeds are dried). Transgenic *Brachypodium* seeds are sown in germination plugs type (Growtech), having a size of 19-22 mm width and over 35 mm height. The plugs are placed into designated plastic trays, then flooded with 0.1% Basta solution, until plugs are saturated. The trays are placed in the refrigerator where they undergo cold treatment for 3 days at 4° C. After the cold treatment, the trays are placed in the greenhouse (GH) for hardening under mist condition until germination (about 1 week). $T_2$ transgenic seedlings are then transplanted to 3.1 liter trays filled with peat and perlite in a 3:1 ratio, respectively, 6 plants per plot. The plants are grown under normal growth conditions which include irrigation of the trays with a solution containing 6 mM inorganic nitrogen in the form of $KNO_3$, supplemented with 1 mM $KH_2PO_4$, 1 mM $MgSO_4$, 1.5 mM $CaCl_2$ and microelements obtained from the "Shefer" fertilizer (containing N, P, K (5:3:8, weight percentages, respectively; +300 mg/Kg of microelements (Fe, Mn, Zn, Cu, and Mo) Fertilizers & Chemicals, Haifa, Israel. Under normal conditions the plants grow in a controlled environment in a closed greenhouse, temperature range 18-22° C., humidity approximately 70%. Irrigation is done by drippers with a water solution containing 6 mM N (nitrogen) (as described above), and irrigation was repeated whenever water loss per each weighted plot reached 50%. All plants are grown in the greenhouse until seed maturation. Seeds are harvested, extracted and weighted. The remaining plant biomass (the above ground tissue) is also harvested, and weighted immediately or following drying in oven at 50° C. for 24 hours.

Validation assay of transgenic plants grown under drought conditions and standard growth conditions—This assay follows seed yield production of plants grown in the greenhouse under drought conditions and under standard growth conditions. The growth conditions of the plants were as describe above for normal conditions until the heading stage. From the heading stage the plants were either subjected to drought conditions until seed maturation or were continued under normal conditions until seed maturation. Thus, under normal growth conditions at heading, half of the plants are irrigated with 900 milliliter whenever the tray weight reached 50% of its filled capacity. Under drought growth condition from the heading stage, the other half of the plants are irrigated with 250 milliliter when the tray weight reached 20% of its filled capacity in order to induce drought stress. All plants are grown in the greenhouse until seeds maturation. Seeds are harvested, extracted and weighted. The remaining plant biomass (the above ground tissue) is also harvested, and weighted immediately or following drying in oven at 50° C. for 24 hours.

Validation assay of transgenic plants grown under nitrogen limiting (low N) and standard (nitrogen non-limiting) conditions—This assay follows seed yield production and the biomass formation of plants grown in the greenhouse at limiting and non-limiting nitrogen growth conditions. From the heading stage the plants were either subjected to nitrogen limiting conditions until seed maturation or were continued under normal conditions until seed maturation. Thus, under normal growth conditions at heading, half of the plants are irrigated with a solution containing nitrogen limiting conditions comprising a solution containing 3 mM inorganic nitrogen in the form of $KNO_3$, supplemented with 1 mM $KH_2PO_4$, 1 mM $MgSO_4$, 1.5 mM $CaCl_2$ and microelements, while the other half of the plants are grown under normal condition with normal nitrogen levels achieved by applying a solution of 6 mM inorganic nitrogen also in the form of $KNO_3$, supplemented with 1 mM $KH_2PO_4$, 1 mM $MgSO_4$, 1.5 mM $CaCl_2$ and microelements. All plants are grown in the greenhouse until mature seeds. Seeds are harvested, extracted and weight. The remaining plant biomass (the above ground tissue) is also harvested, and weighted immediately or following drying in oven at 50° C. for 24 hours.

Each construct is validated at its $T_2$ generation. Transgenic plants transformed with a construct conformed by an empty vector carrying a promoter and the selectable marker are used as control [The promoters which are described in Example 25 above, e.g., the 35S promoter (SEQ ID NO: 37)].

The plants are analyzed for their overall size, time to heading, maturity, spikelet's DW (dry weight), Inflorescence node number, seed yield, 1,000-seed weight, dry matter and harvest index (Formula 15). Transgenic plants performance is compared to control plants grown in parallel under the same (e.g., identical) conditions. Next, analyzed data is saved to text files and processed using the JMP statistical analysis software (SAS institute).

The experiment is planned in random blocks design. For each gene of the invention four to five independent transformation events are analyzed from each construct with 8 repeats.

At the end of the growing period plant harvest is separated between the vegetative parts and the reproductive parts (spikes) and the following parameters are measured using digital imaging system as describe below.

A grain sample per plot of 2 grams is weighted, photographed and images are processed using the below described image processing system. The sum of grain number, length and width (longest axis) are measured from those images and are averaged by the number of grains.

The image processing system that is used, consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images are captured in resolution of 10 Mega Pixels (3888×2592 pixels) and stored in a low compression JPEG (Joint Photographic Experts Group standard) format. Next, image processing output data for seed area and seed length is saved to text files and analyzed using the JMP statistical analysis software (SAS institute).

Assay 1: Seed Yield, Plant Biomass, Yield Components (Spike Assay) and Grain Filling Period in Greenhouse Conditions Until Seed Maturation (Seed Maturation Assay).

Time to heading—Number of days in which 50% of the plants in a plot are at heading (emergence of the first head).

Spikelet's dry weight (gr.)—The weight of spikes of each plot is separated from the vegetative parts and Spikelet's dry weight is measured per plot.

Inflorescence node number—count number of spikelet's above flag leaf on main tiller.

Harvest Index—The harvest index is calculated using Formula 15 (described above).

Vegetative Dry Weight—Total weight of the vegetative portion above ground (excluding roots and reproductive spikelets) after drying at 70° C. in oven for 48 hours;

Total dry mater per plant—Calculated as vegetative portion above ground plus all the spikelet dry weight per plot divided by the number of plants in plot.

Grain filling period—Calculated from the time to maturity (braking color of the spikelets from green to yellow of 50% in the plot) minus the time to heading.

At the end of the experiment a sample of 2 grams of Spikelet's Dry weight from each plot is collected and the following parameters were processed using digital imaging system:

Total Grains yield per plant (gr.) -A sample of 2 grams of spikelet's dry weight from each plot is collected, grains are extracted and weighted. The average grain yield per plot is then calculated per the total Spikelet's dry weight. Results of grain yield per plant are achieved by dividing the result per plot by number of plants per plot.

Grain number—A sample of 2 grams of Spikelet's Dry weight are extracted, photographed and analyzed using image processing system. Number of grains from the sample is taken by image processing system and is calculated to the whole plot. Number of grains per plant are further calculated by dividing the total grain number per plot by the number of plants per plot.

1000 grain weight—grain yield and grain number are calculated as describe above, 1000 grains is calculated via the ratio between total grain yield per plant divided by the total grain number per plant.

Statistical analyses—To identify genes conferring significantly improved tolerance to abiotic stresses, the results obtained from the transgenic plants are compared to those obtained from control plants. To identify outperforming genes and constructs, results from the independent transformation events tested are analyzed separately. Data is analyzed using Student's t-test and results are considered significant if the p value was less than 0.1. The JMP statistics software package was used (Version 5.2.1, SAS Institute Inc., Cary, N.C., USA).

Assay 2: Plant Height and Rachis Diameter in Greenhouse Conditions Until Seed Maturation (Seed Maturation Assay).

Plant height—Each of the plants was measured for its height using a measuring tape. Height was measured from ground level to spike base of the longest spike at harvest.

Rachis diameter—Before harvest measure rachis diameter using micro caliber (node above the first spikelet)

Example 34

Evaluation of Transgenic Brachypoium for Heading in Validation Biomass (BM) Assay Under Normal, Drought and Nitrogen Deficient Conditions in Greenhouse Assays Until Heading (GH-Heading Assays)

Each validation trait assay measure the efficacy of specific traits as describe in the table below. In addition to those traits, our genes improve yield under various conditions (normal, NUE and drought).

TABLE 315

Allocation of *Brachypodium* parameters to specific traits

| # | Parameters | Traits |
|---|---|---|
| 1 | Leaf thickness | Plant biomass |
| 2 | Time to heading | Plant biomass and Grain filling period |
| 3 | Shoot dry weight | Plant biomass |
| 4 | Shoot fresh weight | Plant biomass |

Table 315. A decrease in "time to heading" will reduce the "dry weight".

Assay 1: Plant Biomass Leaf Thickness and Time to Heading in Greenhouse Conditions Until Heading (Heading Assay).

Under Normal conditions—This assay follows time to heading, transgenic *Brachypodium* seeds were sown in germination plugs type (Growtech), size 19-22 mm wide over 35 mm high. The plugs are placed into designated black plastic trays, than flood with 0.1% Basta solution, until plugs are saturated. The trays are placed in the refrigerator where they will undergo cold treatment for 3 days at 4° C. After the cold treatment the trays are placed in the GH for hardening under mist condition until germination (1 week). $T_2$ transgenic seedlings were then transplanted to 3.1 liter trays filled with peat and perlite in a 3:1 ratio, 6 plants per plot. The plants were grown under normal growth conditions which included irrigation of the trays with a solution containing 6 mM inorganic nitrogen in the form of $KNO_3$, supplemented with 1 mM $KH_2PO_4$, 1 mM $MgSO_4$, 1.5 mM $CaCl_2$ and microelements obtained from the "Shefer" fertilizer (containing N, P, K (5:3:8, weight percentages, respectively; +300 mg/Kg of microelements (Fe, Mn, Zn, Cu, and Mo) Fertilizers & Chemicals, Haifa, Israel. Under normal conditions the plants grown in a controlled environment in a closed transgenic greenhouse, temperature about 1 8-22° C., humidity around 70%. Irrigation is done by drippers with a water solution containing 6 mM N (nitrogen) (as described hereinabove), and irrigation is repeated whenever water loss reached 50%. All plants are grown in the greenhouse until heading. Plant biomass (the above ground tissue) harvested, and weighted immediately (FW) or following drying in oven at 50° C. for 24 hours. In addition, leaf thickness is measured.

Under drought conditions and standard growth conditions—This assay follows time to heading of plants grown in the greenhouse under drought conditions and under standard growth conditions. Under normal condition, irrigation is performed on half of the plants when tray weight reached 50% of its filled capacity while under drought conditions, the second half of plants were irrigated when tray weight reached 20% of its filled capacity in order to induce drought stress. All plants are grown in the greenhouse until heading. Leaf thickness and time to heading are measured. The remaining plant biomass parameters (the above ground tissue) are also harvested, and weighted immediately or following drying in oven at 50° C. for 24 hours.

Under nitrogen limiting (low N) and standard (nitrogen non-limiting) conditions—This assay follows the biomass formation of plants grown in the greenhouse at limiting and non-limiting nitrogen growth conditions. Under nitrogen limiting conditions, half of the plants were irrigated with a solution containing nitrogen limiting conditions, which were achieved by irrigating the plants with a solution containing 3 mM inorganic nitrogen in the form of $KNO_3$, supplemented with 1 mM $KH_2PO_4$, 1 mM $MgSO_4$, 1.5 mM $CaCl_2$ and microelements, while the normal nitrogen levels (standard conditions) were achieved by applying a solution of 6 mM inorganic nitrogen also in the form of KNO$_3$, supplemented with 1 mM KH$_2$PO$_4$, 1 mM MgSO$_4$, 1.5 mM CaCl$_2$ and microelements. All plants are grown in the greenhouse until heading. Leaf thickness and time to heading are measured. The remaining plant biomass parameters (the above ground tissue) are also harvested, and weighted immediately or following drying in oven at 50° C. for 24 hours.

Each construct was validated at its T$_2$ generation. Transgenic plants transformed with a construct conformed by an empty vector carrying a promoter and the selectable marker are used as control [The promoters which are described in Example 25 above, e.g., the 35S promoter (SEQ ID NO: 37)].

The plants are analyzed for their leaf thickness, time to heading, shoot FW and shoot DW. Transgenic plants performance is compared to control plants grown in parallel under the same (e.g., identical) conditions. Next, analyzed data is saved to text files and processed using the JMP statistical analysis software (SAS institute).

The experiment was planned in random blocks design. For each gene of the invention four to five independent transformation events are analyzed from each construct.

Time to heading—Number of days in which 50% of the plants in a plot are at heading (emergence of the first head).

Leaf thickness—before harvest leaf thickness is measured using micro caliber on the upper open leaf.

Shoot fresh weight—Total weight of the vegetative portion above ground (excluding roots and reproductive spikelet's);

Shoot dry weight—Total weight of the vegetative portion above ground (excluding roots and reproductive spikelet's) after drying at 70° C. in oven for 48 hours;

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less or equal than 0.1. The JMP statistics software package was used (Version 5.2.1, SAS Institute Inc., Cary, N.C., USA).

Example 35

Over-Expression of a Polypeptide by Genome Editing

Over-expression of a polypeptide according to certain embodiments of the present invention can be achieved using methods of gene editing. One example of such approach includes editing a selected genomic region as to express the polypeptide of interest. In the current example, the target genomic region is the maize locus GRMZM2G069095 (based on genome version Zea mays AGPv3) and the polypeptide to be over-expressed is the maize LBY245 comprising the amino acid sequence set forth in SEQ ID NO: 16122. It is to be explicitly understood that other genome loci can be used as targets for genome editing for over-expressing other polypeptides of the invention based on the same principles.

FIG. 14A depicts the sequence of the endogenous 5' upstream flanking region of the genomic sequence GRMZM2G069095 (SEQ ID NO:26731) and FIG. 14B depicts the sequence of the endogenous 3'-downstream flanking region of this genomic locus (SEQ ID NO:26732). FIG. 14C depicts the sequence of the 5'-UTR gRNA (SEQ ID NO: 26729) and FIG. 14D depicts the sequence of the 5'-UTR gRNA without NGG nucleotides following the 3 nucleotides after the Cas9 cutting (SEQ ID NO: 26733). FIG. 14E depicts the sequence of the 3'-UTR gRNA (SEQ ID NO: 26730) and FIG. 14F depicts the sequence of the 3'-UTR gRNA after cut (SEQ ID NO: 26734). FIG. 14G depicts the coding sequence (from the "ATG" start codon to the "TGA" termination codon, marked by bold and underlined) of the desired LBY245 sequence (SEQ ID NO: 26736) encoding the polypeptide set forth by SEQ ID NO: 16122.

The complete exemplary repair template (SEQ ID NO: 26735) is depicted in FIG. 14H. The repair template includes: (1) the upstream flanking region (1 kbp) sequence including part of the gRNA after cutting (SEQ ID NO: 26733; shown in bold and italics); (2) 5' UTR of genomic DNA from Cas9 cutting site to ATG; (3) the coding sequence (CDS) of the desired LBY245 sequence (SEQ ID NO:26736) marked in lower case with the start (ATG) and the stop (TGA) codons marked in bold and underlined; (4) 3' UTR of genomic DNA from the stop codon to Cas9 cutting site including the predicted part of the gRNA after cutting (SEQ ID NO: 26734, shown in bold and italics and (5) the downstream flanking region (1 kbp) sequence.

The repair template is delivered into the cell type of interest along with the 5' and 3' guide RNA sequences (SEQ ID NO: 26729 and SEQ ID NO: 26730, respectively).

Example 36

Identification of Domains Comprised in Identified Genes

A polypeptide domain refers to a set of conserved amino acids located at specific positions along an alignment of sequences of evolutionarily related proteins. While amino acids at other positions can vary between homologues, amino acids that are highly conserved, and particularly amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom.

Interpro is hosted at the European Bioinformatics Institute in the United Kingdom. InterProScan is the software package that allows sequences (protein and nucleic) to be scanned against InterPro's signatures. Signatures are predictive models, provided by several different databases, that make up the InterPro consortium.

InterProScan 5.11-51.0 was used to analyze the polypeptides of the present invention (core and homologues/orthologs) for common domains (Mitchell A et al., 2015.

Nucleic Acids Research 43(Database issue): D213-221; doi: 10.1093/nar/gku1243). Briefly, InterProScan is based on scanning methods native to the InterPro member databases. It is distributed with pre-configured method cut-offs recommended by the member database experts and which are believed to report relevant matches. All cut-offs are defined in configuration files of the InterProScan programs. Matches obtained with the fixed cut-off are subject to the following filtering:

Pfam filtering: Each Pfam family is represented by two hidden Markov models (HMMs)—ls and fs (full-length and fragment). An HMM model has bit score cut-offs (for each domain match and the total model match) and these are defined in the Gathering threshold (GA) lines of the Pfam database. Initial results are obtained with quite a high common cut-off and then the matches of the signature with a lower score than the family specific cut-offs are dropped.

If both the fs and ls model for a particular Pfam hits the same region of a sequence, the AM field in the Pfam database is used to determine which model should be chosen—globalfirst (LS); localfirst (FS) or byscore (whichever has the highest e-value).

Another type of filtering has been implemented since release 4.1. It is based on Clan filtering and nested domains. Further information on Clan filtering can be found in the Pfam website for more information on Clan filtering.

TIGRFAMs filtering: Each TIGRFAM HMM model has its own cut-off scores for each domain match and the total model match. These bit score cut-offs are defined in the "trusted cut-offs" (TC) lines of the database. Initial results are obtained with quite a high common cut-off and then the matches (of the signature or some of its domains) with a lower score compared to the family specific cut-offs are dropped.

PRINTS filtering: All matches with p-value more than a pre-set minimum value for the signature are dropped.

SMART filtering: The publicly distributed version of InterProScan has a common e-value cut-off corresponding to the reference database size. A more sophisticated scoring model is used on the SMART web server and in the production of pre-calculated InterPro match data.

Exact scoring thresholds for domain assignments are proprietary data. The InterProMatches data production procedure uses these additional smart.thresholds data. It is to be noted that the given cut-offs are e-values (i.e. the number of expected random hits) and therefore are valid only in the context of reference database size and smart.desc data files to filter out results obtained with higher cut-off.

It implements the following logic: If the whole sequence E-value of a found match is worse than the 'cut_low', the match is dropped. If the domain E-value of a found match is worse than the 'repeat' cut-off (where defined) the match is dropped. If a signature is a repeat, the number of significant matches of that signature to a sequence must be greater than the value of 'repeats' in order for all matches to be accepted as true (T).

If the signature is part of a family ('family_cut' is defined), if the domain E-value is worse than the domain cut off ('cutoff'), the match is dropped. If the signature has "siblings" (because it has a family_cut defined), and they overlap, the preferred sibling is chosen as the true match according to information in the overlaps file.

PROSITE patterns CONFIRMation: ScanRegExp is able to verify PROSITE matches using corresponding statistically-significant CONFIRM patterns. The default status of the PROSITE matches is unknown (?) and the true positive (T) status is assigned if the corresponding CONFIRM patterns match as well. The CONFIRM patterns were generated based on the true positive SWISS-PROT PROSITE matches using eMOTIF software with a stringency of $10e^{-9}$ P-value.

PANTHER filtering: Panther has pre- and post-processing steps. The pre-processing step is intended to speed up the HMM-based searching of the sequence and involves blasting the HMM sequences with the query protein sequence in order to find the most similar models above a given e-value. The resulting HMM hits are then used in the HMM-based search.

Panther consists of families and sub-families. When a sequence is found to match a family in the blast run, the sub-families are also scored using HMMER tool (that is, unless there is only 1 sub-family, in which case, the family alone is scored against).

Any matches that score below the e-value cut-off are discarded. Any remaining matches are searched to find the HMM with the best score and e-value and the best hit is then reported (including any sub-family hit).

GENE3D filtering: Gene3D also employs post-processing of results by using a program called DomainFinder. This program takes the output from searching the Gene3D HMMs against the query sequence and extracts all hits that are more than 10 residues long and have an e-value better than 0.001. If hits overlap at all, the match with the better e-value is chosen.

The polypeptides of the invention the expression of which increase at least one trait selected from the group consisting of yield, growth rate, biomass, vigor, oil content, seed yield, fiber yield, fiber quality, fiber length, photosynthetic capacity, nitrogen use efficiency, early flowering, grain filling period, harvest index, plant height, and/or abiotic stress tolerance of a plant, can be characterized by specific amino acid domains. According to certain embodiments, particular domains are conserved within a family of polypeptides as described in Table 316 hereinbelow. Without wishing to be bound by specific theory or mechanism of action, the conserved domain may indicate common functionally of the polypeptides comprising same. The domains are presented by an identifier (number). Table 317 provides the details of each domain.

TABLE 316

Domain Families

| Core Polypeptide (SEQ ID NO) | Characteristic Domains (Domain identifier) | Homologous Polypeptides Family Sharing the Domain (SEQ ID Nos) |
|---|---|---|
| 15824 | 1; 2; 3 | 16185; 16186; 16187 |
| 15825 | 4; 5; 6 | 16188 |
| 15826 | 7; 8; 9; 10; 11 | 16189; 16190 |
| 15827 | 12; 13; 14; 15; 16 | 16191; 16192; 16193; 16194; 16195; 16196; 16197; 16198 |
| 15828 | 17; 19; 20 | 16199; 16200; 16201; 16202; 16203; 16204; 16205; 16206; 16207; 16208; 16209; 16210; 16211; 16212; 16213; 16214; 16215; 16216; 16217; 16218; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 16219; 16220; 16221; 16222; 16223; 16224; 16225; 16226; 16227; 16228; 16229; 16230; 16231; 16232; 16233; 16234; 16235; 16236; 16237; 16238; 16239; 16240; 16241; 16242; 16243; 16244; 16245; 16246; 16247; 16248; 16249; 16250; 16251; 16252; 16253; 16254; 16255; 16256; 16257; 16258; 16259; 16260; 16261; 16262; 16263; 16264; 16265; 16266; 16267; 16268; 16269; 16270; 16271; 16272; 16273; 16274; 16275; 16276; 16277; 16278; 16279; 16280; 16281; 16282; 16283; 16284; 16285; 16286; 16287; 16288; 16289; 16290; 16291; 16292; 16293; 16294; 16295; 16296; 16297; 16298; 16299; 16300; 16301; 16302; 16303; 16304; 16305; 16306; 16307; 16308; 16309; 16310; 16311; 16312; 16313; 16314; 16315; 16316; 16317; 16318; 16319; 16320; 16321; 16322; 16323; 16324; 16325; 16326; 16327; 16328; 16329; 16330; 16331; 16332; 16333; 16334; 16335; 16336; 16337; 16338; 16339; 16340; 16341; 16342; 16343; 16344; 16345; 16346; 16347; 16348; 16349; 16350; 16351; 16352; 16353; 16354; 16355; 16356; 16357; 16358; 16359; 16360; 16361; 16362; 16363; 16364; 16365; 16366; 16367; 16368; 16369; 16370; 16371; 16372; 16373; 16374; 16375; 16376; 16377; 16378; 16379; 16380; 16381; 16382; 16383; 16384; 16385; 16386; 16387; 16388; 16389; 16390; 16391; 16392; 16393; 16394; 16395; 16396; 16397; 16398; 16399; 16400; 16401; 16402; 16403; 16404; 16405; 16406; 16407; 16408; 16409; 16410; 16411; 16412; 16413; 16414; 16415; 16416; 16417; 16418; 16419; 16420; 16421; 16422; 16423; 16424; 16425; 16426; 16427; 16428; 16429; 16430; 16431; 16432; 16433; 16434; 16435; 16436; 16437; 16438; 16439; 16440; 16441; 16442; 16443; 16444; 16445; 16446; 16447; 16448; 16449; 16450; 16451; 16452; 16453; 16454; 16455; 16456; 16457; 16458; 16459; 16460; 16461; 16462; 16463; 16464; 16465; 16466; 16467; 16468; 16469; 16470; 16471; 16472; 16473; 16474; 16475; 16476; 16477; 16478; 16479; 16480; 16481; 16482; 16483; 16484; 16485; 16486; 16487; 16488; 16489; 16490; 16491; 16492; 16493; 16494; 16495; 16496; 16497; 16498; 16499; 16500; 16501; 16502; 16503; 16504; 16505; 16506; 16507; 16508; 16509; 16510; 16511; 16512; 16513; 16514; 16515; 16516; 16517; 16518; 16519; 16520; 16521; 16522; 16523; 16524; 16525; 16526; 16527; 16528; 16529; 16530; 16531; 16532; 16533; 16534; 16535; 16536; 16537; 16538; 16539; 16540; 16541; 16542; 16543; 16544; 16545; 16546; 16547; 16548; 16549; 16550; 16551; 16552; 16553; 16554; 16555; 16556; 16557; 16558; 16559; 16560; 16561; 16562; 16563; 16564; 16565; 16566; 16567; 16568; 16569; 16570; 16571; 16572; 16573; 16574; 16575; 16576; 16577; 16578; 16579; 16580; 16581; 16582; 16583 |
| 15829 | 22; 23; 24 | 16584 |
| 15830 | 25; 26; 27 | 16585; 16586; 16587; 16588; 16589; 16590 |
| 15832 | 32; 33; 34 | 15832; 16591; 16592; 16593; 16594; 16595; 16596; 16597; 16598; 16599; 16600; 16601; 16602; 16603; 16604; 16605; 16606; 16607; 16608; 16609; 16610; 16611; 16612; 16613; 16614; 16615; 16616; 16617; 16618; 16619; 16620; 16621; 16622; 16623; 16624; 16625; 16626; 16627; 16628; 16629; 16630; 16631; 16632; 16633; 16634; 16635; 16636; 16637; 16638; 16639; 16640; 16641; 16642; 16643; 16644; 16645; 16646; 16647; 16648; 16649; 16650; 16651; 16652; 16653; 16654; 16655; 16656; 16657; 16658; 16659; 16660; 16661; 16662; 16663; 16664; 16665; 16666; 16667; 16668; 16669; 16670; 16671; 16672; 16673; 16674; 16675; 16676; 16677; 16678; 16679; 16680; 16681; 16682; 16683; 16684; 16685; 16686; 16687; 16688; 16689; 16690; 16691; 16692; 16693; 16694; 16695; 16696; 16697; 16698; 16699; 16700; 16701; 16702; 16703; 16704; 16705; 16706; 16707; 16708; 16709; 16710; 16711; 16712; 16713; 16714; 16715; 16716; 16717; 16718; 16719; 16720; 16721; 16722; 16723; 16724; 16725; 16726; 16727; 16728; 16729; 16730; 16731; 16732; 16733; 16734; 16735; 16736; 16737; 16738; 16739; 16740; 16741; 16742; 16743; 16744; 16745; 16746; 16747; 16748; 16749; 16750; 16751; 16752; 16753; 16754; 16755; 16756; 16757; 16758; 16759; 16760; 16761; 16762; 16763; 16764; 16765; 16766; 16767; 16768; 16769; 16770; 16771; 16772; 16773; 16774; 16775; 16776 |
| 15833 | 37; 38 | 16777; 16778; 16779; 16780; 16781; 16782; 16783; 16784; 16785; 16786; 16787; 16788; 16789; 16790; 16791; 16792; 16793; 16794 |
| 15834 | 39; 40; 41; 42; 43 | 16795; 16796; 16797; 16798; 16799; 16800; 16801; 16802; 16803; 16804; 16805; 16806; 16807; 16808; 16809; 16810; 16811; 16812; 16813; 16814; 16815 |
| 15835 | 44; 45; 46; 47; 48; 49; 50; 51; 52; 53; 54 | 16816; 16817; 16818; 16819; 16820; 16821; 16822; 16823; 16824; 16825; 16826; 16827; 16828; 16829; 16830; 16831; 16832; 16833; 16834; 16835; 16836; 16837; 16838 |
| 15837 | 57; 58; 60 | 16839; 16840; 16841; 16842; 16843; 16844; 16845; 16846; 16847; 16848; 16849; 16850; 16851; 16852; 16853; 16854; 16855; 16856; 16857; 16858; 16859; 16860; 16861; 16862; 16863; 16864; 16865; 16866; 16867; 16868; 16869; 16870; 16871; 16872; 16873; 16874; 16875; 16876; 16877; 16878; 16879; 16880; 16881; 16882; 16883; 16884; 16885; 16886; 16887; 16888; 16889; 16890; 16891; 16892; 16893; 16894; 16895; 16896; 16897; 16898; 16899; 16900; 16901; 16902; 16903; 16904; 16905; 16906; 16907; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 16908; 16909; 16910; 16911; 16912; 16913; 16914; 16915; 16916; 16917; 16918; 16919; 16920; 16921; 16922; 16923; 16924; 16925; 16926; 16927; 16928; 16929; 16930; 16931; 16932; 16933; 16934; 16935; 16936; 16937; 16938; 16939; 16940; 16941; 16942; 16943; 16944; 16945; 16946; 16947; 16948; 16949; 16950; 16951; 16952; 16953; 16954; 16955; 16956; 16957; 16958; 16959; 16960; 16961; 16962; 16963; 16964; 16965; 16966; 16967; 16968; 16969; 16970; 16971; 16972; 16973; 16974; 16975; 16976; 16977; 16978; 16979; 16980; 16981; 16982; 16983; 16984 |
| 15839 | 64; 65; 66; 67 | 16985; 16986; 16987; 16988; 16989; 16990; 16991; 16992; 16993; 16994; 16995; 16996; 16997; 16998; 16999; 17000; 17001; 17002; 17003 |
| 15840 | 41; 68; 69 | 17004; 17005; 17006; 17007; 17008; 17009 |
| 15841 | 71; 72 | 17010; 17011; 17012; 17013; 17014; 17015; 17016; 17017; 17018; 17019; 17020; 17021; 17022; 17023; 17024; 17025; 17026; 17027; 17028; 17029; 17030; 17031; 17032; 17033; 17034; 17035; 17036; 17037; 17038; 17039; 17040; 17041; 17042; 17043; 17044; 17045; 17046; 17047; 17048; 17049; 17050; 17051; 17052; 17053; 17054; 17055; 17056 |
| 15842 | 73 | 17057; 17058; 17059; 17060; 17061; 17062; 17063; 17064; 17065; 17066; 17067; 17068; 17069; 17070 |
| 15843 | 74; 75 | 17071; 17072; 17073; 17074; 17075; 17076; 17077; 17078; 17079; 17080; 17081; 17082; 17083 |
| 15844 | 28; 76 | 17084 |
| 15845 | 77; 78 | 17085; 17086; 17087; 17088; 17089; 17090 |
| 15846 | 79; 80 | 17091; 17092; 17093; 17094 |
| 15847 | 81; 82; 83; 84; 85 | 17095; 17096; 17097; 17098; 17099; 17100; 17101; 17102; 17103; 17104; 17105 |
| 15849 | 86; 87; 88; 89 | 17106; 17107; 17108; 17109; 17110; 17111; 17112; 17113 |
| 15850 | 90 | 17114; 17115; 17116; 17117 |
| 15851 | 91 | 17118; 17119; 17120; 17121; 17122; 17123; 17124; 17125; 17126; 17127; 17128; 17129; 17130; 17131; 17132; 17133; 17134; 17135; 17136; 17137; 17138; 17139; 17140; 17141; 17142; 17143; 17144; 17145; 17146; 17147; 17148; 17149; 17150; 17151; 17152; 17153; 17154; 17155; 17156; 17157; 17158; 17159; 17160; 17161; 17162; 17163; 17164; 17165; 17166; 17167; 17168; 17169; 17170; 17171; 17172; 17173; 17174; 17175; 17176; 17177; 17178; 17179; 17180; 17181; 17182; 17183; 17184; 17185; 17186; 17187; 17188; 17189; 17190; 17191; 17192; 17193; 17194; 17195; 17196; 17197; 17198; 17199; 17200; 17201; 17202; 17203; 17204; 17205; 17206; 17207; 17208; 17209; 17210; 17211; 17212; 17213; 17214; 17215; 17216; 17217; 17218; 17219; 17220; 17221; 17222; 17223; 17224; 17225; 17226; 17227; 17228; 17229; 17230; 17231; 17232; 17233; 17234; 17235; 17236; 17237; 17238; 17239; 17240; 17241; 17242; 17243; 17244; 17245; 17246; 17247; 17248; 17249; 17250; 17251; 17252; 17253; 17254; 17255; 17256; 17257; 17258; 17259; 17260; 17261; 17262; 17263; 17264; 17265; 17266; 17267; 17268; 17269; 17270; 17271; 17272; 17273; 17274; 17275; 17276; 17277; 17278; 17279; 17280; 17281; 17282; 17283; 17284; 17285; 17286; 17287; 17288; 17289; 17290; 17291; 17292; 17293; 17294; 17295; 17296; 17297; 17298; 17299; 17300; 17301; 17302; 17303; 17304; 17305; 17306; 17307; 17308; 17309; 17310; 17311; 17312; 17313; 17314; 17315; 17316; 17317; 17318; 17319; 17320; 17321; 17322; 17323; 17324; 17325; 17326; 17327; 17328; 17329; 17330; 17331; 17332; 17333; 17334; 17335; 17336; 17337; 17338; 17339; 17340; 17341; 17342; 17343; 17344; 17345; 17346; 17347; 17348; 17349; 17350; 17351; 17352; 17353; 17354; 17355; 17356; 17357; 17358; 17359; 17360; 17361; 17362; 17363; 17364; 17365; 17366; 17367; 17368; 17369; 17370 |
| 15852 | 93; 94; 9; 95; 96 | 17371; 17372; 17373; 17374; 17375; 17376; 17377; 17378; 17379; 17380; 17381; 17382; 17383; 17384; 17385; 17386; 17387; 17388; 17389; 17390; 17391; 17392; 17393; 17394; 17395; 17396; 17397; 17398; 17399; 17400; 17401; 17402; 17403; 17404; 17405; 17406; 17407; 17408; 17409; 17410; 17411; 17412; 17413; 17414; 17415; 17416; 17417; 17418; 17419; 17420; 17421; 17422; 17423; 17424; 17425; 17426; 17427; 17428; 17429; 17430; 17431; 17432; 17433; 17434; 17435; 17436; 17437; 17438; 17439; 17440; 17441; 17442; 17443; 17444; 17445; 17446; 17447; 17448; 17449; 17450; 17451; 17452; 17453; 17454; 17455; 17456; 17457; 17458; 17459; 17460; 17461; 17462; 17463; 17464; 17465; 17466; 17467; 17468; 17469; 17470; 17471; 17472; 17473; 17474; 17475; 17476; 17477; 17478; 17479; 17480; 17481; 17482; 17483; 17484; 17485; 17486; 17487; 17488; 17489; 17490; 17491; 17492; 17493; 17494; 17495; 17496; 17497; 17498; 17499; 17500; 17501; 17502; 17503; 17504; 17505; 17506; 17507; 17508; 17509; 17510; 17511; 17512; 17513; 17514; 17515; 17516; 17517; 17518; 17519; 17520; 17521; 17522; 17523; 17524; 17525; 17526; 17527; 17528; 17529; 17530; 17531; 17532; 17533; 17534; 17535; 17536; 17537; 17538; 17539; 17540; 17541; 17542; 17543; 17544; 17545; 17546; 17547; 17548; 17549; 17550; 17551; 17552; 17553; 17554; 17555; 17556; 17557; 17558; 17559; 17560; 17561; 17562; 17563; 17564; 17565; 17566; 17567; 17568; 17569; 17570; 17571; 17572; 17573; 17574; 17575 |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| 15855 | 102; 103; 104; 105; 106 | 17576; 17577; 17578; 17579; 17580; 17581; 17582; 17583; 17584; 17585; 17586; 17587; 17588; 17589; 17590; 17591; 17592; 17593; 17594; 17595; 17596; 17597; 17598; 17599; 17600; 17601; 17602; 17603; 17604; 17605; 17606; 17607; 17608; 17609; 17610; 17611; 17612; 17613; 17614; 17615; 17616; 17617; 17618; 17619; 17620; 17621; 17622; 17623; 17624; 17625; 17626; 17627; 17628; 17629; 17630; 17631; 17632; 17633; 17634; 17635; 17636; 17637; 17638; 17639; 17640; 17641; 17642; 17643; 17644; 17645; 17646; 17647; 17648; 17649; 17650; 17651; 17652; 17653; 17654; 17655; 17656; 17657; 17658; 17659; 17660; 17661; 17662; 17663; 17664; 17665; 17666; 17667; 17668; 17669; 17670; 17671; 17672; 17673; 17674; 17675 |
| 15859 | 109; 26 | 17699; 17700; 17701; 17702; 17703; 17704; 17705; 17706; 17707 |
| 15860 | 110; 111; 9; 112; 113 | 17708; 17709; 17710; 17711; 17712; 17713; 17714; 17715; 17716 |
| 15861 | 114; 115; 116 | 17717; 17718; 17719; 17720; 17721; 17722; 17723; 17724; 17725; 17726; 17727; 17728; 17729; 17730; 17731; 17732; 17733; 17734 |
| 15862 | 117 | 17735 |
| 15863 | 118 | 17736; 17737; 17738; 17739; 17740; 17741; 17742; 17743; 17744; 17745; 17746; 17747; 17748; 17749; 17750; 17751; 17752; 17753; 17754; 17755; 17756; 17757; 17758; 17759; 17760; 17761; 17762 |
| 15864 | 119; 121 | 17763; 17764; 17765; 17766; 17767; 17768; 17769; 17770; 17771; 17772; 17773; 17774 |
| 15865 | 122 | 17775; 17776; 17777 |
| 15867 | 123; 124 | 17780; 17781; 17782; 17783; 17784; 17785 |
| 15869 | 122 | 17791; 17792; 17793; 17794; 17795; 17796; 17797; 17798 |
| 15870 | 125 | 17799; 17800; 17801; 17802; 17803; 17804; 17805; 17806; 17807 |
| 15871 | 126; 127 | 17808; 17809; 17810; 17811; 17812; 17813; 17814; 17815; 17816; 17817 |
| 15872 | 129 | 17818; 17819; 17820; 17821; 17822; 17823; 17824; 17825 |
| 15873 | 42 | 17826; 17827; 17828; 17829; 17830; 17831; 17832 |
| 15875 | 132; 133; 134; 30; 135; 136; 31; 6; 4; 137 | 17833 |
| 15876 | 138; 139 | 17834; 17835; 17836; 17837; 17838 |
| 15878 | 128; 129 | 17839; 17840; 17841; 17842 |
| 15879 | 144; 145; 146 | 17843; 17844 |
| 15882 | 149; 150 | 17846; 17847; 17848; 17849; 17850; 17851; 17852; 17853; 17854; 17855; 17856 |
| 15884 | 151; 152; 153 | 17857; 17858; 17859; 17860 |
| 15885 | 154; 155; 148; 75; 156 | 17861; 17862; 17863; 17864 |
| 15886 | 125 | 17865; 17866; 17867; 17868; 17869; 17870; 17871; 17872; 17873; 17874; 17875 |
| 15887 | 61; 62; 63 | 17876; 17877; 17878; 17879 |
| 15888 | 157 | 17880 |
| 15889 | 158; 5 | 17881; 17882 |
| 15890 | 159 | 17883; 17884; 17885; 17886; 17887; 17888; 17889; 17890; 17891; 17892; 17893; 17894 |
| 15891 | 160; 161 | 17895; 17896; 17897; 17898; 17899; 17900; 17901; 17902; 17903; 17904; 17905; 17906; 17907; 17908; 17909; 17910; 17911; 17912; 17913; 17914; 17915; 17916; 17917 |
| 15892 | 9; 162 | 17918; 17919; 17920; 17921; 17922; 17923 |
| 15893 | 9; 162 | 17924; 17925; 17926; 17927; 17928; 17929 |
| 15895 | 164; 165; 166 | 17930; 17931; 17932; 17933; 17934; 17935; 17936 |
| 15896 | 167 | 17937; 17938; 17939; 17940 |
| 15897 | 110; 111; 9; 168; 113 | 17941; 17942; 17943; 17944; 17945; 17946; 17947; 17948; 17949; 17950; 17951; 17952; 17953; 17954; 17955; 17956; 17957; 17958; 17959; 17960; 17961; 17962; 17963; 17964; 17965; 17966; 17967; 17968; 17969; 17970; 17971; 17972; 17973; 17974; 17975; 17976; 17977; 17978; 17979; 17980; 17981; 17982; 17983; 17984; 17985; 17986; 17987; 17988; 17989; 17990; 17991; 17992; 17993; 17994; 17995; 17996; 17997; 17998; 17999; 18000; 18001; 18002; 18003; 18004; 18005; 18006; 18007; 18008; 18009; 18010; 18011; 18012; 18013; 18014; 18015; 18016 |
| 15898 | 169; 70; 71; 170 | 18017; 18018; 18019; 18020; 18021; 18022; 18023; 18024; 18025; 18026; 18027; 18028; 18029; 18030; 18031; 18032; 18033; 18034; 18035 |
| 15899 | 171; 172; 173; 174; 175; 176; 177 | 18036; 18037; 18038; 18039; 18040; 18041; 18042; 18043; 18044; 18045; 18046; 18047; 18048 |
| 15900 | 178; 125 | 18049; 18050; 18051; 18052; 18053; 18054; 18055; 18056; 18057; 18058; 18059; 18060; 18061; 18062; 18063 |
| 15901 | 179; 110; 180; 9; 181 | 18064; 18065; 18066; 18067; 18068; 18069; 18070; 18071; 18072; 18073; 18074 |
| 15902 | 71; 72 | 18075; 18076; 18077; 18078; 18079; 18080; 18081; 18082; 18083; 18084; 18085; 18086; 18087; 18088; 18089; 18090; 18091; 18092; 18093; 18094; 18095; 18096; 18097; 18098; 18099; 18100; 18101; 18102; 18103; 18104; 18105; 18106; 18107; 18108; 18109; 18110; 18111; 18112; 18113; 18114; 18115; 18116; 18117; 18118; 18119; 18120; 18121; 18122; 18123; 18124; 18125; 18126; 18127; 18128; 18129; 18130; 18131; 18132; 18133; 18134; 18135; 18136; 18137; 18138; 18139; 18140; 18141; 18142; 18143 |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| 15906 | 186; 187; 188 | 18144; 18145; 18146; 18147; 18148; 18149; 18150; 18151; 18152; 18153; 18154; 18155; 18156; 18157 |
| 15907 | 186; 187; 188 | 18158; 18159; 18160; 18161; 18162; 18163; 18164; 18165; 18166; 18167; 18168; 18169; 18170; 18171; 18172; 18173; 18174; 18175; 18176; 18177; 18178 |
| 15908 | 191 | 18179; 18180; 18181; 18182; 18183; 18184; 18185; 18186; 18187; 18188; 18189 |
| 15910 | 1; 2; 3 | 18190; 18191; 18192; 18193 |
| 15911 | 193; 194 | 18194; 18195; 18196; 18197; 18198; 18199; 18200; 18201; 18202; 18203; 18204; 18205; 18206; 18207; 18208; 18209; 18210 |
| 15912 | 125; 178 | 18211; 18212; 18213 |
| 15913 | 195; 116; 125 | 18214; 18215; 18216; 18217; 18218; 18219; 18220; 18221 |
| 15914 | 196; 197; 198 | 15914; 18222; 18223; 18224; 18225; 18226; 18227; 18228; 18229; 18230; 18231; 18232; 18233; 18234; 18235; 18236; 18237; 18238; 18239; 18240; 18241; 18242; 18243; 18244; 18245; 18246; 18247; 18248; 18249; 18250; 18251; 18252; 18253; 18254; 18255; 18256; 18257; 18258; 18259; 18260; 18261; 18262; 18263; 18264; 18265; 18266; 18267; 18268; 18269; 18270; 18271; 18272; 18273; 18274; 18275; 18276; 18277; 18278; 18279; 18280; 18281; 18282; 18283; 18284; 18285; 18286; 18287; 18288; 18289; 18290; 18291; 18292; 18293; 18294; 18295; 18296; 18297; 18298; 18299; 18300; 18301; 18302; 18303; 18304; 18305; 18306; 18307; 18308; 18309; 18310; 18311; 18312; 18313; 18314; 18315; 18316; 18317; 18318; 18319; 18320; 18321; 18322; 18323; 18324; 18325; 18326; 18327; 18328; 18329; 18330; 18331; 18332; 18333; 18334; 18335; 18336; 18337; 18338; 18339; 18340; 18341; 18342; 18343; 18344; 18345; 18346; 18347; 18348; 18349; 18350; 18351; 18352; 18353; 18354; 18355; 18356; 18357; 18358; 18359; 18360; 18361; 18362; 18363; 18364; 18365; 18366; 18367; 18368; 18369; 18370; 18371; 18372; 18373; 18374; 18375; 18376; 18377; 18378; 18379; 18380; 18381; 18382; 18383; 18384; 18385; 18386; 18387; 18388; 18389; 18390; 18391; 18392; 18393; 18394; 18395; 18396; 18397; 18398; 18399; 18400; 18401; 18402; 18403; 18404; 18405; 18406; 18407; 18408; 18409; 18410; 18411; 18412; 18413; 18414; 18415; 18416; 18417; 18418; 18419; 18420; 18421; 18422; 18423; 18424; 18425; 18426; 18427; 18428; 18429; 18430; 18431; 18432; 18433; 18434; 18435; 18436; 18437; 18438; 18439; 18440; 18441; 18442; 18443; 18444; 18445; 18446; 18447; 18448; 18449; 18450; 18451; 18452; 18453; 18454; 18455; 18456; 18457; 18458; 18459; 18460; 18461; 18462; 18463; 18464; 18465; 18466; 18467; 18468; 18469; 18470; 18471; 18472; 18473; 18474; 18475; 18476; 18477; 18478; 18479; 18480; 18481; 18482; 18483; 18484; 18485; 18486; 18487; 18488; 18489; 18490; 18491; 18492; 18493; 18494; 18495; 18496; 18497; 18498; 18499; 18500; 18501; 18502; 18503; 18504; 18505; 18506; 18507; 18508; 18509; 18510; 18511; 18512; 18513; 18514; 18515; 18516; 18517; 18518; 18519; 18520; 18521; 18522; 18523; 18524; 18525; 18526; 18527; 18528; 18529; 18530; 18531; 18532; 18533; 18534; 18535; 18536; 18537; 18538; 18539; 18540; 18541; 18542; 18543; 18544; 18545; 18546; 18547; 18548; 18549; 18550; 18551; 18552; 18553; 18554; 18555 |
| 15915 | 199; 200; 201; 202; 203; 204 | 18556; 18557; 18558; 18559; 18560; 18561; 18562; 18563; 18564; 18565; 18566; 18567; 18568; 18569; 18570; 18571; 18572; 18573; 18574; 18575; 18576; 18577; 18578; 18579; 18580; 18581; 18582; 18583; 18584; 18585; 18586; 18587; 18588; 18589; 18590; 18591; 18592; 18593; 18594; 18595; 18596 |
| 15916 | 205; 201 | 18597; 18598; 18599; 18600; 18601; 18602; 18603; 18604; 18605; 18606; 18607; 18608 |
| 15917 | 4; 31; 6 | 18609; 18610; 18611; 18612; 18613; 18614; 18615; 18616; 18617; 18618; 18619 |
| 15918 | 206 | 18620; 18621; 18622; 18623 |
| 15919 | 4; 41; 31; 6 | 18624; 18625; 18626; 18627; 18628; 18629; 18630; 18631; 18632; 18633; 18634; 18635 |
| 15920 | 207; 208; 9 | 15920; 18636; 18637; 18638; 18639; 18640; 18641; 18642; 18643; 18644; 18645; 18646; 18647; 18648; 18649; 18650; 18651; 18652; 18653; 18654; 18655; 18656; 18657; 18658; 18659; 18660; 18661; 18662; 18663; 18664; 18665; 18666; 18667; 18668; 18669; 18670; 18671; 18672; 18673; 18674; 18675; 18676; 18677; 18678; 18679; 18680; 18681; 18682; 18683; 18684; 18685; 18686; 18687; 18688; 18689; 18690; 18691; 18692; 18693; 18694; 18695; 18696; 18697; 18698; 18699; 18700; 18701; 18702; 18703; 18704; 18705; 18706; 18707; 18708; 18709; 18710; 18711; 18712; 18713; 18714; 18715; 18716; 18717; 18718; 18719; 18720; 18721; 18722; 18723; 18724; 18725; 18726; 18727; 18728; 18729; 18730; 18731; 18732; 18733; 18734; 18735; 18736; 18737; 18738; 18739; 18740; 18741; 18742; 18743; 18744; 18745; 18746; 18747; 18748; 18749; 18750; 18751; 18752; 18753; 18754; 18755; 18756; 18757; 18758; 18759; 18760; 18761; 18762; 18763; 18764; 18765; 18766; 18767; 18768; 18769; 18770; 18771; 18772; 18773; 18774; 18775; 18776; 18777; 18778; 18779; 18780; 18781; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 18782; 18783; 18784; 18785; 18786; 18787; 18788; 18789; 18790; 18791; 18792; 18793; 18794; 18795; 18796; 18797; 18798; 18799; 18800; 18801; 18802; 18803; 18804; 18805; 18806; 18807; 18808; 18809; 18810; 18811; 18812; 18813; 18814; 18815; 18816; 18817; 18818; 18819; 18820; 18821; 18822; 18823; 18824; 18825; 18826; 18827; 18828; 18829; 18830; 18831; 18832; 18833; 18834; 18835; 18836; 18837; 18838; 18839; 18840; 18841; 18842; 18843; 18844; 18845; 18846; 18847; 18848; 18849; 18850; 18851; 18852; 18853; 18854; 18855; 18856; 18857; 18858; 18859; 18860; 18861; 18862; 18863; 18864; 18865; 18866; 18867; 18868; 18869; 18870; 18871; 18872; 18873; 18874; 18875; 18876; 18877; 18878; 18879; 18880; 18881; 18882; 18883; 18884; 18885; 18886; 18887; 18888; 18889; 18890; 18891; 18892; 18893; 18894; 18895; 18896; 18897; 18898; 18899; 18900; 18901; 18902; 18903; 18904; 18905; 18906; 18907; 18908; 18909; 18910; 18911; 18912; 18913; 18914; 18915; 18916; 18917; 18918; 18919; 18920; 18921; 18922; 18923; 18924; 18925; 18926; 18927; 18928; 18929; 18930; 18931; 18932; 18933; 18934; 18935; 18936; 18937; 18938; 18939; 18940; 18941; 18942; 18943; 18944; 18945; 18946; 18947; 18948; 18949; 18950; 18951; 18952; 18953; 18954; 18955; 18956; 18957; 18958; 18959; 18960; 18961; 18962; 18963; 18964; 18965; 18966; 18967; 18968; 18969; 18970; 18971; 18972; 18973; 18974; 18975; 18976; 18977; 18978; 18979; 18980; 18981; 18982; 18983; 18984; 18985; 18986; 18987; 18988; 18989; 18990; 18991; 18992; 18993; 18994; 18995; 18996; 18997; 18998; 18999 |
| 15922 | 209 | 19008 |
| 15923 | 210 | 19009 |
| 15924 | 211 | 19010; 19011; 19012; 19013; 19014; 19015; 19016 |
| 15925 | 212; 213 | 19017; 19018; 19019; 19020; 19021; 19022; 19023; 19024; 19025; 19026; 19027; 19028; 19029; 19030; 19031; 19032; 19033 |
| 15926 | 215; 216; 217 | 19034; 19035; 19036; 19037; 19038; 19039; 19040; 19041; 19042; 19043 |
| 15927 | 164; 218; 165; 166 | 19044; 19045; 19046; 19047; 19048; 19049; 19050; 19051; 19052; 19053; 19054; 19055; 19056; 19057 |
| 15928 | 220 | 19058; 19059; 19060; 19061; 19062; 19063; 19064 |
| 15931 | 222; 26 | 19065; 19066; 19067; 19068; 19069; 19070; 19071 |
| 15932 | 223 | 19072; 19073; 19074; 19075; 19076; 19077; 19078 |
| 15933 | 4; 31; 6 | 19079 |
| 15935 | 17; 225; 226 | 19080; 19081; 19082; 19083; 19084; 19085; 19086; 19087; 19088 |
| 15937 | 228; 9; 229 | 19089; 19090; 19091 |
| 15938 | 29; 4; 6 | 19092; 19093; 19094; 19095; 19096; 19097; 19098; 19099; 19100; 19101; 19102; 19103; 19104; 19105; 19106; 19107; 19108; 19109; 19110; 19111; 19112; 19113; 19114; 19115; 19116; 19117; 19118; 19119; 19120; 19121; 19122; 19123; 19124; 19125; 19126; 19127; 19128; 19129; 19130; 19131; 19132; 19133; 19134; 19135; 19136; 19137; 19138; 19139; 19140; 19141; 19142; 19143; 19144; 19145; 19146; 19147; 19148; 19149; 19150; 19151; 19152; 19153; 19154; 19155; 19156; 19157; 19158; 19159; 19160; 19161; 19162; 19163; 19164; 19165; 19166; 19167; 19168; 19169; 19170; 19171; 19172; 19173; 19174; 19175; 19176; 19177; 19178; 19179; 19180; 19181; 19182; 19183; 19184; 19185; 19186; 19187; 19188; 19189; 19190; 19191 |
| 15939 | 111; 9; 110; 233 | 19192; 19193; 19194; 19195; 19196; 19197; 19198; 19199; 19200; 19201; 19202; 19203; 19204; 19205; 19206; 19207; 19208; 19209; 19210; 19211; 19212; 19213; 19214; 19215; 19216; 19217; 19218; 19219; 19220; 19221; 19222; 19223; 19224; 19225; 19226; 19227; 19228; 19229; 19230; 19231; 19232; 19233; 19234; 19235; 19236; 19237; 19238; 19239; 19240; 19241; 19242; 19243; 19244; 19245; 19246; 19247; 19248; 19249; 19250; 19251; 19252; 19253; 19254; 19255; 19256; 19257; 19258; 19259; 19260; 19261; 19262; 19263; 19264; 19265; 19266; 19267; 19268; 19269; 19270; 19271; 19272; 19273; 19274; 19275; 19276; 19277; 19278; 19279; 19280; 19281; 19282; 19283; 19284; 19285; 19286; 19287; 19288; 19289; 19290; 19291; 19292; 19293; 19294; 19295; 19296; 19297; 19298; 19299; 19300; 19301; 19302; 19303; 19304; 19305; 19306; 19307; 19308; 19309; 19310; 19311; 19312; 19313; 19314; 19315; 19316; 19317; 19318; 19319; 19320; 19321; 19322; 19323; 19324; 19325; 19326; 19327; 19328; 19329; 19330; 19331; 19332; 19333; 19334; 19335; 19336; 19337; 19338; 19339; 19340; 19341; 19342; 19343; 19344; 19345; 19346; 19347 |
| 15941 | 192; 116; 148; 235; 75 | 19348; 19349; 19350 |
| 15943 | 238; 239 | 19351; 19352; 19353; 19354; 19355; 19356; 19357; 19358; 19359; 19360 |
| 15944 | 17; 240; 164; 241; 242; 243 | 19361; 19362 |
| 15945 | 244; 245; 246 | 19363; 19364; 19365; 19366; 19367; 19368; 19369; 19370; 19371; 19372; 23597 |
| 15946 | 247; 110; 248; 249; 9 | 19373; 19374; 19375; 19376; 19377 |
| 15947 | 250; 251; 252; 253; 254; 255; 142; 257 | 19378; 19379; 19380; 19381; 19382; 19383 |
| 15948 | 258 | 19384; 19385; 19386; 19387; 19388; 19389; 19390; 19391; 19392; 19393 |
| 15950 | 261; 148; 75 | 19394; 19395; 19396; 19397; 19398; 19399; 19400; 19401 |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| 15952 | 119; 121 | 19402 |
| 15953 | 240; 164; 268 | 19403; 19404 |
| 15954 | 17; 262; 263; 9; 264; 265; 266; 269 | 19405; 19406; 19407; 19408; 19409; 19410; 19411; 19412; 19413; 19414; 19415 |
| 15958 | 274; 275; 276 | 19416; 19417; 19418; 19419; 19420; 19421; 19422; 19423; 19424; 19425; 19426; 19427; 19428; 19429; 19430; 19431; 19432 |
| 15959 | 277; 26 | 19433; 19434; 19435; 19436; 19437; 19438; 19439; 19440; 19441 |
| 15960 | 279; 280 | 19442; 19443; 19444; 19445; 19446; 19447; 19448; 19449; 19450; 19451; 19452; 19453; 19454; 19455; 19456; 19457; 19458; 19459; 19460; 19461; 19462; 19463; 19464; 19465; 19466; 19467 |
| 15961 | 29; 4; 6; 31 | 19468; 19469; 19470; 19471; 19472; 19473 |
| 15964 | 281; 282; 284 | 19474; 19475; 19476; 19477; 19478; 19479; 19480; 19481; 19482; 19483; 19484; 19485; 19486 |
| 15965 | 285; 286 | 19487; 19488 |
| 15966 | 287; 288; 289 | 19489; 19490 |
| 15967 | 290; 291; 292 | 19491; 19492; 19493; 19494 |
| 15971 | 295; 296; 297; 298 | 19501; 19502; 19503; 19504; 19505; 19506; 19507; 19508; 19509; 19510; 19511; 19512; 19513; 19514; 19515; 19516; 19517; 19518; 19519; 19520; 19521; 19522; 19523; 19524; 19525; 19526; 19527; 19528; 19529; 19530; 19531; 19532; 19533; 19534; 19535; 19536; 19537; 19538; 19539; 19540; 19541; 19542; 19543; 19544; 19545; 19546; 19547; 19548; 19549; 19550; 19551; 19552; 19553; 19554; 19555; 19556; 19557; 19558; 19559; 19560; 19561; 19562; 19563; 19564; 19565; 19566; 19567; 19568; 19569; 19570; 19571; 19572; 19573; 19574; 19575; 19576; 19577; 19578; 19579; 19580; 19581 |
| 15972 | 299; 300 | 19582 |
| 15974 | 26; 302 | 19583; 19584 |
| 15979 | 306 | 19585; 19586; 19587; 19588; 19589; 19590; 19591; 19592 |
| 15982 | 310; 311; 312 | 19593 |
| 15983 | 313 | 19594; 19595; 19596; 19597 |
| 15986 | 119; 121 | 19598; 19599; 19600; 19601; 19602; 19603; 19604; 19605; 19606; 19607; 19608; 19609; 19610; 19611; 19612; 19613; 19614; 19615; 19616; 19617; 19618; 19619; 19620; 19621 |
| 15987 | 164; 315; 316 | 19622; 19623; 19624; 19625; 19626; 19627; 19628; 19629 |
| 15989 | 151; 152; 153 | 19630; 19631 |
| 15990 | 317 | 19632; 19633; 19634; 19635; 19636; 19637; 19638; 19639; 19640; 19641; 19642; 19643; 19644 |
| 15991 | 318; 319 | 19645; 19646; 19647; 19648; 19649; 19650; 19651; 19652; 19653 |
| 15992 | 201; 320 | 19654; 19655; 19656; 19657; 19658; 19659; 19660; 19661; 19662; 19663; 19664; 19665; 19666; 19667; 19668; 19669; 19670; 19671; 19672; 19673; 19674; 19675; 19676; 19677; 19678; 19679; 19680; 19681; 19682; 19683; 19684; 19685; 19686; 19687; 19688; 19689; 19690 |
| 15993 | 275; 321; 322 | 19691; 19692; 19693; 19694; 19695; 19696; 19697 |
| 15994 | 323 | 19698; 19699; 19700; 19701; 19702; 19703; 19704; 19705; 19706; 19707; 19708; 19709; 19710; 19711; 19712; 19713; 19714; 19715; 19716; 19717; 19718; 19719; 19720; 19721; 19722; 19723; 19724; 19725; 19726; 19727; 19728; 19729; 19730; 19731; 19732; 19733; 19734; 19735; 19736; 19737; 19738; 19739; 19740; 19741; 19742; 19743; 19744; 19745; 19746; 19747; 19748; 19749; 19750; 19751; 19752; 19753; 19754; 19755; 19756; 19757; 19758; 19759; 19760; 19761; 19762; 19763; 19764; 19765; 19766; 19767; 19768; 19769; 19770; 19771; 19772; 19773; 19774; 19775; 19776; 19777; 19778; 19779; 19780; 19781; 19782; 19783; 19784; 19785; 19786; 19787 |
| 15995 | 122 | 19788; 19789; 19790 |
| 15996 | 324; 325; 125 | 19791; 19792; 19793; 19794; 19795; 19796; 19797; 19798; 19799; 19800; 19801; 19802; 19803; 19804; 19805; 19806; 19807; 19808; 19809; 19810; 19811; 19812; 19813; 19814; 19815; 19816; 19817; 19818; 19819; 19820; 19821; 19822; 19823; 19824; 19825; 19826; 19827; 19828; 19829; 19830; 19831; 19832; 19833; 19834; 19835; 19836; 19837; 19838; 19839; 19840; 19841; 19842; 19843; 19844; 19845; 19846; 19847; 19848; 19849; 19850; 19851; 19852; 19853; 19854; 19855; 19856; 19857; 19858; 19859; 19860; 19861; 19862; 19863; 19864; 19865; 19866; 19867; 19868; 19869; 19870; 19871; 19872; 19873; 19874; 19875; 19876; 19877; 19878; 19879; 19880; 19881; 19882; 19883; 19884; 19885; 19886; 19887; 19888; 19889; 19890; 19891; 19892 |
| 15998 | 328 | 19893; 19894; 19895; 19896; 19897 |
| 16005 | 331 | 19898; 19899; 19900; 19901; 19902 |
| 16006 | 332 | 19903 |
| 16007 | 333; 334; 335; 336; 338; 339; 340; 341; 342; 343 | 19904; 19905; 19906; 19907; 19908; 19909; 19910; 19911; 19912; 19913; 19914; 19915; 19916; 23598; 23599; 23600; 23601 |
| 16008 | 344; 345 | 19917; 19918; 19919; 19920; 19921; 19922; 19923; 19924; 19925; 19926; 19927 |
| 16009 | 346 | 19928; 19929 |
| 16010 | 347; 348; 349 | 19930; 19931; 19932; 19933; 19934; 19935; 19936; 19937; 19938 |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| 16012 | 351; 9; 352 | 19940; 19941; 19942; 19943; 19944; 19945; 19946; 19947; 19948; 19949 |
| 16013 | 354 | 19950; 19951; 19952; 19953; 19954; 19955; 19956; 19957; 19958; 19959; 19960; 19961; 19962; 19963 |
| 16014 | 9; 10; 11; 355 | 19964; 19965; 19966; 19967; 19968; 19969 |
| 16015 | 193; 194 | 19970; 19971; 19972; 19973; 19974; 19975; 19976; 19977; 19978; 19979; 19980; 19981; 19982; 19983; 19984; 19985; 19986; 19987; 19988; 19989; 19990; 19991; 19992; 19993; 19994; 19995; 19996; 19997; 19998; 19999; 20000; 20001; 20002; 20003; 20004; 20005; 20006; 20007; 20008; 20009; 20010; 20011; 20012; 20013 |
| 16017 | 357; 358; 359; 360 | 20014; 20015; 20016; 20017; 20018; 20019; 20020; 20021; 20022; 20023; 20024; 20025; 20026; 20027; 20028; 20029; 20030; 20031; 20032; 20033; 20034; 20035; 20036; 20037; 20038; 20039; 20040; 20041; 20042; 20043; 20044; 20045; 20046; 20047; 20048; 20049; 20050; 20051; 20052; 20053; 20054; 20055; 20056; 20057; 20058; 20059; 20060; 20061; 20062; 20063; 20064; 20065; 20066; 20067; 20068; 20069; 20070; 20071; 20072; 20073; 20074; 20075; 20076; 20077; 20078; 20079; 20080; 20081; 20082; 20083; 20084; 20085; 20086; 20087; 20088; 20089; 20090; 20091; 20092; 20093; 20094; 20095; 20096; 20097; 20098; 20099; 20100; 20101; 20102; 20103; 20104; 20105; 20106; 20107; 20108; 20109; 20110; 20111; 20112; 20113; 20114; 20115; 20116; 20117; 20118; 20119; 20120; 20121; 20122; 20123; 20124; 20125; 20126; 20127; 20128; 20129; 20130; 20131; 20132; 20133; 20134; 20135; 20136; 20137; 20138; 20139; 20140; 20141; 20142; 20143; 20144; 20145; 20146; 20147; 20148; 20149; 20150; 20151; 20152; 20153; 20154; 20155; 20156; 20157; 20158; 20159; 20160; 20161; 20162; 20163; 20164; 20165; 20166; 20167; 20168; 20169; 20170; 20171; 20172; 20173; 20174; 20175; 20176; 20177; 20178; 20179; 20180; 20181; 20182; 20183; 20184; 20185; 20186; 20187; 20188; 20189; 20190; 20191; 20192; 20193; 20194; 20195; 20196; 20197; 20198; 20199; 20200; 20201; 20202; 20203; 20204; 20205; 20206; 20207; 20208; 20209; 20210; 20211; 20212; 20213; 20214; 20215; 20216; 20217; 20218; 20219; 20220; 20221; 20222; 20223; 20224; 20225; 20226; 20227; 20228; 20229; 20230; 20231; 20232; 20233; 20234; 20235; 20236; 20237; 20238; 20239; 20240; 20241; 20242; 20243; 20244; 20245; 20246; 20247; 20248; 20249; 20250; 20251; 20252; 20253; 20254; 20255; 20256; 20257; 20258; 20259; 20260; 20261; 20262; 20263; 20264; 20265; 20266; 20267; 20268; 20269; 20270; 20271; 20272; 20273; 20274; 20275; 20276; 20277; 20278; 20279; 20280; 20281; 20282; 20283; 20284; 20285; 20286; 20287; 20288; 20289; 20290; 20291; 20292; 20293; 20294; 20295; 20296; 20297; 20298; 20299; 20300; 20301; 20302; 20303; 20304; 20305; 20306; 20307; 20308; 20309; 20310; 20311; 20312; 20313; 20314; 20315; 20316; 20317; 20318; 20319; 20320; 20321; 20322; 20323; 20324; 20325; 20326; 20327; 20328; 20329; 20330; 20331; 20332; 20333; 20334; 20335; 20336; 20337; 20338; 20339; 20340; 20341; 20342; 23602; 23603; 23604; 23605 |
| 16021 | 371; 372 | 20343; 20344; 20345; 20346; 20347; 20348; 20349; 20350; 20351 |
| 16022 | 373; 374; 376; 377; 378; 139; 345 | 20352; 20353; 20354; 20355; 20356; 20357; 20358; 20359; 20360; 20361; 20362 |
| 16023 | 379; 247; 380 | 20363; 20364; 20365; 20366; 20367; 20368; 20369 |
| 16024 | 272; 273 | 20370; 20371; 20372; 20373 |
| 16025 | 381; 382 | 20374; 20375; 20376; 20377; 20378; 20379; 20380 |
| 16026 | 220 | 20381; 20382 |
| 16027 | 383; 384 | 20383; 20384; 20385; 20386 |
| 16029 | 387 | 20387; 20388 |
| 16030 | 28; 76; 388; 389; 390 | 20389; 20390 |
| 16031 | 391; 392; 393 | 20391; 20392; 20393; 20394; 20395; 20396; 20397; 20398 |
| 16032 | 394; 110; 179; 395; 9; 396; 345 | 20399; 20400; 20401 |
| 16033 | 228; 9; 229 | 20402; 20403; 20404; 20405; 20406; 20407; 20408 |
| 16034 | 157 | 20409 |
| 16035 | 397 | 20410; 20411; 20412; 20413; 20414; 20415; 20416; 20417; 20418; 20419; 20420; 20421; 20422; 20423; 20424; 20425; 20426; 20427 |
| 16036 | 29; 4; 148; 75; 31; 6 | 20428; 20429; 20430; 20431; 20432; 20433 |
| 16037 | 398; 179; 399; 9; 110; 400; 401; 402; 403 | 20434; 20435; 20436; 20437; 20438; 20439 |
| 16038 | 404 | 20440; 20441 |
| 16039 | 33; 34 | 16039; 20442; 20443; 20444; 20445; 20446; 20447; 20448; 20449; 20450; 20451; 20452; 20453; 20454; 20455; 20456; 20457; 20458; 20459; 20460; 20461; 20462; 20463; 20464; 20465; 20466; 20467; 20468; 20469; 20470; 20471; 20472; 20473; 20474; 20475; 20476; 20477; 20478; 20479; 20480; 20481; 20482; 20483; 20484; 20485; 20486; 20487; 20488; 20489; 20490; 20491; 20492; 20493; 20494; 20495; 20496; 20497; 20498; 20499; 20500; 20501; 20502; 20503; 20504; 20505; 20506; 20507; 20508; 20509; 20510; 20511; 20512; 20513; 20514; 20515; 20516; 20517; 20518; 20519; 20520; 20521; 20522; 20523; 20524; 20525; 20526; 20527; 20528; 20529; 20530; 20531; 20532; 20533; 20534; 20535; 20536; 20537; 20538; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 20539; 20540; 20541; 20542; 20543; 20544; 20545; 20546; 20547; 20548; 20549; 20550; 20551; 20552; 20553; 20554; 20555; 20556; 20557; 20558; 20559; 20560; 20561; 20562; 20563; 20564; 20565; 20566; 20567; 20568; 20569; 20570; 20571; 20572; 20573; 20574; 20575; 20576; 20577; 20578; 20579; 20580; 20581; 20582; 20583; 20584; 20585; 20586; 20587; 20588; 20589; 20590; 20591; 20592; 20593; 20594; 20595; 20596; 20597; 20598; 20599; 20600; 20601; 20602; 20603; 20604; 20605; 20606; 20607; 20608; 20609; 20610; 20611; 20612; 20613; 20614; 20615; 20616; 20617; 20618; 20619; 20620; 20621; 20622; 20623; 20624; 20625; 20626; 20627; 20628; 20629; 20630; 20631; 20632; 20633; 20634; 20635; 20636; 20637 |
| 16040 | 405 | 20638; 20639; 20640; 20641; 20642; 20643; 20644; 20645; 20646; 20647; 20648; 20649; 20650; 20651; 20652; 20653; 20654; 20655; 20656; 20657; 20658; 20659; 20660; 20661; 20662; 20663; 20664; 20665; 20666; 20667; 20668; 20669; 20670; 20671; 20672; 20673; 20674; 20675; 20676; 20677; 20678; 20679; 20680; 20681; 20682; 20683; 20684; 20685; 20686; 20687; 20688; 20689; 20690; 20691; 20692; 20693; 20694; 20695; 20696; 20697; 20698; 20699; 20700; 20701; 20702; 20703; 20704; 20705; 20706; 20707; 20708; 20709; 20710; 20711; 20712; 20713; 20714; 20715; 20716; 20717; 20718; 20719; 20720; 20721; 20722; 20723; 20724; 20725; 20726; 20727; 20728; 20729; 20730; 20731; 20732; 20733; 20734; 20735; 20736; 20737; 20738; 20739; 20740; 20741; 20742; 20743; 20744; 20745; 20746; 20747; 20748; 20749; 20750; 20751; 20752; 20753; 20754; 20755; 20756; 20757; 20758; 20759; 20760; 20761; 20762; 20763; 20764; 20765; 20766; 20767; 20768; 20769; 20770; 20771; 20772; 20773; 20774; 20775; 20776; 20777; 20778; 20779; 20780; 20781; 20782; 20783; 20784; 20785; 20786; 20787; 20788; 20789; 20790; 20791; 20792; 20793; 20794; 20795; 20796; 20797; 20798; 20799; 20800; 20801; 20802; 20803; 20804; 20805; 20806; 20807; 20808; 20809; 20810; 20811; 20812; 20813; 20814; 20815; 20816; 20817; 20818; 20819; 20820; 20821; 20822; 20823; 20824; 20825; 20826; 20827; 20828; 20829; 20830; 20831; 20832; 20833; 20834; 20835; 20836; 20837; 20838; 20839; 20840; 20841; 20842; 20843; 20844; 20845; 20846; 20847; 20848; 20849; 20850; 20851; 20852; 20853; 20854; 20855; 20856; 20857; 20858; 20859; 20860; 20861; 20862; 20863; 20864; 20865; 20866; 20867; 20868; 20869; 20870; 20871; 20872; 20873; 20874; 20875; 20876; 20877; 20878; 20879; 20880; 20881; 20882; 20883; 20884; 20885; 20886; 20887; 20888; 20889; 20890; 20891; 20892; 20893; 20894; 20895; 20896; 20897; 20898; 20899; 20900; 20901; 20902; 20903; 20904; 20905; 20906; 20907; 20908; 20909; 20910; 20911; 20912; 20913; 20914; 20915; 20916; 20917; 20918; 20919; 20920; 20921; 20922; 20923; 20924; 20925; 20926; 20927; 20928; 20929; 20930; 20931; 20932; 20933; 20934; 20935; 20936; 20937; 20938; 20939; 20940; 20941; 20942; 20943; 20944; 20945; 20946; 20947; 20948; 20949; 20950; 20951; 20952; 20953; 20954; 20955; 20956; 20957; 20958; 20959; 20960; 20961; 20962; 20963; 20964; 20965; 20966; 20967; 20968; 20969; 20970; 20971; 20972; 20973; 20974; 20975; 20976; 20977; 20978; 20979; 20980; 20981; 20982; 20983; 20984; 20985; 20986; 20987; 20988; 20989; 20990; 20991; 20992; 20993; 20994; 20995; 20996; 20997; 20998; 20999; 21000; 21001; 21002; 21003; 21004; 21005; 21006; 21007; 21008; 21009; 21010; 21011; 21012; 21013; 21014; 21015; 21016; 21017; 21018; 21019; 21020; 21021; 21022; 21023; 21024; 21025; 21026; 21027; 21028; 21029; 21030; 21031; 21032; 21033; 21034; 21035; 21036; 21037; 21038; 21039; 21040; 21041; 21042; 21043; 21044; 21045; 21046; 21047; 21048; 21049; 21050; 21051; 21052; 21053; 21054; 21055; 21056; 21057; 21058; 21059; 21060; 21061; 21062; 21063; 21064; 21065; 21066; 21067; 21068; 21069; 21070; 21071; 21072; 21073; 21074; 21075; 21076; 21077; 21078; 21079; 21080; 21081; 21082; 21083; 21084; 21085; 21086; 21087; 21088; 21089; 21090; 21091; 21092; 21093; 21094; 21095; 21096; 21097; 21098; 21099; 21100; 21101; 21102; 21103; 21104; 21105; 21106; 21107; 21108; 21109; 21110; 21111; 21112; 21113; 21114; 21115 |
| 16041 | 148; 75 | 21116; 21117; 21118; 21119; 21120; 21121 |
| 16042 | 247; 406; 407; 408 | 21122; 21123; 21124; 21125; 21126; 21127; 21128; 21129; 21130; 21131; 21132; 21133; 21134; 21135; 21136; 21137; 21138; 21139; 21140; 21141; 21142; 21143; 21144; 21145; 21146; 21147; 21148; 21149; 21150; 21151; 21152; 21153; 21154; 21155; 21156; 21157; 21158; 21159; 21160; 21161; 21162; 21163; 21164; 21165; 21166; 21167; 21168; 21169; 21170; 21171; 21172; 21173; 21174; 21175; 21176; 21177; 21178; 21179; 21180; 21181; 21182; 21183; 21184; 21185; 21186; 21187; 21188; 21189; 21190; 21191; 21192; 21193; 21194; 21195; 21196; 21197; 21198; 21199; 21200; 21201; 21202; 21203; 21204; 21205; 21206; 21207; 21208; 21209; 21210; 21211; 21212; 21213; 21214; 21215; 21216; 21217; 21218; 21219; 21220; 21221; 21222; 21223; 21224; 21225; 21226; 21227; 21228; 21229; 21230; 21231; 21232; 21233; 21234; 21235; 21236; 21237; 21238; 21239; 21240; 21241; 21242; 21243; 21244; 21245; 21246; 21247; 21248; 21249; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 21250; 21251; 21252; 21253; 21254; 21255; 21256; 21257; 21258; 21259; 21260; 21261; 21262; 21263; 21264; 21265; 21266; 21267; 21268; 21269; 21270; 21271; 21272; 21273; 21274; 21275; 21276; 21277; 21278; 21279; 21280; 21281; 21282; 21283; 21284; 21285; 21286; 21287; 21288; 21289; 21290; 21291; 21292; 21293; 21294; 21295; 21296; 21297; 21298; 21299; 21300; 21301; 21302; 21303; 21304 |
| 16043 | 409; 410; 411; 412 | 16075; 21305; 21306; 21307; 21308; 21309; 21310; 21311; 21312; 21313; 21314; 21315; 21316; 21317; 21318; 21319; 21320; 21321; 21322; 21323; 21324; 21325; 21326; 21327; 21328 |
| 16044 | 17; 414; 415; 416; 417; 418; 419; 420 | 21329; 21330; 21331; 21332; 21333; 21334 |
| 16045 | 421; 422; 9; 207; 425; 426; 427 | 21335; 21336; 21337; 21338; 21339; 21340; 21341; 21342; 21343; 21344; 21345; 21346; 21347; 21348; 21349; 21350; 21351; 21352; 21353; 21354; 21355; 21356; 21357; 21358; 21359; 21360; 21361; 21362; 21363; 21364; 21365; 21366; 21367; 21368; 21369; 21370; 21371; 21372; 21373; 21374; 21375; 21376; 21377; 21378; 21379; 21380; 21381; 21382; 21383; 21384; 21385; 21386; 21387; 21388; 21389; 21390; 21391; 21392; 21393; 21394; 21395; 21396; 21397; 21398; 21399; 21400; 21401; 21402; 21403; 21404; 21405; 21406; 21407; 21408; 21409; 21410; 21411; 21412; 21413; 21414; 21415; 21416; 21417; 21418; 21419; 21420; 21421; 21422; 21423; 21424; 21425; 21426; 21427; 21428; 21429; 21430; 21431; 21432; 21433; 21434; 21435; 21436; 21437; 21438; 21439; 21440; 21441; 21442; 21443; 21444; 21445; 21446 |
| 16046 | 428; 70; 71; 170; 429; 430 | 21447; 21448; 21449; 21450; 21451; 21452; 21453; 21454 |
| 16047 | 70; 428; 71; 170; 431; 429 | 21455; 21456; 21457; 21458; 21459; 21460; 21461; 21462 |
| 16048 | 432; 433; 435; 9; 437 | 21463; 21464; 21465; 21466; 21467; 21468; 21469; 21470; 21471; 21472; 21473; 21474; 21475; 21476; 21477; 21478; 21479; 21480; 21481; 21482; 21483; 21484; 21485; 21486; 21487; 21488; 21489; 21490; 21491; 21492; 21493; 21494; 21495; 21496; 21497; 21498; 21499; 21500; 21501; 21502; 21503; 21504; 21505; 21506; 21507; 21508; 21509; 21510; 21511; 21512; 21513; 21514; 21515; 21516; 21517; 21518; 21519; 21520; 21521; 21522; 21523; 21524; 21525; 21526; 21527; 21528; 21529; 21530; 21531; 21532; 21533; 21534; 21535; 21536; 21537; 21538; 21539; 21540; 21541; 21542; 21543; 21544; 21545; 21546; 21547; 21548; 21549; 21550; 21551; 21552; 21553; 21554; 21555; 21556; 21557; 21558; 21559; 21560; 21561; 21562; 21563; 21564; 21565; 21566; 21567; 21568; 21569 |
| 16049 | 438; 439 | 21570; 21571; 21572; 21573; 21574; 21575 |
| 16050 | 440; 26; 441; 442; 443; 444 | 21576; 21577; 21578; 21579; 21580; 21581; 21582; 21583 |
| 16051 | 81; 82; 83; 84; 85 | 21584; 21585; 21586; 21587; 21588; 21589; 21590 |
| 16052 | 445 | 21591; 21592; 21593; 21594 |
| 16053 | 446 | 21595; 21596; 21597; 21598; 21599; 21600; 21601; 21602 |
| 16054 | 228; 447; 9; 229 | 21603; 21604; 21605; 21606; 21607; 21608; 21609; 21610; 21611; 21612; 21613; 21614; 21615; 21616; 21617; 21618; 21619; 21620; 21621; 21622 |
| 16056 | 201 | 21631; 21632; 21633; 21634; 21635; 21636; 21637; 21638; 21639; 21640; 21641; 21642; 21643; 21644; 21645; 21646; 21647; 21648; 21649; 21650; 21651; 21652; 21653; 21654; 21655; 21656; 21657; 21658; 21659; 21660; 21661; 21662; 21663; 21664; 21665; 21666; 21667; 21668; 21669; 21670; 21671; 21672; 21673; 21674; 21675; 21676; 21677; 21678; 21679; 21680; 21681; 21682; 21683; 21684; 21685; 21686; 21687; 21688; 21689; 21690; 21691; 21692; 21693; 21694; 21695; 21696; 21697; 21698; 21699; 21700; 21701; 21702; 21703; 21704; 21705; 21706; 21707; 21708; 21709; 21710; 21711; 21712; 21713; 21714; 21715; 21716; 21717; 21718; 21719; 21720; 21721 |
| 16057 | 29; 4; 31; 6 | 21722; 21723; 21724; 21725; 21726; 21727; 21728; 21729; 21730; 21731; 21732; 21733; 21734; 21735; 21736; 21737; 21738; 21739; 21740; 21741; 21742; 21743; 21744; 21745; 21746; 21747; 21748; 21749; 21750; 21751; 21752; 21753; 21754; 21755; 21756; 21757; 21758; 21759; 21760; 21761; 21762; 21763; 21764; 21765; 21766; 21767; 21768; 21769; 21770; 21771; 21772; 21773; 21774; 21775; 21776; 21777; 21778; 21779; 21780; 21781; 21782; 21783; 21784; 21785; 21786; 21787; 21788; 21789; 21790; 21791; 21792; 21793; 21794; 21795; 21796; 21797; 21798; 21799; 21800; 21801; 21802; 21803; 21804; 21805; 21806; 21807; 21808; 21809; 21810; 21811; 21812; 21813; 21814; 21815; 21816; 21817; 21818; 21819; 21820; 21821; 21822; 21823; 21824; 21825; 21826; 21827; 21828; 21829; 21830; 21831; 21832; 21833; 21834 |
| 16058 | 449; 62; 450; 451 | 21835; 21836; 21837; 21838; 21839; 21840; 21841; 21842; 21843; 21844; 21845; 21846; 21847; 21848; 21849; 21850; 21851; 21852; 21853; 21854; 21855; 21856; 21857; 21858; 21859; 21860; 21861; 21862; 21863; 21864; 21865; 21866; 21867; 21868; 21869; 21870; 21871 |
| 16059 | 452; 453; 9 | 21872; 21873; 21874; 21875; 21876 |
| 16060 | 247; 454; 17; 455; 414 | 21877 |
| 16061 | 23; 456; 457 | 21878; 21879; 21880; 21881; 21882; 21883; 21884; 21885; 21886; 21887; 21888; 21889; 21890; 21891; 21892 |
| 16062 | 1; 3; 2 | 21893; 21894; 21895; 21896; 21897; 21898; 21899; 21900; 21901 |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| 16063 | 458; 459; 460; 461 | 21902; 21903; 21904; 21905; 21906; 21907; 21908; 21909; 21910; 21911; 21912; 21913; 21914; 21915; 21916; 21917; 21918; 21919; 21920; 21921; 21922; 21923; 21924; 21925; 21926; 21927; 21928; 21929; 21930; 21931; 21932; 21933; 21934; 21935; 21936; 21937; 21938; 21939; 21940; 21941; 21942; 21943; 21944; 21945; 21946; 21947; 21948; 21949; 21950; 21951; 21952; 21953; 21954; 21955; 21956; 21957; 21958; 21959; 21960; 21961; 21962; 21963; 21964; 21965; 21966; 21967; 21968; 21969; 21970; 21971; 21972; 21973; 21974; 21975; 21976; 21977; 21978; 21979; 21980; 21981; 21982; 21983; 21984; 21985; 21986; 21987; 21988; 21989; 21990; 21991; 21992; 21993; 21994; 21995; 21996; 21997; 21998; 21999; 22000; 23606; 23607 |
| 16064 | 77; 115; 116 | 22001; 22002; 22003 |
| 16065 | 462; 70; 428; 170; 71 | 22004; 22005; 22006; 22007; 22008; 22009; 22010; 22011 |
| 16066 | 347; 348; 349; 463 | 22012; 22013; 22014; 22015; 22016; 22017; 22018; 22019 |
| 16067 | 464 | 22020; 22021; 22022 |
| 16068 | 465 | 22023; 22024; 22025; 22026; 22027 |
| 16069 | 466; 467 | 22028; 22029; 22030 |
| 16070 | 468; 469 | 22031; 22032; 22033 |
| 16071 | 470; 471; 472; 473; 474; 475; 476 | 22034; 22035; 22036; 22037; 22038; 22039; 22040; 22041; 22042; 22043; 22044; 22045; 22046; 22047; 22048; 22049; 22050; 22051; 22052; 22053; 22054; 22055; 22056; 22057; 22058; 22059; 22060; 22061; 22062; 22063; 22064; 22065; 22066; 22067; 22068; 22069; 22070 |
| 16072 | 477; 478; 479; 480; 481 | 22071; 22072; 22073; 22074; 22075; 22076; 22077; 22078 |
| 16073 | 201; 320 | 22079; 22080; 22081; 22082; 22083; 22084; 22085; 22086; 22087; 22088; 22089; 22090; 22091; 22092; 22093; 22094; 22095; 22096; 22097; 22098; 22099; 22100; 22101; 22102; 22103; 22104; 22105; 22106; 22107; 22108; 22109; 22110; 22111; 22112; 22113; 22114; 22115; 22116; 22117; 22118; 22119; 22120; 22121; 22122; 22123; 22124; 22125; 22126; 22127; 22128; 22129; 22130; 22131; 22132; 22133; 22134; 22135; 22136; 22137; 22138; 22139; 22140; 22141; 22142; 22143; 22144; 22145; 22146; 22147; 22148; 22149; 22150; 22151; 22152; 22153 |
| 16074 | 200 | 22154; 22155; 22156; 22157; 22158; 22159; 22160; 22161 |
| 16078 | 258; 259 | 22162; 22163; 22164; 22165; 22166; 22167; 22168 |
| 16079 | 489; 490; 491 | 22169; 22170; 22171; 22172; 22173; 22174; 22175; 22176; 22177; 22178; 22179; 22180; 22181; 22182; 22183; 22184; 22185; 22186; 22187; 22188; 22189; 22190; 22191; 22192; 22193; 22194; 22195; 22196; 22197; 22198; 22199; 22200; 22201; 22202; 22203; 22204; 22205; 22206; 22207; 22208; 22209; 22210; 22211; 22212; 22213; 22214; 22215; 22216; 22217; 22218; 22219; 22220; 22221; 22222; 22223; 22224; 22225; 22226; 22227; 22228; 22229; 22230; 22231; 22232; 22233; 22234; 22235; 22236; 22237; 22238; 22239; 22240; 22241; 22242; 22243; 22244; 22245; 22246; 22247; 22248; 22249; 22250; 22251; 22252; 22253; 22254; 22255; 22256; 22257; 22258; 22259; 22260; 22261; 22262; 22263; 22264; 22265; 22266; 22267; 22268; 22269; 22270; 22271; 22272; 22273; 22274; 22275; 22276; 22277; 22278; 22279; 22280; 22281; 22282; 22283; 22284; 22285; 22286; 22287; 22288; 22289; 22290; 22291; 22292; 22293; 22294; 22295; 22296; 22297; 22298; 22299; 22300; 22301; 22302; 22303; 22304; 22305; 22306; 22307; 22308; 22309; 22310; 22311; 22312; 22313; 22314; 22315; 22316; 22317; 22318; 22319; 22320; 22321; 22322; 22323; 22324; 22325; 22326; 22327; 22328; 22329; 22330; 22331; 22332; 22333; 22334; 22335; 22336; 22337; 22338; 22339; 22340; 22341; 22342; 22343; 22344; 22345; 22346; 22347; 22348; 22349; 22350; 22351; 22352; 22353; 22354; 22355; 22356; 22357; 22358; 22359; 22360; 22361; 22362; 22363; 22364; 22365; 22366; 22367; 22368; 22369; 22370; 22371; 22372; 22373; 22374; 22375; 22376; 22377; 22378; 22379; 22380; 22381; 22382; 22383; 22384; 22385; 22386; 22387; 22388; 22389; 22390; 22391 |
| 16080 | 70 | 22392; 22393; 22394 |
| 16081 | 384 | 22395 |
| 16083 | 492; 493 | 22396; 22397 |
| 16086 | 103; 495; 496; 304; 106 | 22398; 22399; 22400; 22401; 22402; 22403; 22404; 22405; 22406; 22407; 22408; 22409; 22410 |
| 16087 | 497; 498; 499 | 22411; 22412; 22413 |
| 16088 | 99; 101; 9 | 22414 |
| 16089 | 384 | 22415; 22416 |
| 16090 | 500; 87 | 22417; 22418; 22419; 22420; 22421; 22422; 22423; 22424; 22425; 22426; 22427; 22428; 22429; 22430; 22431; 22432; 22433; 22434; 22435; 22436; 22437; 22438; 22439; 22440; 22441; 22442; 22443; 22444; 22445; 22446; 22447; 22448; 22449; 22450; 22451; 22452; 22453; 22454; 22455; 22456; 22457; 22458; 22459; 22460; 22461; 22462; 22463; 22464; 22465; 22466; 22467; 22468; 22469; 22470; 22471; 22472; 22473; 22474; 22475; 22476 |
| 16091 | 501; 502; 503; 504; 505; 506 | 22477; 22478; 22479; 22480; 22481; 22482; 22483; 22484; 22485; 22486; 22487; 22488; 22489; 22490; 22491; 22492; 22493; 22494; 22495; 22496; 22497; 22498; 22499; 22500; 22501; 22502; 22503; 22504; 22505; 22506; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 22507; 22508; 22509; 22510; 22511; 22512; 22513; 22514; 22515; 22516; 22517; 22518; 22519; 22520; 22521; 22522; 22523; 22524; 22525; 22526; 22527; 22528; 22529; 22530; 22531; 22532; 22533; 22534; 22535; 22536; 22537; 22538; 22539; 22540; 22541; 22542; 22543; 22544; 22545; 22546; 22547; 22548; 22549; 22550; 22551; 22552; 22553; 22554; 22555; 22556; 22557; 22558; 22559; 22560; 22561; 22562; 22563; 22564; 22565; 22566; 22567; 22568; 22569; 22570; 22571; 22572; 22573; 22574; 22575; 22576; 22577; 22578; 22579; 22580; 22581; 22582; 22583; 22584; 22585; 22586; 22587; 22588; 22589; 22590; 22591; 22592; 22593; 22594; 22595; 22596; 22597; 22598; 22599; 22600; 22601; 22602; 22603; 22604; 22605; 22606; 22607; 22608; 22609; 22610; 22611; 22612; 22613; 22614; 22615; 22616; 22617; 22618; 22619; 22620; 22621; 22622; 22623; 22624; 22625; 22626; 22627; 22628; 22629; 22630; 22631; 22632; 22633; 22634; 22635; 22636; 22637; 22638; 22639; 22640; 22641; 22642; 22643 |
| 16092 | 508; 509; 510 | 22644; 22645; 22646; 22647; 22648; 22649 |
| 16093 | 511; 125 | 22650; 22651; 22652; 22653; 22654; 22655; 22656; 22657; 22658; 22659; 22660; 22661; 22662; 22663; 22664; 22665; 22666; 22667; 22668; 22669; 22670; 22671; 22672; 22673; 22674; 22675; 22676; 22677 |
| 16095 | 513; 514 | 22678; 22679; 22680; 22681; 22682; 22683; 22684; 22685; 22686; 22687; 22688; 22689 |
| 16096 | 515; 516; 517 | 22690; 22691; 22692; 22693; 22694; 22695; 22696; 22697; 22698; 22699; 22700; 22701; 22702; 22703; 22704; 22705; 22706; 22707; 22708; 22709; 22710; 22711; 22712; 22713; 22714; 22715; 22716; 22717; 22718; 22719; 22720; 22721; 22722; 22723; 22724; 22725; 22726; 22727; 22728; 22729; 22730; 22731; 22732; 22733; 22734; 22735; 22736; 22737; 22738; 22739; 22740; 22741; 22742; 22743; 22744; 22745; 22746; 22747; 22748; 22749; 22750; 22751; 22752; 22753; 22754; 22755; 22756; 22757; 22758; 22759; 22760; 22761; 22762; 22763; 22764; 22765; 22766; 22767; 22768; 22769; 22770; 22771; 22772; 22773; 22774; 22775; 22776; 22777; 22778; 22779; 22780; 22781; 22782; 22783; 22784; 22785; 22786; 22787; 22788; 22789; 22790; 22791; 22792; 22793; 22794; 22795; 22796; 22797; 22798; 22799; 22800; 22801; 22802; 22803; 22804; 22805; 22806; 22807; 22808; 22809; 22810; 22811; 22812; 22813; 22814; 22815; 22816; 22817; 22818; 22819; 22820; 22821; 22822; 22823; 22824; 22825; 22826; 22827; 22828; 22829; 22830; 22831; 22832; 22833; 22834; 22835; 22836; 22837; 22838; 22839; 22840; 22841; 22842; 22843; 22844; 22845; 22846; 22847; 22848; 22849; 22850; 22851; 22852; 22853; 22854; 22855; 22856; 22857; 22858; 22859; 22860; 22861; 22862; 22863; 22864; 22865; 22866; 22867; 22868; 22869; 22870; 22871; 22872; 22873; 22874; 22875; 22876; 22877; 22878; 22879; 22880; 22881; 22882; 22883; 22884; 22885; 22886; 22887; 22888; 22889; 22890; 22891; 22892; 22893; 22894; 22895; 22896; 22897; 22898; 22899; 22900; 22901; 22902; 22903; 22904; 22905; 22906; 22907; 22908; 22909; 22910; 22911; 22912; 22913; 22914; 22915; 22916; 22917; 22918; 22919; 22920; 22921; 22922; 22923; 22924; 22925; 22926; 22927; 22928; 22929; 22930; 22931; 22932; 22933; 22934; 22935; 22936; 22937; 22938; 22939; 22940; 22941; 22942; 22943; 22944; 22945; 22946; 22947; 22948; 22949; 22950; 22951; 22952; 22953; 22954; 22955; 22956; 22957; 22958; 22959; 22960; 22961; 22962; 22963; 22964; 22965; 22966; 22967; 22968; 22969; 22970; 22971; 22972; 22973; 22974; 22975; 22976; 22977; 22978; 22979; 22980; 22981; 22982; 22983; 22984; 22985; 22986; 22987; 22988; 22989; 22990; 22991; 22992; 22993; 22994; 22995; 22996; 22997; 22998; 22999; 23000; 23001; 23002; 23003; 23004; 23005; 23006; 23007; 23008; 23009; 23010; 23011; 23012; 23013; 23014; 23015; 23016; 23017; 23018; 23019; 23020; 23021; 23022; 23023 |
| 16097 | 29; 4; 31; 6 | 23024; 23025; 23026; 23027; 23028; 23029; 23030; 23031; 23032; 23033; 23034; 23035; 23036; 23037; 23038; 23039; 23040; 23041; 23042; 23043; 23044; 23045; 23046; 23047; 23048; 23049; 23050; 23051; 23052; 23053; 23054; 23055; 23056; 23057; 23058; 23059; 23060; 23061; 23062; 23063; 23064; 23065; 23066; 23067; 23068; 23069; 23070; 23071; 23072; 23073; 23074; 23075; 23076; 23077; 23078; 23079; 23080; 23081; 23082; 23083; 23084; 23085; 23086; 23608; 23609; 23610; 23611; 23612 |
| 16098 | 107; 108 | 23087; 23088 |
| 16099 | 144; 145; 146 | 23089; 23090; 23091 |
| 16101 | 148; 183; 184; 75; 185 | 23092; 23093 |
| 16106 | 9; 518 | 23095 |
| 16113 | 318; 319 | 23096; 23097; 23098; 23099; 23100; 23101; 23102; 23103; 23104; 23105; 23106; 23107; 23108; 23109; 23110; 23111; 23112 |
| 16119 | 17; 414; 416; 415; 418; 417; 419; 420 | 23113 |
| 16122 | 28; 29; 4; 30; 31; 6 | 23114; 23115; 23116; 23117 |
| 16123 | 55 | 23118; 23119; 23120; 23121; 23122; 23123; 23124; 23125; 23126 |
| 16124 | 79; 80 | 23127; 23128; 23129; 23130 |
| 16126 | 86; 87; 88; 89 | 23131; 23132; 23133 |
| 16127 | 107; 108 | 23134; 23135; 23136; 23137; 23138; 23139; 23140; 23141 |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| 16128 | 118 | 23142; 23143; 23144 |
| 16132 | 130; 131 | 23176; 23177 |
| 16135 | 147; 148; 75 | 23178; 23179; 23180; 23181; 23182; 23183; 23184; 23185; 23186; 23187; 23188; 23189 |
| 16136 | 103; 106 | 23190; 23191; 23192; 23193; 23194; 23195 |
| 16139 | 195; 116 | 23196; 23197; 23198; 23199; 23200; 23201; 23202; 23203; 23204; 23205; 23206; 23207; 23208; 23209; 23210; 23211; 23212; 23213; 23214; 23215; 23216; 23217; 23218 |
| 16140 | 211 | 23219; 23220; 23221; 23222 |
| 16141 | 215; 214; 216; 217 | 23223 |
| 16142 | 221 | 23224; 23225; 23226; 23227; 23228; 23229; 23230; 23231 |
| 16143 | 228; 9; 229 | 23232; 23233; 23234; 23235 |
| 16146 | 17; 262; 9; 264; 265; 266; 267 | 23236; 23237; 23238; 23239; 23240; 23241; 23242; 23243 |
| 16147 | 119; 121 | 23244; 23245 |
| 16148 | 274; 275; 276 | 23246; 23247; 23248; 23249; 23250; 23251; 23252; 23253; 23254; 23255; 23256; 23257; 23258; 23259; 23260; 23261; 23262; 23263; 23264; 23265; 23266; 23267; 23268; 23269; 23270; 23271; 23272; 23273; 23274; 23275; 23276; 23277; 23278; 23279; 23280; 23281; 23282; 23283; 23284; 23285; 23286; 23287; 23288; 23289; 23290; 23291; 23292; 23293; 23294; 23295; 23296; 23297; 23298; 23299; 23300; 23301; 23302; 23303; 23304; 23305; 23306; 23307; 23308; 23309; 23310; 23311; 23312; 23313; 23314; 23315; 23316; 23317; 23318; 23319; 23320; 23321; 23322; 23323; 23324; 23325; 23326; 23327; 23328; 23329; 23330; 23331; 23332; 23333; 23334; 23335; 23336; 23337; 23338; 23339; 23340; 23341; 23342; 23343; 23344; 23345; 23346; 23347; 23348; 23349; 23350; 23351; 23352; 23353; 23354; 23355; 23356; 23357; 23358; 23359; 23360; 23361; 23362; 23363; 23364; 23365 |
| 16150 | 285; 286 | 23366; 23367 |
| 16152 | 290; 291; 292 | 23368; 23369 |
| 16153 | 293 | 23370 |
| 16154 | 294; 223 | 23371; 23372; 23373 |
| 16156 | 41; 307; 308; 309; 68 | 23374 |
| 16161 | 122 | 23375 |
| 16162 | 326; 103; 327; 304; 106 | 23376; 23377 |
| 16166 | 356 | 23378; 23379; 23380; 23381; 23382 |
| 16173 | 398; 179; 399; 9; 110; 400; 401; 402; 403 | 23383; 23384; 23385; 23386; 23387; 23388; 23389; 23390; 23391; 23392; 23393; 23394; 23395; 23396; 23397; 23398; 23399; 23400; 23401; 23402; 23403; 23404; 23405; 23406; 23407; 23408; 23409; 23410; 23411; 23412; 23413; 23414; 23415; 23416; 23417; 23418; 23419; 23420; 23421; 23422; 23423; 23424; 23425; 23426; 23427; 23428; 23429; 23430; 23431; 23432; 23433; 23434; 23435; 23436; 23437; 23438; 23439; 23440; 23441; 23442; 23443; 23444; 23445; 23446; 23447; 23448; 23449; 23450; 23451; 23452; 23453; 23454; 23455; 23456; 23457; 23458; 23459; 23460 |
| 16176 | 470; 471; 472; 473; 474; 475; 476 | 23461; 23462; 23463; 23464; 23465; 23466; 23467; 23468; 23469; 23470; 23471; 23472; 23473; 23474; 23475; 23476; 23477; 23478; 23479; 23480; 23481; 23482; 23483; 23484; 23485; 23486; 23487; 23488; 23489; 23490; 23491; 23492; 23493; 23494; 23495; 23496; 23497; 23498; 23499; 23500; 23501; 23502; 23503; 23504; 23505; 23506; 23507; 23508; 23509; 23510; 23511; 23512; 23513 |
| 16177 | 482 | 23514; 23515; 23516; 23517; 23518; 23519; 23520; 23521; 23522; 23523; 23524; 23525 |
| 16178 | 484; 485; 486; 487; 488; 321 | 23526; 23527; 23528; 23529; 23530; 23531; 23532; 23533; 23534; 23535 |
| 16181 | 305 | 23536; 23537; 23538; 23539 |
| 16183 | 99; 9; 101 | 23540 |
| 16184 | 29; 4; 31; 6 | 23541; 23542; 23543; 23544; 23545; 23546; 23547; 23548; 23549; 23550; 23551; 23552; 23553 |
| 23575 | 520; 521 | 23613; 23614; 23615; 23616; 23617; 23618; 25616 |
| 23576 | 522; 321; 524 | 23554; 23619; 23620; 23621; 23622; 23623; 23624; 23625; 23626; 23627; 23628; 23629; 23630; 23631; 23632; 25617 |
| 23577 | 186; 187; 190; 188 | 25618 |
| 23578 | 525; 207; 9; 518 | 23633; 23634; 23635; 23636; 23637; 23638; 23639; 23640; 23641; 23642; 23643; 23644; 23645; 23646; 23647; 23648; 23649; 23650; 23651; 23652; 23653; 23654; 23655; 23656; 23657; 23658; 23659; 23660; 23661; 23662; 23663; 23664; 23665; 23666; 23667; 23668; 23669; 25619; 25620; 25621 |
| 23579 | 526; 527; 528; 246 | 23670; 23671; 25622; 25623; 25624; 25625; 25626; 25627; 25628 |
| 23580 | 529; 530 | 23555; 23672; 23673; 23674; 23675; 25629 |
| 23581 | 511; 125 | 23676; 23677; 23678; 23679; 23680; 23681; 23682; 23683; 23684; 23685; 23686; 23687; 23688 |
| 23582 | 310; 311; 312 | 23689; 23690; 23691; 23692; 25630; 25631 |
| 23584 | 208; 207; 9 | 23693; 23694; 23695; 23696; 23697; 23698; 23699; 23700; 23701; 23702; 23703; 23704; 23705; 23706; 23707; 23708; 23709; 23710; 23711; 23712; 23713; 23714; 23715; 23716; 23717; 23718; 23719; 23720; 23721; 23722; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 23723; 23724; 23725; 23726; 23727; 23728; 23729; 23730; 23731; 23732; 23733; 25632; 25633; 25634; 25635; 25636; 25637; 25638; 25639; 25640; 25641; 25642; 25643; 25644; 25645; 25646; 25647; 25648 |
| 23585 | 531; 532; 535; 536 | 23585; 23734; 23735; 23736; 23737; 23738; 23739; 23740; 23741; 23742; 23743; 23744; 23745; 23746; 23747; 23748; 23749; 23750; 23751; 23752; 23753; 23754; 23755; 23756; 23757; 23758; 23759; 23760; 23761; 23762; 23763; 23764; 23765; 23766; 23767; 23768; 23769; 23770; 23771; 23772; 23773; 23774; 23775; 23776; 23777; 23778; 23779; 23780; 23781; 23782; 23783; 23784; 23785; 23786; 23787; 23788; 23789; 23790; 23791; 23792; 23793; 23794; 23795; 23796; 23797; 23798; 23799; 23800; 23801; 23802; 23803; 23804; 23805; 23806; 23807; 23808; 23809; 23810; 23811; 23812; 23813; 23814; 23815; 23816; 23817; 23818; 23819; 23820; 23821; 23822; 23823; 23824; 23825; 23826; 23827; 23828; 23829; 23830; 23831; 23832; 23833; 23834; 23835; 23836; 23837; 23838; 23839; 23840; 23841; 23842; 23843; 23844; 23845; 23846; 23847; 23848; 23849; 23850; 23851; 23852; 23853; 23854; 23855; 23856; 23857; 23858; 23859; 23860; 23861; 23862; 23863; 23864; 23865; 23866; 23867; 23868; 23869; 23870; 23871; 23872; 23873; 23874; 23875; 23876; 23877; 23878; 23879; 23880; 23881; 23882; 23883; 23884; 23885; 23886; 23887; 23888; 23889; 23890; 23891; 23892; 23893; 23894; 23895; 23896; 23897; 23898; 23899; 23900; 23901; 23902; 23903; 23904; 23905; 23906; 23907; 23908; 23909; 23910; 23911; 23912; 23913; 23914; 23915; 23916; 23917; 23918; 23919; 25649; 25650; 25651; 25652; 25653; 25654; 25655; 25656; 25657; 25658; 25659; 25660; 25661 |
| 23586 | 537; 201; 320 | 23556; 23920; 23921; 23922; 23923; 23924; 23925; 23926; 23927; 23928; 23929; 23930; 23931; 23932; 23933; 23934; 23935; 23936; 23937; 23938; 23939; 23940; 23941; 23942; 23943; 23944; 23945; 23946; 23947; 23948; 23949; 23950; 23951; 23952; 23953; 23954; 23955; 23956; 23957; 23958; 23959; 25662 |
| 23587 | 538; 9; 540; 382 | 23960; 23961; 23962; 23963; 23964; 23965; 23966; 23967; 23968 |
| 23588 | 201 | 23969; 23970; 23971; 23972; 23973; 23974; 23975; 23976; 23977; 23978; 23979; 23980; 23981; 23982; 23983; 23984; 23985; 23986; 23987; 23988; 23989; 23990; 23991; 23992; 23993; 23994; 23995; 23996; 23997; 23998; 23999; 24000; 24001; 24002; 24003; 24004; 24005; 24006; 24007; 24008; 24009; 24010; 24011; 24012; 24013; 24014; 24015; 24016; 24017; 24018; 24019; 24020; 24021; 24022; 24023; 24024; 24025; 24026; 24027; 24028; 24029; 24030; 24031; 24032; 24033; 24034; 24035; 24036; 24037; 24038; 24039; 24040; 24041; 24042; 24043; 24044; 24045; 24046; 24047; 24048; 24049; 24050; 24051; 24052; 24053; 24054; 24055; 24056; 24057; 24058; 24059; 24060; 24061; 24062; 24063; 24064; 24065; 24066; 24067; 24068; 24069; 24070; 24071; 24072; 24073; 24074; 24075; 24076; 24077; 24078; 24079; 24080; 24081; 24082; 24083; 24084; 24085; 24086; 24087; 24088; 24089; 24090; 24091; 24092; 24093; 24094; 24095; 24096; 24097; 24098; 24099; 24100; 24101; 24102; 24103; 24104; 24105; 24106; 24107; 24108; 24109; 24110; 24111; 24112; 24113; 24114; 24115; 24116; 24117; 24118; 24119; 24120; 24121; 24122; 24123; 24124; 24125; 24126; 24127; 24128; 24129; 24130; 24131; 24132; 24133; 24134; 24135; 24136; 24137; 24138; 24139; 24140; 24141; 24142; 24143; 24144; 24145; 24146; 24147; 24148; 24149; 24150; 24151; 24152; 24153; 24154; 24155; 24156; 24157; 24158; 24159; 24160; 24161; 24162; 24163; 24164; 24165; 24166; 24167; 24168; 24169; 24170; 24171; 24172; 24173; 24174; 24175; 24176; 24177; 24178; 24179; 24180; 24181; 24182; 24183; 24184; 24185 |
| 23590 | 186; 187; 190; 188 | 24186; 24187; 24188; 24189; 24190 |
| 23591 | 525; 9; 518 | 23591; 24191; 24192; 24193; 24194; 24195; 24196; 24197; 24198; 24199; 24200; 24201; 24202; 24203; 24204; 24205; 24206; 24207; 24208; 24209; 24210; 24211; 24212; 24213; 24214; 24215; 24216; 24217; 24218; 24219; 24220; 24221; 24222; 24223; 24224; 24225; 24226; 24227; 24228; 24229; 24230; 24231; 24232; 24233; 24234; 24235; 24236; 24237; 24238; 24239; 24240; 24241; 24242; 24243; 24244; 24245; 24246; 24247; 24248; 24249; 24250; 24251; 24252; 24253; 24254; 24255; 24256; 24257; 24258; 24259; 24260; 24261; 24262; 24263; 24264; 24265; 24266; 24267; 24268; 24269; 24270; 24271; 24272; 24273; 24274; 24275; 24276; 24277; 24278; 24279; 24280; 24281; 24282; 24283; 24284; 24285; 24286; 24287; 24288; 24289; 24290; 24291; 24292; 24293; 24294; 24295; 24296; 24297; 24298; 24299; 24300; 24301; 24302; 24303; 24304; 24305; 24306; 24307; 24308; 24309; 24310; 24311; 24312; 24313; 24314; 24315; 24316; 24317; 24318; 24319; 24320; 24321; 24322; 24323; 24324; 24325; 24326; 24327; 24328; 24329; 24330; 24331; 24332; 24333; 24334; 24335; 24336; 24337; 24338; 24339; 24340; 24341; 24342; 24343; 24344; 24345; 24346; 24347; 24348; 24349; 24350; 24351; 24352; 24353; 24354; 24355; 24356; 24357; 24358; 24359; 24360; 24361; 24362; 24363; 24364; 24365; 24366; 24367; 24368; 24369; 24370; 24371; 24372; 24373; 24374; 24375; 24376; 24377; 24378; 24379; 24380; 24381; 24382; 24383; 24384; 24385; |

US 10,766,935 B2

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 24386; 24387; 24388; 24389; 24390; 24391; 24392; 24393; 24394; 24395; 24396; 24397; 24398; 24399; 24400; 24401; 24402; 24403; 24404; 24405; 24406; 24407; 24408; 24409; 24410; 24411; 24412; 24413; 24414; 24415; 24416; 24417; 24418; 24419; 24420; 24421; 24422; 24423; 24424; 24425; 24426; 24427; 24428; 24429; 24430; 24431; 24432; 24433; 24434; 24435; 24436; 24437; 24438; 24439; 24440; 24441; 24442; 24443; 24444; 24445; 24446; 24447; 24448; 24449; 24450; 24451; 24452; 24453; 24454; 24455; 24456; 24457; 24458; 24459; 24460; 24461; 24462; 24463; 24464; 24465; 24466; 24467; 24468; 24469; 24470; 24471; 24472; 24473; 24474; 24475; 24476; 24477; 24478; 24479; 24480; 24481; 24482; 24483; 24484; 24485; 24486; 24487; 24488; 24489; 24490; 24491; 24492; 24493; 24494; 24495; 24496; 24497; 24498; 24499; 24500; 24501; 24502; 24503; 24504; 24505; 24506; 24507; 24508; 24509; 24510; 24511; 24512; 24513; 24514; 24515; 24516; 24517; 24518; 24519; 24520; 24521; 24522; 24523; 24524; 24525; 24526; 24527; 24528; 24529; 24530; 24531; 24532; 24533; 24534; 24535; 24536; 24537; 24538; 24539; 24540; 24541; 24542; 24543; 24544; 24545; 24546; 24547; 24548; 24549; 24550; 24551; 24552; 24553; 24554; 24555; 24556; 24557; 24558; 24559; 24560; 24561; 24562; 24563; 24564; 24565; 24566; 24567; 24568; 24569; 24570; 24571; 24572; 24573; 24574; 24575; 24576; 24577; 24578; 24579; 24580; 24581; 24582; 24583; 24584; 24585; 24586; 24587; 24588; 24589; 24590; 24591; 24592; 24593; 24594; 24595; 24596; 24597; 24598; 24599; 24600; 24601; 24602; 24603; 24604; 24605; 24606; 24607; 24608; 24609; 24610; 24611; 24612; 24613; 24614; 24615; 24616; 24617; 24618; 24619; 24620; 24621; 24622; 24623; 24624; 24625; 24626; 24627; 24628; 24629; 24630; 24631; 24632; 24633; 24634; 24635; 24636; 24637; 24638; 24639; 24640; 24641; 24642; 24643; 24644; 24645; 24646; 24647; 24648; 24649; 24650; 24651; 24652; 24653; 24654; 24655; 24656; 24657; 24658; 24659; 24660; 24661; 24662; 24663; 24664; 24665; 24666; 24667; 24668; 24669; 24670; 24671; 24672; 24673; 24674; 24675; 24676; 24677; 24678; 24679; 24680; 24681; 24682; 24683; 24684; 24685; 25663; 25664; 25665; 25666 |
| 23592 | 526; 527; 246; 528 | 24686; 24687 |
| 23593 | 511; 125 | 24688; 24689; 24690; 24691; 24692; 24693; 24694; 24695; 24696; 24697; 24698; 24699; 24700; 24701; 24702; 24703; 24704; 24705; 24706; 24707; 24708; 24709; 24710; 25667 |
| 23594 | 208; 207; 9 | 24711; 24712; 24713; 24714; 24715; 24716; 24717; 24718; 24719; 24720; 24721; 24722; 24723; 24724; 24725; 24726; 24727; 24728; 24729; 24730; 24731; 24732; 24733; 24734; 24735; 24736; 24737; 24738; 24739; 24740; 24741; 24742; 24743; 24744; 24745; 24746; 24747; 24748; 25668; 25669; 25670; 25671; 25672; 25673; 25674; 25675; 25676; 25677; 25678; 25679 |
| 23595 | 201; 537; 320 | 23557; 23558; 23559; 23560; 23561; 23562; 23563; 23564; 23565; 23566; 23567; 23568; 23569; 23570; 23571; 23572; 23573; 24749; 24750; 24751; 24752; 24753; 24754; 24755; 24756; 24757; 24758; 24759; 24760; 24761; 24762; 24763; 24764; 24765; 24766; 24767; 24768; 24769; 24770; 24771; 24772; 24773; 24774; 24775; 24776; 24777; 24778; 24779; 24780; 24781; 24782; 24783; 24784; 24785; 24786; 24787; 24788; 24789; 24790; 24791; 24792; 24793; 24794; 24795; 24796; 24797; 24798; 24799; 24800; 24801; 24802; 24803; 24804; 24805; 24806; 24807; 24808; 24809; 24810; 24811; 24812; 24813; 24814; 24815; 24816; 24817; 24818; 24819; 24820; 24821; 24822 |
| 25610 | 541; 542; 543; 544; 546 | 24823; 24824; 24825; 24826; 24827; 24828; 24829; 24830; 24831; 24832; 24833; 24834; 24835; 24836; 24837; 24838; 24839; 24840; 24841; 24842; 24843; 24844; 24845; 24846; 24847; 24848; 24849; 24850; 24851; 24852; 24853; 24854; 24855; 24856; 24857; 24858; 24859; 24860; 24861; 24862; 24863; 24864; 24865; 24866; 24867; 24868; 24869; 24870; 24871; 24872; 24873; 24874; 24875; 24876; 24877; 24878; 24879; 24880; 24881; 24882; 24883; 24884; 24885; 24886; 24887; 24888; 24889; 24890; 24891; 24892; 24893; 24894; 24895; 24896; 24897; 24898; 24899; 24900; 24901; 24902; 24903; 24904; 24905; 24906; 24907; 24908; 24909; 24910; 24911; 24912; 24913; 24914; 24915; 24916; 24917; 24918; 24919; 24920; 24921; 24922; 24923; 24924; 24925; 24926; 24927; 24928; 24929; 24930; 24931; 24932; 24933; 24934; 24935; 24936; 24937; 24938; 24939; 24940; 24941; 24942; 24943; 24944; 24945; 25610; 25680; 25681; 25682; 25683; 25684; 25685; 25686; 25687; 25688; 25689; 25690; 25691; 25692; 25693; 25694; 25695; 25696; 25697; 25698; 25699; 25700; 25701; 25702; 25703; 25704; 25705; 25706; 25707; 25708; 25709; 25710; 25711; 25712; 25713; 25714; 25715; 25716; 25717; 25718; 25719; 25720; 25721; 25722; 25723; 25724; 25725; 25726; 25727; 25728; 25729; 25730; 25731; 25732; 25733; 25734; 25735; 25736; 25737; 25738; 25739; 25740; 25741; 25742; 25743; 25744; 25745; 25746; 25747; 25748; 25749; 25750; 25751; 25752; 25753; 25754; 25755; 25756; 25757; 25758; 25759; 25760; 25761; 25762; 25763; 25764; 25765; 25766; 25767; 25768; 25769; 25770; 25771; 25772; 25773; 25774; 25775; 25776; 25777; 25778; 25779; 25780; 25781; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 25782; 25783; 25784; 25785; 25786; 25787; 25788; 25789; 25790; 25791; 25792; 25793; 25794; 25795; 25796; 25797; 25798; 25799; 25800; 25801; 25802; 25803; 25804; 25805; 25806; 25807; 25808; 25809; 25810; 25811; 25812; 25813; 25814; 25815; 25816; 25817; 25818; 25819; 25820; 25821; 25822; 25823; 25824; 25825; 25826; 25827; 25828; 25829; 25830; 25831; 25832; 25833; 25834; 25835; 25836; 25837; 25838; 25839; 25840; 25841; 25842; 25843; 25844; 25845; 25846; 25847; 25848; 25849; 25850; 25851; 25852; 25853; 25854; 25855; 25856; 25857; 25858; 25859; 25860; 25861; 25862; 25863; 25864; 25865; 25866; 25867; 25868; 25869; 25870; 25871; 25872; 25873; 25874; 25875; 25876; 25877; 25878; 25879; 25880; 25881; 25882; 25883; 25884; 25885; 25886; 25887; 25888; 25889; 25890; 25891; 25892; 25893; 25894; 25895; 25896; 25897; 25898; 25899; 25900; 25901; 25902; 25903; 25904; 25905; 25906; 25907; 25908; 25909; 25910; 25911; 25912; 25913; 25914; 25915; 25916; 25917; 25918; 25919; 25920; 25921; 25922; 25923; 25924; 25925; 25926; 25927; 25928; 25929; 25930; 25931; 25932; 25933; 25934; 25935; 25936; 25937; 25938; 25939; 25940; 25941; 25942; 25943; 25944; 25945; 25946; 25947; 25948; 25949; 25950; 25951; 25952; 25953; 25954; 25955; 25956; 25957; 25958; 25959; 25960; 25961; 25962; 25963; 25964; 25965; 25966; 25967; 25968; 25969; 25970; 25971; 25972; 25973; 25974; 25975; 25976; 25977; 25978; 25979; 25980; 25981; 25982; 25983; 25984; 25985; 25986; 25987; 25988; 25989; 25990; 25991; 25992 |
| 25611 | 357; 358; 359; 360 | 24946; 24947; 24948; 24949; 24950; 24951; 24952; 24953; 24954; 24955; 24956; 24957; 24958; 24959; 24960; 24961; 24962; 24963; 24964; 24965; 24966; 24967; 24968; 24969; 24970; 24971; 24972; 24973; 24974; 24975; 24976; 24977; 24978; 24979; 24980; 24981; 24982; 24983; 24984; 24985; 24986; 24987; 24988; 24989; 24990; 24991; 24992; 24993; 24994; 24995; 24996; 24997; 24998; 24999; 25000; 25001; 25002; 25003; 25004; 25005; 25006; 25007; 25008; 25009; 25010; 25011; 25012; 25013; 25014; 25015; 25016; 25017; 25018; 25019; 25020; 25021; 25022; 25023; 25024; 25025; 25026; 25027; 25028; 25029; 25030; 25031; 25032; 25033; 25034; 25035; 25036; 25037; 25038; 25039; 25040; 25041; 25042; 25043; 25044; 25045; 25046; 25047; 25048; 25049; 25050; 25051; 25052; 25053; 25054; 25055; 25056; 25057; 25058; 25059; 25060; 25061; 25062; 25063; 25064; 25065; 25066; 25067; 25068; 25069; 25070; 25071; 25072; 25073; 25074; 25075; 25076; 25077; 25078; 25079; 25080; 25081; 25082; 25083; 25084; 25085; 25086; 25087; 25088; 25089; 25090; 25091; 25092; 25093; 25094; 25095; 25096; 25097; 25098; 25099; 25100; 25101; 25102; 25103; 25104; 25105; 25106; 25107; 25108; 25109; 25110; 25111; 25112; 25113; 25114; 25115; 25116; 25117; 25118; 25119; 25120; 25121; 25122; 25123; 25124; 25125; 25126; 25127; 25128; 25129; 25130; 25131; 25132; 25133; 25134; 25135; 25136; 25137; 25138; 25139; 25140; 25141; 25142; 25143; 25144; 25145; 25146; 25147; 25148; 25149; 25150; 25151; 25152; 25153; 25154; 25155; 25156; 25157; 25158; 25159; 25160; 25161; 25162; 25163; 25164; 25165; 25166; 25167; 25168; 25169; 25170; 25171; 25172; 25173; 25174; 25175; 25176; 25177; 25178; 25179; 25180; 25181; 25182; 25183; 25184; 25185; 25186; 25187; 25188; 25189; 25190; 25191; 25192; 25993; 25994; 25995; 25996; 25997; 25998; 25999; 26000; 26001; 26002; 26003; 26004; 26005; 26006; 26007; 26008; 26009; 26010; 26011; 26012; 26013; 26014; 26015; 26016; 26017; 26018; 26019; 26020; 26021; 26022; 26023; 26024; 26025; 26026; 26027; 26028; 26029; 26030; 26031; 26032; 26033; 26034; 26035; 26036; 26037; 26038; 26039; 26040; 26041; 26042; 26043; 26044; 26045; 26046; 26047; 26048; 26049; 26050; 26051; 26052; 26053; 26054; 26055; 26056; 26057; 26058; 26059; 26060; 26061; 26062; 26063; 26064; 26065; 26066; 26067; 26068; 26069; 26070; 26071; 26072; 26073; 26074; 26075; 26076; 26077; 26078; 26079; 26080; 26081; 26082; 26083; 26084; 26085; 26086; 26087; 26088; 26089; 26090; 26091; 26092; 26093; 26094; 26095; 26096; 26097; 26098; 26099; 26100; 26101; 26102; 26103; 26104; 26105; 26106; 26107; 26108; 26109; 26110; 26111; 26112; 26113; 26114; 26115; 26116; 26117; 26118; 26119; 26120; 26121; 26122; 26123; 26124; 26125; 26126; 26127; 26128; 26129; 26130 |
| 25612 | 547 | 25193; 25194; 26131 |
| 25613 | 548; 550 | 25195; 25196; 25197; 25198; 25199; 25200; 25201; 25202; 25203; 25204; 25205; 25206; 25207; 25208; 25209; 25210; 25211; 25212; 25213; 25214; 25215; 25216; 25217; 25218; 25219; 25220; 25221; 25222; 25223; 25224; 25225; 25226; 25227; 25228; 25229; 25230; 25231; 25232; 25233; 25234; 25235; 25236; 25237; 25238; 25239; 25240; 25241; 25242; 25243; 25244; 25245; 25246; 25247; 25248; 25249; 25250; 25251; 25252; 25253; 25254; 25255; 25256; 25257; 25258; 25259; 25260; 25261; 25262; 25263; 25264; 25265; 25266; 25267; 25268; 25269; 25270; 25271; 25272; 25273; 25274; 25275; 25276; 25277; 25278; 25279; 25280; 25281; 25282; 25283; 25284; 25285; 25286; 25287; 25288; 25289; 25290; 25291; 25292; 25293; 25294; 25295; 25296; 25297; 25298; 25299; 25300; 25301; 25302; |

TABLE 316-continued

Domain Families

| Core Polypeptide (SEQ ID NO) | Characteristic Domains (Domain identifier) | Homologous Polypeptides Family Sharing the Domain (SEQ ID Nos) |
|---|---|---|
| | | 25303; 25304; 25305; 25306; 25307; 25308; 25309; 25310; 25311; 25312; 25313; 25314; 25315; 25316; 25317; 25318; 25319; 25320; 25321; 25322; 25323; 25324; 25325; 25326; 25327; 25328; 25329; 25330; 25331; 25332; 25333; 25334; 25335; 25336; 25337; 25338; 25339; 25340; 25341; 25342; 25343; 25344; 25345; 25346; 25347; 25348; 25349; 25350; 25351; 25352; 25353; 25354; 25355; 25356; 25357; 25358; 25359; 25360; 25361; 25362; 25363; 25364; 25365; 25366; 25367; 25368; 25369; 25370; 25371; 25372; 25373; 25374; 25375; 25376; 25377; 25378; 25379; 25380; 25381; 25382; 25383; 25384; 25385; 25386; 25387; 25388; 25389; 25390; 25391; 25392; 25393; 25394; 25395; 25396; 25397; 25398; 25399; 25400; 25401; 25402; 25403; 25404; 25405; 25406; 25407; 25408; 25409; 25410; 25411; 25412; 25413; 25414; 25415; 25416; 25417; 25418; 25419; 25420; 25421; 25422; 25423; 25424; 25425; 25426; 25427; 25428; 25429; 25430; 25431; 25432; 25433; 25434; 25435; 25436; 25437; 25438; 25439; 25440; 25441; 25442; 25443; 25444; 25445; 25446; 25447; 25448; 25449; 25450; 25451; 25452; 25453; 25454; 25455; 25456; 25457; 25458; 25459; 25460; 25461; 25462; 25463; 25464; 25465; 25466; 25467; 25468; 25469; 25470; 25471; 25472; 25473; 25474; 25475; 25476; 25477; 25478; 25479; 25480; 25481; 25482; 25483; 25484; 25485; 25486; 25487; 25488; 25489; 25490; 25491; 25492; 25493; 25494; 25495; 25496; 25497; 25498; 25499; 25500; 25501; 25502; 25503; 25504; 25505; 25506; 25507; 25508; 25509; 25510; 25511; 25512; 25513; 25514; 25515; 25516; 25517; 25518; 25519; 25520; 25521; 25522; 25523; 25524; 25525; 25526; 25527; 25528; 25529; 25530; 25531; 25532; 25533; 25534; 25535; 25536; 25537; 25538; 25539; 25540; 25541; 25542; 25543; 25544; 25545; 25546; 25547; 25548; 25549; 25550; 25551; 25552; 25553; 25554; 25555; 25556; 25557; 25558; 25559; 25560; 25561; 25562; 25563; 25564; 25565; 25566; 25567; 25568; 25569; 25570; 25571; 25572; 25573; 25574; 25575; 25576; 25577; 25578; 25579; 25580; 25581; 25582; 25583; 25584; 25585; 25586; 25587; 25588; 25589; 25590; 25591; 25592; 25593; 25594; 25595; 25596; 25597; 25598; 25599; 25600; 25601; 25602; 25603; 25604; 26132; 26133; 26134; 26135; 26136; 26137; 26138; 26139; 26140; 26141; 26142; 26143; 26144; 26145; 26146; 26147; 26148; 26149; 26150; 26151; 26152; 26153; 26154; 26155; 26156; 26157; 26158; 26159; 26160; 26161; 26162; 26163; 26164; 26165; 26166; 26167; 26168; 26169; 26170; 26171; 26172; 26173; 26174; 26175; 26176; 26177; 26178; 26179; 26180; 26181; 26182; 26183; 26184; 26185; 26186; 26187; 26188; 26189; 26190; 26191; 26192; 26193; 26194; 26195; 26196; 26197; 26198; 26199; 26200; 26201; 26202; 26203; 26204; 26205; 26206; 26207; 26208; 26209; 26210; 26211; 26212; 26213; 26214; 26215; 26216; 26217; 26218; 26219; 26220; 26221; 26222; 26223; 26224; 26225; 26226; 26227; 26228; 26229; 26230; 26231; 26232; 26233; 26234; 26235; 26236; 26237; 26238; 26239; 26240; 26241; 26242; 26243 |
| 25614 | 551 | 25605; 25606; 25607; 25608; 25609 |

TABLE 317

Details of Identified Domains

| Domain Identifier | InterPro No. | Accession No. | Description |
|---|---|---|---|
| 1 | IPR001128 | SSF48264 | Cytochrome P450 |
| 2 | IPR002401 | PR00463 | E-class P450 group I signature Cytochrome P450, E-class, group I |
| 3 | IPR017972 | PS00086 | Cytochrome P450 cysteine heme-iron ligand signature. Cytochrome P450, conserved site |
| 4 | IPR000719 | SM00220 | Protein kinase domain |
| 5 | IPR032675 | G3DSA: 3.80.10.10 | Leucine-rich repeat domain, L domain-like |
| 6 | IPR011009 | SSF56112 | Protein kinase-like domain |
| 7 | IPR014014 | PS51195 | DEAD-box RNA helicase Q motif profile. RNA helicase, DEAD-box type, Q motif |
| 8 | IPR011545 | PF00270 | DEAD/DEAH box helicase DEAD/DEAH box helicase domain |
| 9 | IPR027417 | SSF52540 | P-loop containing nucleoside triphosphate hydrolase |
| 10 | IPR014001 | PS51192 | Superfamilies 1 and 2 helicase ATP-binding type-1 domain profile. Helicase superfamily 1/2, ATP-binding domain |
| 11 | IPR001650 | PF00271 | Helicase conserved C-terminal domain Helicase, C-terminal |
| 12 | IPR020719 | PS01287 | RNA 3'-terminal phosphate cyclase signature. RNA 3'-terminal phosphate cyclase-like, conserved site |

TABLE 317-continued

Details of Identified Domains

| Domain Identifier No. | InterPro No. | Accession No. | Description |
|---|---|---|---|
| 13 | IPR013791 | PF05189 | RNA 3'-terminal phosphate cyclase (RTC), insert domain RNA 3'-terminal phosphate cyclase, insert domain |
| 14 | IPR023797 | G3DSA: 3.65.10.20 | RNA 3'-terminal phosphate cyclase domain |
| 15 | IPR016443 | TIGR03400 | 18S_RNA_Rcl1p: 18S rRNA biogenesis protein RCL1 RNA 3'-terminal phosphate cyclase type 2 |
| 16 | IPR013792 | SSF55205 | RNA 3'-terminal phosphate cyclase/enolpyruvate transferase, alpha/beta |
| 17 | IPR012340 | SSF50249 | Nucleic acid-binding, OB-fold |
| 18 | IPR028333 | TIGR03630 | uS17_arch: ribosomal protein uS17 Ribosomal protein S17, archaeal/eukaryotic |
| 19 | IPR032440 | PF16205 | Ribosomal_S17 N-terminal 40S ribosomal protein S11, N-terminal |
| 20 | IPR019979 | PS00056 | Ribosomal protein S17 signature. Ribosomal protein S17, conserved site |
| 21 | IPR000266 | PD001295 | RIBOSOMAL S17 30S RIBONUCLEOPROTEIN RRNA-BINDING RNA-BINDING 40S S11 S17P S11 Ribosomal protein S17/S11 |
| 22 | IPR000504 | PF00076 | RNA recognition motif. (a.k.a. RRM, RBD, or RNP domain) RNA recognition motif domain |
| 23 | IPR012677 | SSF54928 | Nucleotide-binding alpha-beta plait domain |
| 24 | IPR008111 | PR01738 | RNA binding motif protein 8 family signature RNA-binding motif protein 8 |
| 25 | IPR007857 | PIRSF015894 | Protein arginine N-methyltransferase PRMT5 |
| 26 | IPR029063 | PF00145 | C-5 cytosine-specific DNA methylase S-adenosyl-L-methionine-dependent methyltransferase |
| 27 | IPR025799 | PS51678 | SAM-dependent methyltransferase PRMT-type domain profile. Protein arginine N-methyltransferase |
| 28 | IPR000270 | SM00666 | PB1 domain |
| 29 | IPR017441 | PS00107 | Protein kinases ATP-binding region signature. Protein kinase, ATP binding site |
| 30 | IPR001245 | PF07714 | Protein tyrosine kinase Serine-threonine/tyrosine-protein kinase catalytic domain |
| 31 | IPR008271 | PS00108 | Serine/Threonine protein kinases active-site signature. Serine/threonine-protein kinase, active site |
| 32 | IPR016487 | PIRSF006609 | Sm-like protein Lsm6/SmF |
| 33 | IPR001163 | PF01423 | LSM domain LSM domain, eukaryotic/archaea-type |
| 34 | IPR010920 | SSF50182 | LSM domain |
| 35 | IPR021966 | PF12108 | Splicing factor SF3a60 binding domain Splicing factor SF3a60 binding domain |
| 36 | IPR000690 | PS50171 | Zinc finger matrin-type profile. Zinc finger, C2H2-type matrin |
| 37 | IPR031774 | PF16837 | Pre-mRNA-splicing factor SF3A3, of SF3a complex, Prp9 SF3A3 domain |
| 38 | IPR024598 | PF11931 | Domain of unknown function (DUF3449) Domain of unknown function DUF3449 |
| 39 | IPR013719 | PF08512 | Histone chaperone Rttp106-like Domain of unknown function DUF1747 |
| 40 | IPR000969 | PR00887 | Structure-specific recognition protein signature Structure-specific recognition protein |
| 41 | IPR011993 | SSF50729 | PH domain-like |
| 42 | IPR009071 | PS50118 | HMG boxes A and B DNA-binding domains profile. High mobility group box domain |
| 43 | IPR024954 | PF03531 | Structure-specific recognition protein (SSRP1) SSRP1 domain |
| 44 | IPR001412 | PS00178 | Aminoacyl-transfer RNA synthetases class-I signature. Aminoacyl-tRNA synthetase, class I, conserved site |
| 45 | IPR007639 | PF04558 | Glutaminyl-tRNA synthetase, non-specific RNA binding region part 1 Glutaminyl-tRNA synthetase, class Ib, non-specific RNA-binding domain, N-terminal |
| 46 | IPR020061 | G3DSA: 1.10.1160.10 | Glutamyl/glutaminyl-tRNA synthetase, class Ib, alpha-bundle domain |
| 47 | IPR020056 | G3DSA: 2.40.240.10 | Ribosomal protein L25/Gln-tRNA synthetase, beta-barrel domain |
| 48 | IPR007638 | PF04557 | Glutaminyl-tRNA synthetase, non-specific RNA binding region part 2 Glutaminyl-tRNA synthetase, class Ib, non-specific RNA-binding domain 2 |
| 49 | IPR011035 | SSF50715 | Ribosomal protein L25/Gln-tRNA synthetase, anti-codon-binding domain |
| 50 | IPR020058 | PF00749 | tRNA synthetases class I (E and Q), catalytic domain Glutamyl/glutaminyl-tRNA synthetase, class Ib, catalytic domain |
| 51 | IPR014729 | G3DSA: 3.40.50.620 | Rossmann-like alpha/beta/alpha sandwich fold |
| 52 | IPR000924 | PR00987 | Glutamyl-tRNA synthetase signature Glutamyl/glutaminyl-tRNA synthetase |
| 53 | IPR004514 | TIGR00440 | glnS: glutamine--tRNA ligase Glutamine-tRNA synthetase |

TABLE 317-continued

Details of Identified Domains

| Domain Identifier | InterPro No. | Accession No. | Description |
|---|---|---|---|
| 54 | IPR020059 | PF03950 | tRNA synthetases class I (E and Q), anti-codon binding domain Glutamyl/glutaminyl-tRNA synthetase, class Ib, anti-codon binding domain |
| 55 | IPR007023 | PF04939 | Ribosome biogenesis regulatory protein (RRS1) Ribosomal biogenesis regulatory protein |
| 56 | IPR018262 | PS01107 | Ribosomal protein L27e signature. Ribosomal protein L27e, conserved site |
| 57 | IPR008991 | SSF50104 | Translation protein SH3-like domain |
| 58 | IPR014722 | G3DSA: 2.30.30.30 | Ribosomal protein L2 domain 2 |
| 59 | IPR005824 | PF00467 | KOW motif KOW |
| 60 | IPR001141 | PF01777 | Ribosomal L27e protein family Ribosomal protein L27e |
| 61 | IPR001005 | SM00717 | SANT/Myb domain |
| 62 | IPR009057 | SSF46689 | Homeodomain-like |
| 63 | IPR017930 | PS51294 | Myb-type HTH DNA-binding domain profile. Myb domain |
| 64 | IPR023441 | G3DSA: 2.30.170.20 | Ribosomal protein L24e domain |
| 65 | IPR023442 | PS01073 | Ribosomal protein L24e signature. Ribosomal protein L24e, conserved site |
| 66 | IPR000988 | PF01246 | Ribosomal protein L24e Ribosomal protein L24e-related |
| 67 | IPR011017 | SM00746 | TRASH domain |
| 68 | IPR001849 | PS50003 | PH domain profile. Pleckstrin homology domain |
| 69 | IPR000648 | PF01237 | Oxysterol-binding protein Oxysterol-binding protein |
| 70 | IPR017986 | SSF50978 | WD40-repeat-containing domain |
| 71 | IPR015943 | G3DSA: 2.130.10.10 | WD40/YVTN repeat-like-containing domain |
| 72 | IPR004871 | PF03178 | CPSF A subunit region Cleavage/polyadenylation specificity factor, A subunit, C-terminal |
| 73 | IPR003323 | PF02338 | OTU-like cysteine protease OTU domain |
| 74 | IPR002554 | PF01603 | Protein phosphatase 2A regulatory B subunit (B56 family) Protein phosphatase 2A, regulatory B subunit, B56 |
| 75 | IPR016024 | SSF48371 | Armadillo-type fold |
| 76 | IPR033389 | PF02309 | AUX/IAA family AUX/IAA domain |
| 77 | IPR003137 | PF02225 | PA domain PA domain |
| 78 | IPR018097 | PS01187 | Calcium-binding EGF-like domain signature. EGF-like calcium-binding, conserved site |
| 79 | IPR004698 | TIGR00820 | zip: ZIP zinc/iron transport family Zinc/iron permease, fungal/plant |
| 80 | IPR003689 | PF02535 | ZIP Zinc transporter Zinc/iron permease |
| 81 | IPR010255 | SSF48113 | Haem peroxidase |
| 82 | IPR000823 | PR00461 | Plant peroxidase signature Plant peroxidase |
| 83 | IPR019793 | PS00435 | Peroxidases proximal heme-ligand signature. Peroxidases heam-ligand binding site |
| 84 | IPR019794 | PS00436 | Peroxidases active site signature. Peroxidase, active site |
| 85 | IPR002016 | PS50873 | Plant heme peroxidase family profile. Haem peroxidase, plant/fungal/bacterial |
| 86 | IPR005829 | PS00216 | Sugar transport proteins signature 1. Sugar transporter, conserved site |
| 87 | IPR020846 | SSF103473 | Major facilitator superfamily domain |
| 88 | IPR005828 | PF00083 | Sugar (and other) transporter Major facilitator, sugar transporter-like |
| 89 | IPR003663 | TIGR00879 | SP: MFS transporter, sugar porter (SP) family Sugar/inositol transporter |
| 90 | IPR004316 | PF03083 | Sugar efflux transporter for intercellular exchange SWEET sugar transporter |
| 91 | IPR000133 | PF00810 | ER lumen protein retaining receptor ER lumen protein retaining receptor |
| 92 | IPR004161 | PF03144 | Elongation factor Tu domain 2 Translation elongation factor EFTu/EF1A, domain 2 |
| 93 | IPR015256 | PF09173 | Initiation factor eIF2 gamma, C terminal Translation initiation factor 2, gamma subunit, C-terminal |
| 94 | IPR009001 | SSF50465 | Translation elongation factor EF1A/initiation factor IF2gamma, C-terminal |
| 95 | IPR000795 | PS51722 | Translational (tr)-type guanine nucleotide-binding (G) domain profile. Transcription factor, GTP-binding domain |
| 96 | IPR009000 | SSF50447 | Translation protein, beta-barrel domain |
| 97 | IPR016177 | SSF54171 | DNA-binding domain |
| 98 | IPR001471 | PS51032 | AP2/ERF domain profile. AP2/ERF domain |
| 99 | IPR000623 | MF_00109 | Shikimate kinase [aroK]. Shikimate kinase/Threonine synthase-like 1 |
| 100 | IPR023000 | PS01128 | Shikimate kinase signature. Shikimate kinase, conserved site |
| 101 | IPR031322 | PF01202 | Shikimate kinase Shikimate kinase/gluconokinase |
| 102 | IPR004839 | PF00155 | Aminotransferase class I and II Aminotransferase, class I/classII |
| 103 | IPR015424 | SSF53383 | Pyridoxal phosphate-dependent transferase |
| 104 | IPR004838 | PS00105 | Aminotransferases class-I pyridoxal-phosphate attachment site. Aminotransferases, class-I, pyridoxal-phosphate-binding site |

TABLE 317-continued

Details of Identified Domains

| Domain Identifier | InterPro No. | Accession No. | Description |
|---|---|---|---|
| 105 | IPR000796 | PR00799 | Aspartate aminotransferase signature Aspartate/other aminotransferase |
| 106 | IPR015421 | G3DSA: 3.40.640.10 | Pyridoxal phosphate-dependent transferase, major region, subdomain 1 |
| 107 | IPR001251 | G3DSA: 3.40.525.10 | CRAL-TRIO lipid binding domain |
| 108 | IPR011074 | SM01100 | CRAL/TRIO, N-terminal domain |
| 109 | IPR004159 | PF03141 | Putative S-adenosyl-L-methionine-dependent methyltransferase Putative S-adenosyl-L-methionine-dependent methyltransferase |
| 110 | IPR003593 | SM00382 | AAA+ ATPase domain |
| 111 | IPR003439 | PF00005 | ABC transporter ABC transporter-like |
| 112 | IPR017871 | PS00211 | ABC transporters family signature. ABC transporter, conserved site |
| 113 | IPR013525 | PF01061 | ABC-2 type transporter ABC-2 type transporter |
| 114 | IPR017907 | PS00518 | Zinc finger RING-type signature. Zinc finger, RING-type, conserved site |
| 115 | IPR001841 | PS50089 | Zinc finger RING-type profile. Zinc finger, RING-type |
| 116 | IPR013083 | G3DSA: 3.30.40.10 | Zinc finger, RING/FYVE/PHD-type |
| 117 | IPR005550 | PF03801 | HEC/Ndc80p family Kinetochore protein Ndc80 |
| 118 | IPR013830 | PF13472 | GDSL-like Lipase/Acylhydrolase family SGNH hydrolase-type esterase domain |
| 119 | IPR020845 | PS00455 | Putative AMP-binding domain signature. AMP-binding, conserved site |
| 120 | IPR025110 | PF13193 | AMP-binding enzyme C-terminal domain AMP-binding enzyme C-terminal domain |
| 121 | IPR000873 | PF00501 | AMP-binding enzyme AMP-dependent synthetase/ligase |
| 122 | IPR001594 | PF01529 | DHHC palmitoyltransferase Zinc finger, DHHC-type, palmitoyltransferase |
| 123 | IPR009695 | PF06925 | Monogalactosyldiacylglycerol (MGDG) synthase Diacylglycerol glucosyltransferase, N-terminal |
| 124 | IPR007235 | PF04101 | Glycosyltransferase family 28 C-terminal domain Glycosyl transferase, family 28, C-terminal |
| 125 | IPR029044 | G3DSA: 3.90.550.10 | Nucleotide-diphospho-sugar transferases |
| 126 | IPR000300 | SM00128 | Inositol polyphosphate-related phosphatase |
| 127 | IPR005135 | SSF56219 | Endonuclease/exonuclease/phosphatase |
| 128 | IPR006868 | PF04783 | Protein of unknown function (DUF630) Domain of unknown function DUF630 |
| 129 | IPR006867 | PF04782 | Protein of unknown function (DUF632) Domain of unknown function DUF632 |
| 130 | IPR005172 | PF03638 | Tesmin/TSO1-like CXC domain, cysteine-rich domain CRC domain |
| 131 | IPR033467 | SM01114 | Tesmin/TSO1-like CXC domain |
| 132 | IPR001480 | PS50927 | Bulb-type lectin domain profile. Bulb-type lectin domain |
| 133 | IPR003609 | PF08276 | PAN-like domain PAN/Apple domain |
| 134 | IPR021820 | PF11883 | Domain of unknown function (DUF3403) S-locus receptor kinase, C-terminal |
| 135 | IPR013320 | G3DSA: 2.60.120.200 | Concanavalin A-like lectin/glucanase domain |
| 136 | IPR024171 | PIRSF000641 | S-receptor-like serine/threonine-protein kinase |
| 137 | IPR000858 | PF00954 | S-locus glycoprotein domain S-locus glycoprotein domain |
| 138 | IPR007087 | PS00028 | Zinc finger C2H2 type domain signature. Zinc finger, C2H2 |
| 139 | IPR012317 | PF00644 | Poly(ADP-ribose) polymerase catalytic domain Poly(ADP-ribose) polymerase, catalytic domain |
| 140 | IPR008984 | SSF49879 | SMAD/FHA domain |
| 141 | IPR002716 | PF13638 | PIN domain PIN domain |
| 142 | IPR029060 | SSF88723 | PIN domain-like |
| 143 | IPR000253 | PF00498 | FHA domain Forkhead-associated (FHA) domain |
| 144 | IPR008181 | TIGR00576 | dut: dUTP diphosphatase Deoxyuridine triphosphate nucleotidohydrolase |
| 145 | IPR008180 | PF00692 | dUTPase Deoxyuridine triphosphate nucleotidohydrolase/Deoxycytidine triphosphate deaminase |
| 146 | IPR029054 | SSF51283 | dUTPase-like |
| 147 | IPR013878 | PF08569 | Mo25-like Mo25-like |
| 148 | IPR011989 | G3DSA: 1.25.10.10 | Armadillo-like helical |
| 149 | IPR006694 | PF04116 | Fatty acid hydroxylase superfamily Fatty acid hydroxylase |
| 150 | IPR021940 | PF12076 | WAX2 C-terminal domain Uncharacterised domain Wax2, C-terminal |
| 151 | IPR004367 | PF02984 | Cyclin, C-terminal domain Cyclin, C-terminal domain |
| 152 | IPR013763 | SM00385 | Cyclin-like |
| 153 | IPR006671 | PF00134 | Cyclin, N-terminal domain Cyclin, N-terminal |
| 154 | IPR001313 | PS50302 | Pumilio RNA-binding repeat profile. Pumilio RNA-binding repeat |
| 155 | IPR012959 | PF08144 | CPL (NUC119) domain CPL domain |
| 156 | IPR033133 | PS50303 | Pumilio homology domain (PUM-HD) profile. Pumilio homology domain |

TABLE 317-continued

Details of Identified Domains

| Domain Identifier | InterPro No. | Accession No. | Description |
|---|---|---|---|
| 157 | IPR018866 | PF10497 | Zinc-finger domain of monoamine-oxidase A repressor R1 Zinc-finger domain of monoamine-oxidase A repressor R1 |
| 158 | IPR001810 | SSF81383 | F-box domain |
| 159 | IPR008892 | PF05562 | Cold acclimation protein WCOR413 Cold-regulated 413 protein |
| 160 | IPR002123 | SM00563 | Phospholipid/glycerol acyltransferase |
| 161 | IPR032098 | PF16076 | Acyltransferase C-terminus Acyltransferase, C-terminal domain |
| 162 | IPR031314 | PF01712 | Deoxynucleoside kinase Deoxynucleoside kinase domain |
| 163 | IPR016137 | SM00315 | RGS domain |
| 164 | IPR011990 | G3DSA: 1.25.40.10 | Tetratricopeptide-like helical domain |
| 165 | IPR013026 | PS50293 | TPR repeat region circular profile. Tetratricopeptide repeat-containing domain |
| 166 | IPR019734 | PS50005 | TPR repeat profile. Tetratricopeptide repeat |
| 167 | IPR004146 | PF03107 | C1 domain DC1 |
| 168 | IPR011527 | PS50929 | ABC transporter integral membrane type-1 fused domain profile. ABC transporter type 1, transmembrane domain |
| 169 | IPR022052 | PF12265 | Histone-binding protein RBBP4 or subunit C of CAF1 complex Histone-binding protein RBBP4, N-terminal |
| 170 | IPR001680 | SM00320 | WD40 repeat |
| 171 | IPR022643 | PF00278 | Pyridoxal-dependent decarboxylase, C-terminal sheet domain Orn/DAP/Arg decarboxylase 2, C-terminal |
| 172 | IPR029066 | SSF51419 | PLP-binding barrel |
| 173 | IPR009006 | SSF50621 | Alanine racemase/group IV decarboxylase, C-terminal |
| 174 | IPR022653 | PS00878 | Orn/DAP/Arg decarboxylases family 2 pyridoxal-P attachment site. Orn/DAP/Arg decarboxylase 2, pyridoxal-phosphate binding site |
| 175 | IPR000183 | PR01179 | Ornithine/diaminopimelate/arginine (ODA) decarboxylase family signature Ornithine/DAP/Arg decarboxylase |
| 176 | IPR002985 | PIRSF001336 | Arginine decarboxylase |
| 177 | IPR022644 | PF02784 | Pyridoxal-dependent decarboxylase, pyridoxal binding domain Orn/DAP/Arg decarboxylase 2, N-terminal |
| 178 | IPR005027 | PF03360 | Glycosyltransferase family 43 Glycosyl transferase, family 43 |
| 179 | IPR003959 | PF00004 | ATPase family associated with various cellular activities (AAA) ATPase, AAA-type, core |
| 180 | IPR003960 | PS00674 | AAA-protein family signature. ATPase, AAA-type, conserved site |
| 181 | IPR001487 | SSF47370 | Bromodomain |
| 182 | IPR011047 | SSF50998 | Quinoprotein alcohol dehydrogenase-like superfamily |
| 183 | IPR032682 | PF12717 | non-SMC mitotic condensation complex subunit 1 Condensin complex subunit 1, C-terminal |
| 184 | IPR024324 | PF12922 | non-SMC mitotic condensation complex subunit 1, N-term Condensin complex subunit 1, N-terminal |
| 185 | IPR026003 | PF12765 | HEAT repeat associated with sister chromatid cohesion HEAT repeat associated with sister chromatid cohesion protein |
| 186 | IPR012341 | G3DSA: 1.50.10.10 | Six-hairpin glycosidase |
| 187 | IPR008928 | SSF48208 | Six-hairpin glycosidase-like |
| 188 | IPR001701 | PF00759 | Glycosyl hydrolase family 9 Glycoside hydrolase family 9 |
| 189 | IPR033126 | PS00698 | Glycosyl hydrolases family 9 active sites signature 2. Glycosyl hydrolases family 9, Asp/Glu active sites |
| 190 | IPR018221 | PS00592 | Glycosyl hydrolases family 9 active sites signature 1. Glycoside hydrolase family 9, His active site |
| 191 | IPR003406 | PF02485 | Core-2/I-Branching enzyme Glycosyl transferase, family 14 |
| 192 | IPR003613 | PF04564 | U-box domain U box domain |
| 193 | IPR014024 | TIGR00946 | 2a69: auxin efflux carrier Auxin efflux carrier, plant type |
| 194 | IPR004776 | PF03547 | Membrane transport protein Auxin efflux carrier |
| 195 | IPR005150 | PF03552 | Cellulose synthase Cellulose synthase |
| 196 | IPR029052 | G3DSA: 3.60.21.10 | Metallo-dependent phosphatase-like |
| 197 | IPR004843 | PF00149 | Calcineurin-like phosphoesterase Calcineurin-like phosphoesterase domain, apaH type |
| 198 | IPR006186 | PS00125 | Serine/threonine specific protein phosphatases signature. Serine/threonine-specific protein phosphatase/bis(5-nucleosyl)-tetraphosphatase |
| 199 | IPR008927 | SSF48179 | 6-phosphogluconate dehydrogenase C-terminal domain-like |
| 200 | IPR013328 | G3DSA: 1.10.1040.10 | 6-phosphogluconate dehydrogenase, domain 2 |
| 201 | IPR016040 | PF16363 | GDP-mannose 4,6 dehydratase NAD(P)-binding domain |
| 202 | IPR011128 | PF01210 | NAD-dependent glycerol-3-phosphate dehydrogenase N-terminus Glycerol-3-phosphate dehydrogenase, NAD-dependent, N-terminal |
| 203 | IPR006109 | PF07479 | NAD-dependent glycerol-3-phosphate dehydrogenase C-terminus Glycerol-3-phosphate dehydrogenase, NAD-dependent, C-terminal |

TABLE 317-continued

Details of Identified Domains

| Domain Identifier | InterPro No. | Accession No. | Description |
|---|---|---|---|
| 204 | IPR006168 | PR00077 | NAD-dependent glycerol-3-phosphate dehydrogenase signature Glycerol-3-phosphate dehydrogenase, NAD-dependent |
| 205 | IPR001509 | PF01370 | NAD dependent epimerase/dehydratase family NAD-dependent epimerase/dehydratase, N-terminal domain |
| 206 | IPR004938 | PF03254 | Xyloglucan fucosyltransferase Xyloglucan fucosyltransferase |
| 207 | IPR005225 | TIGR00231 | small_GTP: small GTP-binding protein domain Small GTP-binding protein domain |
| 208 | IPR001806 | PF00071 | Ras family Small GTPase superfamily |
| 209 | IPR003441 | SSF101941 | NAC domain |
| 210 | IPR008803 | PF05879 | Root hair defective 3 GTP-binding protein (RHD3) RHD3/Sey1 |
| 211 | IPR013657 | PF08449 | UAA transporter family UAA transporter |
| 212 | IPR017754 | MF_01841 | Agmatine deiminase [aguA]. Agmatine deiminase |
| 213 | IPR007466 | PF04371 | *Porphyromonas*-type peptidyl-arginine deiminase Peptidyl-arginine deiminase, *Porphyromonas*-type |
| 214 | IPR015120 | PF09032 | Siah interacting protein, N terminal Siah interacting protein, N-terminal |
| 215 | IPR007052 | PF04969 | CS domain CS domain |
| 216 | IPR007699 | PS51048 | SGS domain profile. SGS domain |
| 217 | IPR008978 | SSF49764 | HSP20-like chaperone |
| 218 | IPR001623 | PR00625 | DnaJ domain signature DnaJ domain |
| 219 | IPR018253 | PS00636 | Nt-dnaJ domain signature. DnaJ domain, conserved site |
| 220 | IPR003874 | PF02724 | CDC45-like protein CDC45 family |
| 221 | IPR002013 | PF02383 | SacI homology domain SAC domain |
| 222 | IPR031164 | PS51734 | MPBQ/MBSQ family SAM-binding methyltransferase profile. SAM-binding methyltransferase MPBQ/MBSQ |
| 223 | IPR004331 | PS51382 | SPX domain profile. SPX domain |
| 224 | IPR004046 | PF00043 | Glutathione S-transferase, C-terminal domain Glutathione S-transferase, C-terminal |
| 225 | IPR010987 | G3DSA: 1.20.1050.10 | Glutathione S-transferase, C-terminal-like |
| 226 | IPR002547 | PS50886 | tRNA-binding domain profile. tRNA-binding domain |
| 227 | IPR003527 | PS01351 | MAP kinase signature. Mitogen-activated protein (MAP) kinase, conserved site |
| 228 | IPR019821 | PS00411 | Kinesin motor domain signature. Kinesin motor domain, conserved site |
| 229 | IPR001752 | PR00380 | Kinesin heavy chain signature Kinesin motor domain |
| 230 | IPR017900 | PS00198 | 4Fe—4S ferredoxin-type iron-sulfur binding region signature. 4Fe—4S ferredoxin, iron-sulphur binding, conserved site |
| 231 | IPR017896 | PS51379 | 4Fe—4S ferredoxin-type iron-sulfur binding domain profile. 4Fe—4S ferredoxin-type, iron-sulphur binding domain |
| 232 | IPR007209 | PF04068 | Possible Fer4-like domain in RNase L inhibitor, RLI RNase L inhibitor RLI, possible metal-binding domain |
| 233 | IPR013283 | PR01868 | ABC transporter family E signature ABC transporter ABCE |
| 234 | IPR031100 | PF03641 | Possible lysine decarboxylase LOG family |
| 235 | IPR000225 | PS50176 | Armadillo/plakoglobin ARM repeat profile. Armadillo |
| 236 | IPR001202 | PF00397 | WW domain WW domain |
| 237 | IPR019012 | PF09445 | RNA cap guanine-N2 methyltransferase RNA cap guanine-N2 methyltransferase |
| 238 | IPR016558 | PIRSF009449 | DNA primase, large subunit, eukaryotic |
| 239 | IPR007238 | PF04104 | Eukaryotic and archaeal DNA primase, large subunit DNA primase large subunit, eukaryotic/archaeal |
| 240 | IPR003107 | SM00386 | HAT (Half-A-TPR) repeat |
| 241 | IPR003029 | PS50126 | S1 domain profile. S1 domain |
| 242 | IPR022967 | SM00316 | RNA-binding domain, S1 |
| 243 | IPR008847 | PF05843 | Suppressor of forked protein (Suf) Suppressor of forked |
| 244 | IPR005764 | MF_00004 | Adenine phosphoribosyltransferase [apt]. Adenine phosphoribosyl transferase |
| 245 | IPR000836 | PF00156 | Phosphoribosyl transferase domain Phosphoribosyltransferase domain |
| 246 | IPR029057 | G3DSA: 3.40.50.2020 | Phosphoribosyltransferase-like |
| 247 | IPR011991 | G3DSA: 1.10.10.10 | Winged helix-turn-helix DNA-binding domain |
| 248 | IPR015163 | PF09079 | CDC6, C terminal winged helix domain Cdc6, C-terminal |
| 249 | IPR016314 | PIRSF001767 | Cell division protein Cdc6/18 |
| 250 | IPR019974 | PS00841 | XPG protein signature 1. XPG conserved site |
| 251 | IPR006084 | PR00853 | Xeroderma pigmentosum group G/yeast RAD superfamily signature XPG/Rad2 endonuclease |
| 252 | IPR023426 | MF_00614 | Flap endonuclease 1 [fen]. Flap structure-specific endonuclease |
| 253 | IPR020045 | SSF47807 | 5'-3' exonuclease, C-terminal domain |
| 254 | IPR006086 | SM00484 | XPG-I domain |
| 255 | IPR006085 | PF00752 | XPG N-terminal domain XPG N-terminal |
| 256 | IPR002421 | SM00475 | 5'-3' exonuclease, N-terminal |
| 257 | IPR008918 | SM00279 | Helix-hairpin-helix motif, class 2 |

TABLE 317-continued

Details of Identified Domains

| Domain Identifier | InterPro No. | Accession No. | Description |
|---|---|---|---|
| 258 | IPR014908 | PF08801 | Nup133 N terminal like Nucleoporin, Nup133/Nup155-like, N-terminal |
| 259 | IPR007187 | PF03177 | Non-repetitive/WGA-negative nucleoporin C-terminal Nucleoporin, Nup133/Nup155-like, C-terminal |
| 260 | IPR007192 | PF04049 | Anaphase promoting complex subunit 8/Cdc23 Cdc23 |
| 261 | IPR013598 | PF08389 | Exportin 1-like protein Exportin-1/Importin-beta-like |
| 262 | IPR031327 | SM00350 | Mini-chromosome maintenance protein |
| 263 | IPR004039 | G3DSA: 2.20.28.10 | Rubredoxin-type fold |
| 264 | IPR001208 | PR01657 | Mini-chromosome maintenance (MCM) protein family signature MCM domain |
| 265 | IPR018525 | PS00847 | MCM family signature. Mini-chromosome maintenance, conserved site |
| 266 | IPR027925 | PF14551 | MCM N-terminal domain MCM N-terminal domain |
| 267 | IPR008049 | PR01662 | Mini-chromosome maintenance (MCM) protein 6 signature DNA replication licensing factor Mcm6 |
| 268 | IPR013949 | PF08640 | U3 small nucleolar RNA-associated protein 6 U3 small nucleolar RNA-associated protein 6 |
| 269 | IPR008047 | PR01660 | Mini-chromosome maintenance (MCM) protein 4 signature Mini-chromosome maintenance complex protein 4 |
| 270 | IPR003175 | PF02234 | Cyclin-dependent kinase inhibitor Cyclin-dependent kinase inhibitor |
| 271 | IPR016701 | PIRSF017811 | Cyclin-dependent kinase inhibitor, plant |
| 272 | IPR014978 | PS51666 | QLQ domain profile. Glutamine-Leucine-Glutamine, QLQ |
| 273 | IPR014977 | PF08879 | WRC WRC domain |
| 274 | IPR006218 | PF00793 | DAHP synthetase I family DAHP synthetase I/KDSA |
| 275 | IPR013785 | G3DSA: 3.20.20.70 | Aldolase-type TIM barrel |
| 276 | IPR006269 | MF_00056 | 2-dehydro-3-deoxyphosphooctonate aldolase [kdsA]. 3-deoxy-8-phosphooctulonate synthase |
| 277 | IPR025771 | PS51582 | Phosphoethanolamine N-methyltransferase (PEAMT) (EC 2.1.1.103) family profile. Phosphoethanolamine N-methyltransferase |
| 278 | IPR013216 | PF08241 | Methyltransferase domain Methyltransferase type 11 |
| 279 | IPR003480 | PF02458 | Transferase family Transferase |
| 280 | IPR023213 | G3DSA: 3.30.559.10 | Chloramphenicol acetyltransferase-like domain |
| 281 | IPR016039 | G3DSA: 3.40.47.10 | Thiolase-like |
| 282 | IPR012392 | PIRSF036417 | Very-long-chain 3-ketoacyl-CoA synthase |
| 283 | IPR013747 | PF08541 | 3-Oxoacyl-[acyl-carrier-protein (ACP)] synthase III C terminal 3-Oxoacyl-[acyl-carrier-protein (ACP)] synthase III, C-terminal |
| 284 | IPR013601 | PF08392 | FAE1/Type III polyketide synthase-like protein FAE1/Type III polyketide synthase-like protein |
| 285 | IPR011257 | G3DSA: 1.10.340.30 | DNA glycosylase |
| 286 | IPR005019 | PF03352 | Methyladenine glycosylase Methyladenine glycosylase |
| 287 | IPR004837 | PF01699 | Sodium/calcium exchanger protein Sodium/calcium exchanger membrane region |
| 288 | IPR004798 | TIGR00378 | cax: calcium/proton exchanger Calcium/proton exchanger CAX |
| 289 | IPR004713 | TIGR00846 | caca2: calcium/proton exchanger Calcium/proton exchanger |
| 290 | IPR002109 | PS51354 | Glutaredoxin domain profile. Glutaredoxin |
| 291 | IPR012336 | SSF52833 | Thioredoxin-like fold |
| 292 | IPR004480 | TIGR00365 | TIGR00365: monothiol glutaredoxin, Grx4 family Monothiol glutaredoxin-related |
| 293 | IPR004158 | PF03140 | Plant protein of unknown function Protein of unknown function DUF247, plant |
| 294 | IPR004342 | PF03124 | EXS family EXS, C-terminal |
| 295 | IPR001030 | SSF53732 | Aconitase/3-isopropylmalate dehydratase large subunit, alpha/beta/alpha domain |
| 296 | IPR006251 | TIGR01343 | hacA_fam: homoaconitate hydratase family protein Homoaconitase/3-isopropylmalate dehydratase, large subunit |
| 297 | IPR015932 | G3DSA: 3.40.1060.10 | Aconitase/3-isopropylmalate dehydratase large subunit, alpha/beta/alpha, subdomain 2 |
| 298 | IPR015931 | G3DSA: 3.30.499.10 | Aconitase/3-isopropylmalate dehydratase large subunit, alpha/beta/alpha, subdomain 1/3 |
| 299 | IPR000573 | PF00694 | Aconitase C-terminal domain Aconitase A/isopropylmalate dehydratase small subunit, swivel domain |
| 300 | IPR015928 | SSF52016 | Aconitase/3-isopropylmalate dehydratase, swivel |
| 301 | IPR007657 | PF04577 | Protein of unknown function (DUF563) Glycosyltransferase AER61, uncharacterised |
| 302 | IPR002935 | PF01596 | O-methyltransferase O-methyltransferase, family 3 |
| 303 | IPR000192 | PF00266 | Aminotransferase class-V Aminotransferase class V domain |
| 304 | IPR015422 | G3DSA: 3.90.1150.10 | Pyridoxal phosphate-dependent transferase, major region, subdomain 2 |
| 305 | IPR008630 | PF05637 | galactosyl transferase GMA12/MNN10 family Glycosyltransferase 34 |

TABLE 317-continued

Details of Identified Domains

| Domain Identifier | InterPro No. | Accession No. | Description |
|---|---|---|---|
| 306 | IPR009424 | PF06376 | Protein of unknown function (DUF1070) Arabinogalactan peptide, AGP |
| 307 | IPR025757 | PF14389 | Leucine-zipper of ternary complex factor MIP1 Ternary complex factor MIP1, leucine-zipper |
| 308 | IPR008936 | SSF48350 | Rho GTPase activation protein |
| 309 | IPR000198 | PS50238 | Rho GTPase-activating proteins domain profile. Rho GTPase-activating protein domain |
| 310 | IPR006620 | SM00702 | Prolyl 4-hydroxylase, alpha subunit |
| 311 | IPR005123 | PS51471 | Fe(2+) 2-oxoglutarate dioxygenase domain profile. Oxoglutarate/iron-dependent dioxygenase |
| 312 | IPR003582 | PS51670 | ShKT domain profile. ShKT domain |
| 313 | IPR005301 | SM01388 | MOB kinase activator family |
| 314 | IPR000109 | PF00854 | POT family Proton-dependent oligopeptide transporter family |
| 315 | IPR002885 | PS51375 | Pentatricopeptide (PPR) repeat profile. Pentatricopeptide repeat |
| 316 | IPR032867 | PF14432 | DYW family of nucleic acid deaminases DYW domain |
| 317 | IPR007676 | PF04597 | Ribophorin I Ribophorin I |
| 318 | IPR024709 | PIRSF009360 | O-fucosyltransferase, plant |
| 319 | IPR019378 | PF10250 | GDP-fucose protein O-fucosyltransferase GDP-fucose protein O-fucosyltransferase |
| 320 | IPR002347 | PR00081 | Glucose/ribitol dehydrogenase family signature Short-chain dehydrogenase/reductase SDR |
| 321 | IPR017853 | SSF51445 | Glycoside hydrolase superfamily |
| 322 | IPR008811 | PF05691 | Raffinose synthase or seed imbibition protein Sip1 Glycosyl hydrolases 36 |
| 323 | IPR003674 | PF02516 | Oligosaccharyl transferase STT3 subunit Oligosaccharyl transferase, STT3 subunit |
| 324 | IPR004528 | MF_00057 | 3-deoxy-manno-octulosonate cytidylyltransferase [kdsB]. 3-deoxy-D-manno-octulosonate cytidylyltransferase |
| 325 | IPR003329 | PF02348 | Cytidylyltransferase Acylneuraminate cytidylyltransferase |
| 326 | IPR006947 | G3DSA: 2.10.25.30 | EGF-like, alliinase |
| 327 | IPR006948 | PF04864 | Allinase Alliinase, C-terminal |
| 328 | IPR007300 | PF04172 | LrgB-like family CidB/LrgB family |
| 329 | IPR026823 | PF12662 | Complement Clr-like EGF-like Complement Clr-like EGF domain |
| 330 | IPR013105 | PF07719 | Tetratricopeptide repeat Tetratricopeptide repeat 2 |
| 331 | IPR022214 | PF12554 | Mitotic-spindle organizing gamma-tubulin ring associated Mitotic-spindle organizing protein 1 |
| 332 | IPR000571 | PS50103 | Zinc finger C3H1-type profile. Zinc finger, CCCH-type |
| 333 | IPR001057 | PR00474 | Glutamate 5-kinase family signature Glutamate/acetylglutamate kinase |
| 334 | IPR019797 | PS00902 | Glutamate 5-kinase signature. Glutamate 5-kinase, conserved site |
| 335 | IPR001048 | PF00696 | Amino acid kinase family Aspartate/glutamate/uridylate kinase |
| 336 | IPR016162 | G3DSA: 3.40.605.10 | Aldehyde dehydrogenase N-terminal domain |
| 337 | IPR020593 | PS01223 | Gamma-glutamyl phosphate reductase signature. Gamma-glutamyl phosphate reductase GPR, conserved site |
| 338 | IPR016163 | G3DSA: 3.40.309.10 | Aldehyde dehydrogenase, C-terminal |
| 339 | IPR016161 | SSF53720 | Aldehyde/histidinol dehydrogenase |
| 340 | IPR000965 | MF_00412 | Gamma-glutamyl phosphate reductase [proA]. GPR domain |
| 341 | IPR005766 | TIGR01092 | P5CS: delta l-pyrroline-5-carboxylate synthetase Delta 1-pyrroline-5-carboxylate synthetase |
| 342 | IPR015590 | PF00171 | Aldehyde dehydrogenase family Aldehyde dehydrogenase domain |
| 343 | IPR005715 | TIGR01027 | proB: glutamate 5-kinase Glutamate 5-kinase/delta-1-pyrroline-5-carboxylate synthase |
| 344 | IPR010613 | PF06732 | Pescadillo N-terminus Pescadillo |
| 345 | IPR001357 | SSF52113 | BRCT domain |
| 346 | IPR016435 | TIGR00322 | diphth2_R: diphthamide biosynthesis enzyme Dph1/Dph2 domain Diphthamide synthesis DPH1/DPH2 |
| 347 | IPR000727 | SM00397 | Target SNARE coiled-coil homology domain |
| 348 | IPR006012 | PS00914 | Syntaxin/epimorphin family signature. Syntaxin/epimorphin, conserved site |
| 349 | IPR010989 | SSF47661 | t-SNARE |
| 350 | IPR021538 | PF11416 | Syntaxin-5 N-terminal, Sly1p-binding domain Syntaxin-5, N-terminal, Sly1p-binding domain |
| 351 | IPR016300 | TIGR00345 | GET3_arsA_TRC40: transport-energizing ATPase, TRC40/GET3/ArsA family Arsenical pump ATPase, ArsA/GET3 |
| 352 | IPR025723 | PF02374 | Anion-transporting ATPase Anion-transporting ATPase-like domain |
| 353 | IPR024166 | PIRSF006515 | Ribosomal RNA assembly KRR1 |
| 354 | IPR004088 | SSF54791 | K Homology domain, type 1 |

TABLE 317-continued

Details of Identified Domains

| Domain Identifier | InterPro No. | Accession No. | Description |
|---|---|---|---|
| 355 | IPR000330 | PF00176 | SNF2 family N-terminal domain SNF2-related, N-terminal domain |
| 356 | IPR005554 | PF03813 | Nrap protein Nrap protein |
| 357 | IPR002119 | PR00620 | Histone H2A signature Histone H2A |
| 358 | IPR032454 | PF16211 | C-terminus of histone H2A Histone H2A, C-terminal domain |
| 359 | IPR009072 | G3DSA: 1.10.20.10 | Histone-fold |
| 360 | IPR007125 | PF00125 | Core histone H2A/H2B/H3/H4 Histone H2A/H2B/H3 |
| 361 | IPR032458 | PS00046 | Histone H2A signature. Histone H2A conserved site |
| 362 | IPR016903 | PIRSF028977 | Nucleolar complex-associated protein 3 |
| 363 | IPR005612 | PF03914 | CBF/Mak21 family CCAAT-binding factor |
| 364 | IPR011501 | PF07540 | Nucleolar complex-associated protein Nucleolar complex-associated protein 3, N-terminal |
| 365 | IPR032284 | PF16124 | RecQ zinc-binding ATP-dependent DNA helicase RecQ, zinc-binding domain |
| 366 | IPR018982 | SM00956 | RQC domain |
| 367 | IPR004589 | TIGR00614 | recQ_fam: ATP-dependent DNA helicase, RecQ family DNA helicase, ATP-dependent, RecQ type |
| 368 | IPR010997 | SSF47819 | HRDC-like |
| 369 | IPR002464 | PS00690 | DEAH-box subfamily ATP-dependent helicases signature. DNA/RNA helicase, ATP-dependent, DEAH-box type, conserved site |
| 370 | IPR002121 | PF00570 | HRDC domain HRDC domain |
| 371 | IPR001715 | PF00307 | Calponin homology (CH) domain Calponin homology domain |
| 372 | IPR004953 | PF03271 | EB1-like C-terminal motif EB1, C-terminal |
| 373 | IPR012982 | SM01335 | PADR1 domain |
| 374 | IPR001510 | PS50064 | Poly(ADP-ribose) polymerase zinc finger domain profile. Zinc finger, PARP-type |
| 375 | IPR003034 | PS50800 | SAP motif profile. SAP domain |
| 376 | IPR008893 | SM00773 | WGR domain |
| 377 | IPR008288 | PIRSF000489 | Poly [ADP-ribose] polymerase |
| 378 | IPR004102 | PF02877 | Poly(ADP-ribose) polymerase, regulatory domain Poly(ADP-ribose) polymerase, regulatory domain |
| 379 | IPR003316 | PF02319 | E2F/DP family winged-helix DNA-binding domain E2F/DP family, winged-helix DNA-binding domain |
| 380 | IPR032198 | PF16421 | E2F transcription factor CC-MB domain E2F transcription factor, CC-MB domain |
| 381 | IPR025064 | PF13178 | Protein of unknown function (DUF4005) Domain of unknown function DUF4005 |
| 382 | IPR000048 | PS50096 | IQ motif profile. IQ motif, EF-hand binding site |
| 383 | IPR025610 | PF14215 | bHLH-MYC and R2R3-MYB transcription factors N-terminal Transcription factor MYC/MYB N-terminal |
| 384 | IPR011598 | PS50888 | Myc-type, basic helix-loop-helix (bHLH) domain profile. Myc-type, basic helix-loop-helix (bHLH) domain |
| 385 | IPR014017 | PS51217 | UvrD-like DNA helicase C-terminal domain profile. UvrD-like DNA helicase, C-terminal |
| 386 | IPR014016 | PF00580 | UvrD/REP helicase N-terminal domain UvrD-like Helicase, ATP-binding domain |
| 387 | IPR024861 | PR02064 | Downstream neighbour of Son (DONSON) protein signature Donson |
| 388 | IPR003340 | PS50863 | B3 DNA-binding domain profile. B3 DNA binding domain |
| 389 | IPR010525 | PF06507 | Auxin response factor Auxin response factor |
| 390 | IPR015300 | G3DSA: 2.40.330.10 | DNA-binding pseudobarrel domain |
| 391 | IPR002687 | PS51358 | Nop domain profile. Nop domain |
| 392 | IPR012974 | PF08156 | NOP5NT (NUC127) domain NOP5, N-terminal |
| 393 | IPR012976 | SM00931 | NOSIC |
| 394 | IPR013725 | PF08519 | Replication factor RFC1 C terminal domain DNA replication factor RFC1, C-terminal |
| 395 | IPR008921 | SSF48019 | DNA polymerase III, clamp loader complex, gamma/delta/delta subunit, C-terminal |
| 396 | IPR012178 | PIRSF036578 | Replication factor C subunit 1 |
| 397 | IPR005484 | PF00861 | Ribosomal L18 of archaea, bacteria, mitoch. and chloroplast Ribosomal protein L18 |
| 398 | IPR019489 | PF10431 | C-terminal, D2-small domain, of ClpB protein Clp ATPase, C-terminal |
| 399 | IPR017730 | TIGR03346 | chaperone_ClpB: ATP-dependent chaperone protein ClpB Chaperonin ClpB |
| 400 | IPR001270 | PR00300 | ATP-dependent Clp protease ATP-binding subunit signature ClpA/B family |
| 401 | IPR028299 | PS00871 | Chaperonins clpA/B signature 2. ClpA/B, conserved site 2 |
| 402 | IPR018368 | PS00870 | Chaperonins clpA/B signature 1. ClpA/B, conserved site 1 |
| 403 | IPR004176 | SSF81923 | Clp, N-terminal |
| 404 | IPR013212 | SM00777 | Mad3/Bub1 homology region 1 |
| 405 | IPR001854 | PF00831 | Ribosomal L29 protein Ribosomal protein L29 |

TABLE 317-continued

Details of Identified Domains

| Domain Identifier | InterPro No. | Accession No. | Description |
|---|---|---|---|
| 406 | IPR000994 | PF00557 | Metallopeptidase family M24 Peptidase M24, structural domain |
| 407 | IPR004545 | TIGR00495 | crvDNA_42K: DNA-binding protein, 42 kDa PA2G4 family |
| 408 | IPR001714 | PR00599 | Methionine aminopeptidase-1 signature Peptidase M24, methionine aminopeptidase |
| 409 | IPR011051 | SSF51182 | RmlC-like cupin domain |
| 410 | IPR006045 | SM00835 | Cupin 1 |
| 411 | IPR014710 | G3DSA: 2.60.120.10 | RmlC-like jelly roll fold |
| 412 | IPR001929 | PR00325 | Germin signature Germin |
| 413 | IPR019780 | PS00725 | Germin family signature. Germin, manganese binding site |
| 414 | IPR004365 | PF01336 | OB-fold nucleic acid binding domain OB-fold nucleic acid binding domain, AA-tRNA synthetase-type |
| 415 | IPR002312 | PR01042 | Aspartyl-tRNA synthetase signature Aspartyl/Asparaginyl-tRNA synthetase, class IIb |
| 416 | IPR006195 | PS50862 | Aminoacyl-transfer RNA synthetases class-II family profile. Aminoacyl-tRNA synthetase, class II |
| 417 | IPR004364 | PF00152 | tRNA synthetases class II (D, K and N) Aminoacyl-tRNA synthetase, class II (D/K/N) |
| 418 | IPR004524 | TIGR00459 | aspS_bact: aspartate--tRNA ligase Aspartate-tRNA ligase, bacterial/mitochondrial-type |
| 419 | IPR029351 | PF02938 | GAD domain GAD domain |
| 420 | IPR004115 | G3DSA: 3.30.1360.30 | GAD-like domain |
| 421 | IPR031167 | PS51710 | OBG-type guanine nucleotide-binding (G) domain profile. OBG-type guanine nucleotide-binding (G) domain |
| 422 | IPR031662 | PF16897 | C-terminal region of MMR_HSR1 domain GTP binding protein, second domain |
| 423 | IPR012675 | G3DSA: 3.10.20.30 | Beta-grasp domain |
| 424 | IPR012676 | SSF81271 | TGS-like |
| 425 | IPR006073 | PR00326 | GTP1/OBG GTP-binding protein family signature GTP binding domain |
| 426 | IPR004095 | PF02824 | TGS domain TGS |
| 427 | IPR006074 | PS00905 | GTP1/OBG family signature. GTP1/OBG, conserved site |
| 428 | IPR019775 | PS00678 | Trp-Asp (WD) repeats signature. WD40 repeat, conserved site |
| 429 | IPR020472 | PR00320 | G protein beta WD-40 repeat signature G-protein beta WD-40 repeat |
| 430 | IPR007148 | PF04003 | Dip2/Utp12 Family Small-subunit processome, Utp12 |
| 431 | IPR013934 | PF08625 | Utp13 specific WD40 associated domain Small-subunit processome, Utp13 |
| 432 | IPR030381 | PS51718 | Dynamin-type guanine nucleotide-binding (G) domain profile. Dynamin-type guanine nucleotide-binding (G) domain |
| 433 | IPR022812 | PF00350 | Dynamin family Dynamin superfamily |
| 434 | IPR000261 | SM00027 | EH domain |
| 435 | IPR011992 | G3DSA: 1.10.238.10 | EF-hand domain pair |
| 436 | IPR002048 | SM00054 | EF-hand domain |
| 437 | IPR031692 | PF16880 | N-terminal EH-domain containing protein EH domain-containing protein, N-terminal |
| 438 | IPR020529 | PD315657 | SUBUNIT RECOGNITION ORIGIN COMPLEX 6-LIKE DNA-BINDING COMPLEX DNA NUCLEAR REPLICATION Origin recognition complex, subunit 6, metazoa/plant |
| 439 | IPR008721 | PF05460 | Origin recognition complex subunit 6 (ORC6) Origin recognition complex, subunit 6 |
| 440 | IPR031303 | PS00095 | C-5 cytosine-specific DNA methylases C-terminal signature. DNA methylase, C-5 cytosine-specific, conserved site |
| 441 | IPR001525 | PS51679 | C-5 cytosine-specific DNA methylase (Dnmt) domain profile. C-5 cytosine methyltransferase |
| 442 | IPR022702 | PF12047 | Cytosine specific DNA methyltransferase replication foci domain DNA (cytosine-5)-methyltransferase 1, replication foci domain |
| 443 | IPR001025 | SM00439 | Bromo adjacent homology (BAH) domain |
| 444 | IPR018117 | PS00094 | C-5 cytosine-specific DNA methylases active site. DNA methylase, C-5 cytosine-specific, active site |
| 445 | IPR022816 | PF05786 | Condensin complex subunit 2 Condensin complex subunit 2/barren |
| 446 | IPR012870 | PF07891 | Protein of unknown function (DUF1666) Protein of unknown function DUF1666 |
| 447 | IPR021881 | PF11995 | Domain of unknown function (DUF3490) NPK1-activating kinesin-like protein, C-terminal |
| 448 | IPR017970 | PS00027 | 'Homeobox' domain signature. Homeobox, conserved site |
| 449 | IPR001356 | SM00389 | Homeobox domain |
| 450 | IPR002913 | SM00234 | START domain |
| 451 | IPR023393 | G3DSA: 3.30.530.20 | START-like domain |
| 452 | IPR001267 | PIRSF035805 | Thymidine kinase |

TABLE 317-continued

Details of Identified Domains

| Domain Identifier | InterPro No. | Accession No. | Description |
|---|---|---|---|
| 453 | IPR020633 | PS00603 | Thymidine kinase cellular-type signature. Thymidine kinase, conserved site |
| 454 | IPR014646 | PIRSF036949 | Replication factor A protein 2 |
| 455 | IPR014892 | PF08784 | Replication protein A C terminal Replication protein A, C-terminal |
| 456 | IPR007846 | PS51472 | RNA-recognition motif (RRM) Nup35-type domain profile. RNA-recognition motif (RRM) Nup35-type domain |
| 457 | IPR017389 | PIRSF038119 | Nucleoporin, NUP53 |
| 458 | IPR029064 | SSF55315 | 50S ribosomal protein L30e-like |
| 459 | IPR002415 | PR00883 | High mobility group-like nuclear protein signature H/ACA ribonucleoprotein complex, subunit Nhp2, eukaryote |
| 460 | IPR018492 | PR00881 | Ribosomal protein L7A/RS6 family signature Ribosomal protein L7Ae/L8/Nhp2 family |
| 461 | IPR004038 | PF01248 | Ribosomal protein L7Ae/L30e/S12e/Gadd45 family Ribosomal protein L7Ae/L30e/S12e/Gadd45 |
| 462 | IPR012952 | PF08149 | BING4CT (NUC141) domain BING4, C-terminal domain |
| 463 | IPR006011 | SM00503 | Syntaxin, N-terminal domain |
| 464 | IPR001763 | G3DSA: 3.40.250.10 | Rhodanese-like domain |
| 465 | IPR025585 | PF13326 | Photosystem II Pbs27 Photosystem II Pbs27 |
| 466 | IPR003245 | PF02298 | Plastocyanin-like domain Phytocyanin domain |
| 467 | IPR008972 | G3DSA: 2.60.40.420 | Cupredoxin |
| 468 | IPR006361 | TIGR01464 | hemE: uroporphyrinogen decarboxylase Uroporphyrinogen decarboxylase HemE |
| 469 | IPR000257 | PF01208 | Uroporphyrinogen decarboxylase (URO-D) Uroporphyrinogen decarboxylase (URO-D) |
| 470 | IPR029320 | PF14749 | Acyl-coenzyme A oxidase N-terminal Acyl-coenzyme A oxidase, N-terminal |
| 471 | IPR013786 | G3DSA: 1.10.540.10 | Acyl-CoA dehydrogenase/oxidase, N-terminal |
| 472 | IPR012258 | PIRSF000168 | Acyl-CoA oxidase |
| 473 | IPR009100 | SSF56645 | Acyl-CoA dehydrogenase/oxidase, N-terminal and middle domain |
| 474 | IPR006091 | PF02770 | Acyl-CoA dehydrogenase, middle domain Acyl-CoA oxidase/dehydrogenase, central domain |
| 475 | IPR002655 | PF01756 | Acyl-CoA oxidase Acyl-CoA oxidase, C-terminal |
| 476 | IPR009075 | SSF47203 | Acyl-CoA dehydrogenase/oxidase C-terminal |
| 477 | IPR020568 | SSF54211 | Ribosomal protein S5 domain 2-type fold |
| 478 | IPR000754 | PF00380 | Ribosomal protein S9/S16 Ribosomal protein S9 |
| 479 | IPR023035 | MF_00532_B | 30S ribosomal protein S9 [rpsI]. Ribosomal protein S9, bacterial/plastid |
| 480 | IPR014721 | G3DSA: 3.30.230.10 | Ribosomal protein S5 domain 2-type fold, subgroup |
| 481 | IPR020574 | PS00360 | Ribosomal protein S9 signature. Ribosomal protein S9, conserved site |
| 482 | IPR028098 | PF13439 | Glycosyltransferase Family 4 Glycosyltransferase subfamily 4-like, N-terminal domain |
| 483 | IPR001296 | PF00534 | Glycosyl transferases group 1 Glycosyl transferase, family 1 |
| 484 | IPR011013 | SSF74650 | Galactose mutarotase-like domain |
| 485 | IPR030458 | PS00129 | Glycosyl hydrolases family 31 active site. Glycosyl hydrolases family 31, active site |
| 486 | IPR000322 | PF01055 | Glycosyl hydrolases family 31 Glycoside hydrolase family 31 |
| 487 | IPR031727 | PF16863 | N-terminal barrel of NtMGAM and CtMGAM, maltase-glucoamylase Galactose mutarotase, N-terminal barrel |
| 488 | IPR025887 | PF13802 | Galactose mutarotase-like Glycoside hydrolase family 31, N-terminal domain |
| 489 | IPR010908 | PF13774 | Regulated-SNARE-like domain Longin domain |
| 490 | IPR011012 | SSF64356 | Longin-like domain |
| 491 | IPR001388 | G3DSA: 1.10.3840.10 | Synaptobrevin |
| 492 | IPR005333 | PF03634 | TCP family transcription factor Transcription factor, TCP |
| 493 | IPR017887 | PS51369 | TCP domain profile. Transcription factor TCP subgroup |
| 494 | IPR004883 | PF03195 | Protein of unknown function DUF260 Lateral organ boundaries, LOB |
| 495 | IPR010164 | TIGR01885 | Orn_aminotrans: ornithine--oxo-acid transaminase Ornithine aminotransferase |
| 496 | IPR005814 | PS00600 | Aminotransferases class-III pyridoxal-phosphate attachment site. Aminotransferase class-III |
| 497 | IPR011006 | SSF52172 | CheY-like superfamily |
| 498 | IPR001789 | SM00448 | Signal transduction response regulator, receiver domain |
| 499 | IPR010402 | PS51017 | CCT domain profile. CCT domain |
| 500 | IPR008509 | PF05631 | Sugar-tranasporters, 12 TM Molybdate-anion transporter |
| 501 | IPR005478 | TIGR00232 | tktlase_bact: transketolase Transketolase, bacterial-like |
| 502 | IPR005474 | PF00456 | Transketolase, thiamine diphosphate binding domain Transketolase, N-terminal |
| 503 | IPR009014 | G3DSA: 3.40.50.920 | Transketolase C-terminal/Pyruvate-ferredoxin oxidoreductase domain II |
| 504 | IPR033248 | PF02780 | Transketolase, C-terminal domain Transketolase, C-terminal domain |

TABLE 317-continued

Details of Identified Domains

| Domain Identifier No. | InterPro No. | Accession No. | Description |
|---|---|---|---|
| 505 | IPR029061 | SSF52518 | Thiamin diphosphate-binding fold |
| 506 | IPR005475 | SM00861 | Transketolase-like, pyrimidine-binding domain |
| 507 | IPR020826 | PS00802 | Transketolase signature 2. Transketolase binding site |
| 508 | IPR002933 | PF01546 | Peptidase family M20/M25/M40 Peptidase M20 |
| 509 | IPR017439 | PIRSF005962 | Amidohydrolase |
| 510 | IPR011650 | SSF55031 | Peptidase M20, dimerisation domain |
| 511 | IPR002495 | PF01501 | Glycosyl transferase family 8 Glycosyl transferase, family 8 |
| 512 | IPR027370 | PF13445 | RING-type zinc-finger RING-type zinc-finger, LisH dimerisation motif |
| 513 | IPR023614 | G3DSA: 2.40.160.10 | Porin domain |
| 514 | IPR027246 | PF01459 | Eukaryotic porin Eukaryotic porin/Tom40 |
| 515 | IPR000308 | PIRSF000868 | 14-3-3 protein |
| 516 | IPR023409 | PS00796 | 14-3-3 proteins signature 1. 14-3-3 protein, conserved site |
| 517 | IPR023410 | SSF48445 | 14-3-3 domain |
| 518 | IPR006689 | PR00328 | GTP-binding SAR1 protein signature Small GTPase superfamily, ARF/SAR type |
| 519 | IPR029903 | PF04321 | RmlD substrate binding domain RmlD-like substrate binding domain |
| 520 | IPR030395 | PF03009 | Glycerophosphoryl diester phosphodiesterase family Glycerophosphodiester phosphodiesterase domain |
| 521 | IPR017946 | G3DSA: 3.20.20.190 | PLC-like phosphodiesterase, TIM beta/alpha-barrel domain |
| 522 | IPR001360 | PF00232 | Glycosyl hydrolase family 1 Glycoside hydrolase family 1 |
| 523 | IPR033132 | PS00653 | Glycosyl hydrolases family 1 N-terminal signature. Glycosyl hydrolases family 1, N-terminal conserved site |
| 524 | IPR013781 | G3DSA: 3.20.20.80 | Glycoside hydrolase, catalytic domain |
| 525 | IPR024156 | PS51417 | small GTPase Arf family profile. Small GTPase superfamily, ARF type |
| 526 | IPR005854 | PIRSF000485 | Amidophosphoribosyltransferase |
| 527 | IPR029055 | G3DSA: 3.60.20.10 | Nucleophile aminohydrolases, N-terminal |
| 528 | IPR017932 | PS51278 | Glutamine amidotransferase type 2 domain profile. Glutamine amidotransferase type 2 domain |
| 529 | IPR032259 | PF16113 | Enoyl-CoA hydratase/isomerase Enoyl-CoA hydratase/isomerase, HIBYL-CoA-H type |
| 530 | IPR029045 | G3DSA: 3.90.226.10 | ClpP/crotonase-like domain |
| 531 | IPR019956 | PR00348 | Ubiquitin signature Ubiquitin |
| 532 | IPR001975 | SM01377 | Ribosomal protein L40e |
| 533 | IPR011332 | SSF57829 | Zinc-binding ribosomal protein |
| 534 | IPR019954 | PS00299 | Ubiquitin domain signature. Ubiquitin conserved site |
| 535 | IPR029071 | SSF54236 | Ubiquitin-related domain |
| 536 | IPR000626 | SM00213 | Ubiquitin domain |
| 537 | IPR005979 | TIGR01289 | LPOR: light-dependent protochlorophyllide reductase Light-dependent protochlorophyllide reductase |
| 538 | IPR002710 | PF01843 | DIL domain Dilute domain |
| 539 | IPR004009 | PF02736 | Myosin N-terminal SH3-like domain Myosin, N-terminal, SH3-like |
| 540 | IPR001609 | PR00193 | Myosin heavy chain signature Myosin head, motor domain |
| 541 | IPR002143 | PIRSF002155 | Ribosomal protein L1 |
| 542 | IPR023674 | SSF56808 | Ribosomal protein L1-like |
| 543 | IPR016095 | G3DSA: 3.40.50.790 | Ribosomal protein L1, 3-layer alpha/beta-sandwich |
| 544 | IPR028364 | PF00687 | Ribosomal protein L1p/L10e family Ribosomal protein L1/ribosomal biogenesis protein |
| 545 | IPR023673 | PS01199 | Ribosomal protein L1 signature. Ribosomal protein L1, conserved site |
| 546 | IPR016094 | G3DSA: 3.30.190.20 | Ribosomal protein L1, 2-layer alpha/beta-sandwich |
| 547 | IPR006501 | TIGR01614 | PME_inhib: pectinesterase inhibitor domain Pectinesterase inhibitor domain |
| 548 | IPR023271 | SSF81338 | Aquaporin-like |
| 549 | IPR022357 | PS00221 | MIP family signature. Major intrinsic protein, conserved site |
| 550 | IPR000425 | PR00783 | Major intrinsic protein family signature Major intrinsic protein |
| 551 | IPR003851 | PS01361 | Zinc finger Dof-type signature. Zinc finger, Dof-type |
| 552 | IPR026057 | PF13839 | GDSL/SGNH-like Acyl-Esterase family found in Pmr5 and Cas1p PC-Esterase |
| 553 | IPR025846 | PF14416 | PMR5 N terminal Domain PMR5 N-terminal domain |

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

LENGTHY TABLES

The patent contains a lengthy table section. A copy of the table is available in electronic form from the USPTO web site (http://seqdata.uspto.gov/?pageRequest=docDetail&DocID=US10766935B2). An electronic copy of the table will also be available from the USPTO upon request and payment of the fee set forth in 37 CFR 1.19(b)(3).

SEQUENCE LISTING (26736 sequences)

SEQ ID NO: 1 - DNA, 2000 bp, Triticum Sp.
  Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 2 - DNA, 1919 bp, Triticum Sp.
  misc_feature (1306)..(1316): n is a, c, g, or t
  misc_feature (1649)..(1649): n is a, c, g, or t
  Wheat LMW Longer Promoter
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 3 - DNA, 326 bp, Triticum Sp.
  misc_feature (56)..(56): n is a, c, g, or t
  Wheat LMW Promoter
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 4 - DNA, 2000 bp, Triticum Sp.
  Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 5 - DNA, 425 bp, Triticum Sp.
  Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 6 - DNA, 595 bp, Triticum Sp.
  Wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 7 - DNA, 1238 bp, Triticum Sp.
  misc_feature (1231)..(1231): n is a, c, g, or t
  Wheat gamma gliadin Promoter
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 8 - DNA, 2162 bp, Triticum Sp.
  Wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 9 - DNA, 2147 bp, Triticum Sp.
  Wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10 - DNA, 1992 bp, Zea mays
  Maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 11 - DNA, 1358 bp, Zea mays
  Maize Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 12 - DNA, 1266 bp, Oryza sativa
  Rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 13 - DNA, 2199 bp, Oryza sativa
  Rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 14 - DNA, 1024 bp, Oryza sativa
  Rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 15 - DNA, 2103 bp, Arabidopsis thaliana
  Arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 16 - DNA, 901 bp, Oryza sativa
  Rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 17 - DNA, 844 bp, Oryza sativa
  Rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 18 - DNA, 602 bp, Hordeum vulgare
  Barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 19 - DNA, 1729 bp, Hordeum Sp.
  Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 20 - DNA, 879 bp, Oryza sativa
  Rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 21 - DNA, 666 bp, Cauliflower mosaic virus
  CaMV 35S (pQXNc) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 22 - DNA, 781 bp, Brachypodium Sp.
  PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 23 - DNA, 877 bp, Cauliflower mosaic virus
  CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 24 - DNA, 2322 bp, Arabidopsis thaliana
  Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 25 - DNA, 2318 bp, Arabidopsis thaliana
  Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 26 - DNA, 1321 bp, Brachypodium Sp.
  Brachypodium RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 27 - DNA, 1599 bp, Arabidopsis thaliana
  Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 28 - DNA, 1774 bp, Arabidopsis thaliana
  Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 29 - DNA, 1127 bp, Brassica napus
  Brassica napus (Canola) NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 30 - DNA, 916 bp, Arabidopsis thaliana
  Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 31 - DNA, 3965 bp, Arabidopsis thaliana
  Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 32 - DNA, 4074 bp, Arabidopsis thaliana
  Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 33 - DNA, 1700 bp, Arabidopsis thaliana
  Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 34 - DNA, 1096 bp, Arabidopsis thaliana
  Arabidopsis RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 35 - DNA, 2432 bp, Arabidopsis thaliana
  Arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 36 - DNA, 277 bp, Agrobacterium tumefaciens
  Agrobacterium tumefaciens NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 37 - DNA, 538 bp, Cauliflower mosaic virus
  35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 38 - DNA, 555 bp, Streptomyces hygroscopicus
  Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 39 - DNA, 562 bp, Artificial Sequence
  BAR_GA
agcagccatgagcccagagaggcgcccagccgatatcagaagggctacagaggccgatatgccggccgtgtgcaccatcgtgaaccactacatcgagacatccaccgtgaacttcaggaccgagccgcaagagccacaagagtggaccgatgatctcgtgaggctccgcgagagatacccatggctcgtggctgaagtggatggcgaggttgccggcattgcttatgctggcccatggaaggctaggaacgcctacgattggaccgccgagtccacagtgtacgtgtccccaaggcatcagagaaccggcctcggctctaccctctacacccatctgctcaagtcccttgaggcccaaggcttcaagtctgtggtggctgttatcggcctcccgaacgatccatccgtgaggatgcatgaggctctcggctatgccccaaggggaatgctcagagctgctggcttcaagcacggcaactggcacgatgtgggcttttggcagctcgacttcagcctcccagttccgccaagaccagtgctcccagtgaccgagatctgatga

SEQ ID NO: 40 - DNA, 1822 bp, Gossypium hirsutum
agcaaccttcttctccactcctccatctatatatatagttagaggcagaagggaggaagtgacattggcaatatggctttgctgcattcttacttcttaagcgctggtgagtatgtttcagggtccacggtcttggcagtggcaatgtccattgcttcctattttctgatccctatggtgtttggtggtcgccataaaaactggaagaatgcaccaccaggccctgttggttggcctatccttggcagccttccacacctctccaatcgtctccatgaagatttctttgacatggccaagatctacggtccccttttcagtctaaacttgggaataaagccggccatagtggtgtcatcaccggaaatggcagcccaagttttgaaggaaaaggaagggatgttctccagtcggaccataaccgagaccattcgagtcatctcttatgatgcccattccatcattttctcgccctatggtcccaggtggaaggttcttcgaaggatcttgatcaccgaactactttctcctaaggcctttgaacaatttgagccacttcgtacctcacaggttcatggtttgctcaagtatttgtacttggtctcaaagtccaacactcaagtgaacatagcagaatatgcttttacagcactggccaacctagtgagtaatttcgtctgctccaaggaccttttcgacaactcaatgcctgaaggaagacaaatgaaagagaggttctgggagttgataaaggtgattgggaccccgaatttttctgatctcattccatttgttaaaccatttgatccacaaggcttgaagagaaaaatcaacaagatcttcggccagttggatgctttctatgagaagttaattgaggagaggtttgctgagaagggaaaagctcaacttgatgggacgataccctacaaacggaaaatggatatgttagatgttctgttgagttatgagagtaatgataaacaaaatggtttggacagtttaccaaaatctatcgtcaaaggaatgctttctgaaatgtttattgcaggaactgagacaacctcaagcactgtggagtggggcatggcagaaatcctaagaaaacctagtgtagtcaagaaactgctactggaactggatcaagttgtagggaaggacagatttgtggtggaaagcgatatcccgaagctgacataccttcaggcagttgtgaaagaagttttcagactgcaccctggcgttccactcatcatccctcgtcgcaccaacgaggcatgcgaggtagctggctaccatatccccaagcactgcatcgtttacgtgaacgtttggggaatggcaagggatcctaatgtgtgggaagatccactggagttcaagccggagaggttcatagggtcaagcgtggatgtgaagggccaagactttaacctcttaccgtttgggacggggagaaggtcgtgcgtgggatggccactggctcatcgcatggtgcactattacttggcagctctgctccatgctttccagtgggagtcacctccagatgtcctgaatgatctgggggagagagtggggcttactattcagaaaggtaagagcttgcttagcactcccaagcctcgactgccagcctctgtttatgagcgttagaacggcaccatccaagtataagttagagtgtgcctgtaatgttcctatgttatgttcttatgtttaatacataatgcgaagggtgctcaaatgaaagtttggtggcaatcttgtctaccaacatttatgtatcgcggcattataataaaaataatatgttaccctt

SEQ ID NO: 41 - DNA, 2575 bp, Hordeum vulgare
ggtgccacgggccaccgcgaccgaccgacctctgacccctcactcgggagccacacctcgtcactccaccgcgcactgcacgcagcccgcactccatggcgccgctccactgaaatccaccacctccccagcccgcaaaaccccaaacaaacccgaaaatgccggcgccggccatccaccctctccccctcctcctcctcgccgccaccatcgccaccgcgtccgccgccgtcccgcccgccgcgtcgcactcccagcccacgctgcccaccaaaggggcggccgcgggcgcgtcgcactcccagcccacgaaacccgcggcgccgccggccgccgcgctggcctcggccccgccggcggagggggcgctgctggcggccttcctcgccaaggccgacccgacggcgcacctgcggttccccctcgccgccaccccctgcgcgcacccgggcgtgacctgcagcggcgcggcggggatcacgcacctcgtgctcgagcaggccggcctcaacggcaccttcccgccggacacgatctcgggcctcgccgggctgcgcgtgctcagcctcaagtccaacgcgctccacgggccggtccccgacctctccgcgctcggtaacctcaaggcgctcttcctcgccggcaaccgcttctccggcccgttcccggcctcgctcgcctcgctgcgccgcctccgctccatcgacctgtccgggaaccggttctccggcgcgctcccgcccggcatcgaggccgcgttcccgcatctcacggccctgcggctggattccaaccacttcaatggctccgtccccgcctggaaccagtcgtcgctgaagcagctgaatgtctcgtacaacgacttctccggccccgtgcccgttaccgcatccatggcgctcatgggcgccgacgcgttcgccgggaaccccggcctctgcggcgaggtcgtccgccgcgagtgccgcggctcccccctcgtcttcttccccgacgatggcacgagcggctccgccactccccccgcgcagagcgccggtgtcactggcgatggcccgcagcgccagggcctaccgagctcgtcgtcggcagcgcgcgcgcacaaagtgaagaagaagacggcgttgaccgtcgccgttgctctcgcggctgtcctggcagtgcttctcgtttgcgccatcattgccgcgaggaggggcaagaagaggaggcggcccagcacggcggcatacccaagccccaagaagagcgcggccgcgtcgcagctcagcagggagctggacaacgccgacattggctatgtggagtgcgtgccggacgaggaggcggcggcgatgatgatgccggaggagaaggctcgccggctgggccggagcggctgcctgacgttctgcgcgggcgaggccacgagctacagtctggagcagctgatgcgcgcgtcggcggaggtgcttggccgcgggagcgtggggacgacgtacaaggcggtgctcgacggccggctcgtagtcatcgtcaagaggctggacgccgccaagatcggcccggcagcctccgaggcagagaccttcgagcagaacatggatgtgatcgggcggctgcggcacccgaacctcgtgccgctgcggtcgttctttcaagccaaggaggagcggctgctggtgtacgactaccagcccaacggcagcctccattctctcatccacggttcaagatcgtcccggggaaaaccactgcactggacttcatgcctgaagatagcagaagatgttgcacagggccttgcctacatccatcaagcatctcggcttgttcatggaaacatcaagtcctccaacgtcttgcttggttcagacttcgaggcttgcctcaccgacaactgcctttcattccttctggaatcagcagaagtcaaagacgacgccgcgtacagagcaccagaaaacatgaagtccaacagaaggctcacacccaaatcagatgtctatgcttttggaatccttctccttgagctcctcagcggcaaggcaccactcgagcactcggtcttagcggcaaccaatctccagacatatgctctgtcggggagggaagacgaaggtatcgacagcgagcgactctcgatgatcgtcgacattgcgtctgcttgtgtccggtcgtcgccagagagtcgaccaactgcgtggcaggtcctcaagatgattcaggaggtgaaggaagcagataccaccggtgacaatgaggacggtgatcttactagcgactcctagaccctcttgtggatgaaatggatcgtgtccactggatgcattatcccaagtgagcaatcgtagttacaatgcagtttgctctgcctagaaaagctgatggaaggcgttagtggtgtaggagaatggatttggggtcatgatctctctgactggtatcttttgagctccgaatgctgtaacatatgttagccccccctcccctcccgtggtaattggtgtatggatgctgtggtgatgtggtcatgtttttttagcatcaatcttccttggagatttatattatagtgaagttaaaggccaaagtc

SEQ ID NO: 42 - DNA, 2789 bp, Hordeum vulgare
ggcgctaaaccctacacaccctcgccgccgccgtcgccgtcgccggagaagagtcggggatggggggagggccgcggacgttcgcgggggggctgtccaagtggcagcacaagcggatgcacgagaagctggcgcgggggaaggagcggggcctgctgcggcacgagaagcagctctacctcgcccgcctccgctccgagatccgcgcctcccacctccccggcgcccccgcctcccccgccgaccacgccgggccgacctcctcccgcgcccacatccgcgccctcgccgaccgcttcctccgccccggcgccgaggacctctggaacgacgacgacggcccgctccgccgcgcgcggctgccctcgcagcagaagaatgcggcgaggaccctgccgtccggcgcccggatggtcgactggaagcgggtggagtccggggagaggccgaagccgccccggggaggaggggactggaaggactgggaggagctggattcgggggagccgagggccggcaggggagccggaaatgagcagccgcgattgccggccgcgtttagtcagaggagagggtacgggacggtggctccctggtggtggcaatggagcccgggctcgggcacaccttcgcagaggaaggaggcgtccttcggcttcttcggcctgaagagatgctactcggcgatgcctccactctcaccgcgtcaggaatcgggtgccgcgctaatgccgttgggtgttcgacagctctccgaggctgggggtggcacgaaggggacaccgccggctctgttctatgctcaggagaggttgtactcgggagcagccccgcggcggtttggccagaaatggaggccggattcatcggacgaggatgaggaggtcatgccacctgcaaagagggatctgaggttggcgaaattcgtggcttcaagggaagatgagtcggaagatgatgaagtgggggagacgagcgccatcaggaggaaatggagcagtgctgctctgaggaactgcgatatgaagagagataggaggccgctcaagtcctacgaggaggaaagcgatgatatcactggcagaatccaagagctgcgagaggagataagaaatagggaggtgctgggtgctgagaggcggcgctatgagtcgaggggtgaatctgtgtttacaaataaaagattcgatgaatgtggcatctccccacttactgtcaaagcactcactgatgctggatatatacatacaaccgttgtccaggaagcagcccttccaatttgtcttgaaggtaaagatgttcttgtcaaggccaaaactggaaccggcaaaagtgtagcttttctgcttcctgcaattgaatcagtcttgaatgccatgaagagccatacaaatcatcgagtgtctccaatattcgcccttgttctatgccctacaagagagcttgccgtccaggttacagctgaggcaaatgttttggtgaagtaccatcatggagtgggtgttcagtctcttattggtggtactagattcaagcttgatcagagacggttagagtctgacccatgccagattttagtggcaacacctggaaggctgctggatcatattgaaaacagatcttcattctctgtccgcttgatggggttgaaattgcttgtattggatgaagctgaccacttgctagatttgggttttcgcaaagacatagagaagattgctgatagcttgccacgccaaagacagacactactattttcagctactattccaaaagaggttcgaagggtttcacagatggttttaaacaaggatcatgtttttgttgatacagtgggcttgggagctgttgaaactcctactaaggtgcagcagcaatatcttgtggtaccacatgaactacactttcatatggttcatcgccttcttcgagagcatattgatcaggaagtggactataaggtaattgttttctgcacaacagccatggttactgaatttatgtatataatgcttcgagatctgaagctaaacgtcagagagatacattcaagaaagcctcagctttacagaacacgtatatctgaagagttccgggattccaatcgcctgattctggtaacatcagatgtttcaacacgtggagtgaattatccagatgttaccctagtgattcaggctggtgttcctcctggcagagagcattatattcatcgtcttggaaggactggaagggaaggtaaatcagggaaaggaattctgttgattgcgccatgggaagagtatttcttgaacgagatacatgatctcccaatagagaaggctcctgtgccacagattgatcaggagatgaaacaaaaggttgatgattcgatcaagattgttgacatgagcatcaaggaagccgcataccatgcatggcttggttactataactcgatagctgatgttagcagagacaaagtcatgcttgctgacctggcaagtaggtttggtgtctctatcggcatggaaaagcctccgacgctgtataggaaaaccgccttgaagatggggttaaagggtgtgccgggaattcggataagaaaatgaataaccaagttttgtctcccattctgtaattcgtcttatttctaattttcactacatcaagtttgaaaatgatctatgtcttgtcgactggctcagacgaagaagcactctcacatttttcctagagccttacactcatctgaatgagctttagtcgactgtgacagatgaatgttaggcattattgccatattatcc

SEQ ID NO: 43 - DNA, 1489 bp, Hordeum vulgare
cggcgcacgcctaaaccctagccagccctcgcccccgccgccgccgcacgcacgaccaacccgacacccccgcaaggcgagcgagcagccaaccgtcccccggcgccggcggctggcgaggatgggccgtgagaagtcccggaggctctccggcagccgagacttccggcagcggctggtgctggcgacgctcacctccacccccatcgtcatcaaggacatccgcgccggcgagggcggcctccgcccgcacgagatgtccctcctccacctcctcgacaaggtctccgaccagcacgccatcgacgtcaacgacacagggacgaaggttgggtacaagcccggggtgatcgtcggcgggaaggacctggagcacgactgcggggtgcaccgcgggatcggctacttcatcgagccgctcgttctgctcggcctcttcgccaggtcgcccttgtccattcggctcaaaggaatcacaaatgatgcaaaggacccttctgtggatactttccggatggttacgttgcatatgctcaagcattttggtgttcctcttgaggggctggagctcaaaattgaatgccggggaactcctccctgtggtggtggtgaagtgcttcttcgagtccccaatataaacagtacattaaaggcagtcaattgggttgatgaaggcatggtaaagaggataagaggtgtgacattcgccaccaaagtatctccacagattggaacccgtatcgtctatgctgcacgtggactcttcaataagttcattccagatgttcatatcttcaccgatcatagagttggtttatctggtggattgtcaacaggctatggcttatctgtagttgccgaaaccacaacaggctgtctgatttctgcagattcttccgtgagttatcccaatgttgataaaatgagtgaacaatccaagaagcctgagctaatgtctccagaggatcttggtgagcaagttgcatcgatgctgctagaagaggtggctcaaggaggagttgttgactcaacacatcagggccttctgttcatgttgtgcgctctctgcccgcccgatgtgtcaaaggtacgcgtgggacagctgacaccgcacgctatagaatcacttcgaaacatcaaggagttccttgatgtcaagttcatcatcaagcctgacccaaactcaaacacggttattctaaaatgtgttggtgccggagtgaagaatcttgctcggaagatttcataaacctcatctaggatggaaagcagtgttttggaaccgcaacacaggaattttcaagttttgttgcaagtgtgttgtggatcttcttccccggattagttttgatgcaagctagttgatccagaatggatttgcctgatcatgttatcttgtacccttgatcgtatatccttagatctaatagaacaactactgtttcctgagaaaacatgggtgtgagattttcacattgagatttctgct

SEQ ID NO: 44 - DNA, 877 bp, Hordeum vulgare
acgccttctctcgcctctcgccgcctagtgcgtgccgccgtcggccccatcgccttcgagcatcagccatggcagagcagactgagaaggctttcctgaagcagcctaaggtgttcctctgctcaaagaaggccacaaaggggaacaataagcctggcaaggagggcaacaggttctggaagagtgttggccttggtttcaagactcccaaggaagccattgagggaacctacattgataagaagtgcccattcactggcactgtgtcaattaggggtcgcatcattgctggaacatgtcatagtgctaaaatgaacaggaccatcattgttcgtaggaactaccttcactatgtgaaaaaataccagaggtacgagaagaggcactccaacatccctgcccacatttccccttgcttccgtgtgagagaaggagatcatgtgatcattggccagtgcaggccactgtccaagactgtgcggttcaatgtgttgaaggtcgtcccagcagggtcaaagagtggtgctgtcaagaaggcgttcaccggtgtctgagcaagtcatgaccttttttctctgaaaccttttctccatgaaattttgacgtcacatctatattcttccatctgtgtgtacgagggttttgccttgattgttctccaagcttccaagtcaagagtgaggggtttagtgaagttatgttcagagtgcttcgtgaaggagatttttgatgctgttacctggttactcgttaatatacatcactctttttggccttttgcttgtgacgtaatctgaatttagtctgtaatgtttatctagtactaccaacaaagtttcagcacgcaagtgctgatttatcacatctatctgttgtt

SEQ ID NO: 45 - DNA, 999 bp, Hordeum vulgare
gcttacttgccgccattataagagcgacccccttgcccgcctcacgtcgcctccggcacgctcctctctctctctccctccctctgtgccctctctcgcctgcttttaccatccggttgttgcggcggcggcggcgatggcggcggaggacgtggagttcgtggactacgagcggggcgaggacgaggacgacgaggggatggaggacgaggaggacggggaggtctcggcccgcgcgctccccgtgccccgcatcgccgtcgccccctccgtgccgcgcaccggcagggggcgcttcgtcggccgcagccgctccgtcatggcctccacccgcgaccgcttcgactccatccccttcgccggcagctccgcgcacggcggcccgcagcgctcaattgaaggatggatactacttgtctccggagtcaaagaagatgcagaagaaagtgatttgtatgatgcttttgctgagtttggtgaggtcaaggacttgcatttcaatctggaacgtcgcactggatatggcaagggatatgcattgattgaatatggatgttttgaggaagcacaaactgcaatcagaagaatgaatgggacagagctgttaacaaagactatccatgttgattgggcattcaacagaggtcctatacagaaggccacgagtacaggaccagcacagcgacggtctaggactccgcctcgcaggcttgctgccatgacatactgagagggcgctgctaggcctgcaatctcggaccagtattggtcagtgttttatggtactgcttgtcagggatatttgctatgtcatagattttagtcgtaaccagttgtcttacggcagtaagcggtaaccgaacaatgagccgagtatggtccagaaactgagtcctgattctgccatccttgctacgcctgtagtgagcttgttcagtggatttgctcccaaactttactttgatattttgaatcgatgatgcaaattgttttgtcttt

SEQ ID NO: 46 - DNA, 2466 bp, Setaria italica
agcgaaaaggaaacaacaaatcaactgcaaaagaacaaaaaaaaaaaagaaccaagagtgaaatcagaagcagcccccaaggcgccgcaccctgctctctgaccgccgcgcaaacccctaaaccctagccgcactaggccctctccccctccttcaccggcggcggcggcggcggcggctgcgggaggccaccagtatcgggacgaggagaagcgtcgcatacacagcttttgcagagatgccgctggggcagcgcgcgggggacaagagcgactcccgctactgcggggtggaggtgctcgacttccccgccggcgagggcctccccgccgtccttaaccactccctcgcctccgccttcgacttcatcctcgccccgctggtcgaccccaactaccggcccacgcccggcgccgtgctgcctgtgtcggcgtcggacctcgtcctcggcccggcccagtggagcaaccacgtcgtcgggaagatcagcgagtggattgatttggacgcggaggacgagcggctccggctggactcggagctcacgctgaagcaggagatcgcgtgggcgtctcacctctcgctgcaggcgtgcgttcttcctgcccccaggagaccttcttgtgccaattatgctagagctgtgaatcaaattttgcaaggcctgaccaacatgcatttgtggcttaggttacctctggagaagtctgagccaatggatgatgatcttgataaagtaaagaataacagccaaatgagtgaaaaagtagactcgtgggaattgtggaattcattcagattgctatgtgatcacagtagccaactatgtgtggcacttgatattttgagcacactgccatcaataaactcattagggcggtggtttggggagcctgtcagggctgctattcttcaaacaaatgcttttctaacaaatgcaaaaggatatccttgtttgtcaaagcggcatcagaggctactaactgcattttttaaccattctgttcaggtaataatctctgggagatcaaatcacaatgtttccccagtgtctgaaggagtgctttctggtgatgagaactacattgaagaagctcctgttcgacatgcattaagtccatacctggactacgttgcatacctatataggaggatggatccgcttcctgagcaggagcgctttgagatcaattacagggattttttgcagtctcctctccagcccctgatggataatttggaagctcagacttacgagacatttgagaaggatgtagtgaagtatagccagtatcaaagagcagtcgctaaggccttggttgatagggtcccagatgatgcagtctccacaactaggacggtgctgatggttgttggagcaggccgagggcctctagtacgagcatcattgcaggctgccgaagaaactggtcgcaagttaaaagtatatgctgtcgaaaaaaatcctaatgctgttattactcttcatagtttgatcaaattggaggggtgggaaagcttggttactgtaatttctagtgacatgaggtgctggaatgcccctgaaaaagcagatattttggtcagtgaattgcttgggtcctttggtgacaatgaactatctcctgagtgtctggatggtgctcagcgattcttgaagccagatgggatttccattccttcttcatacaccagtttcatccaaccaataacagcatcaaaattgcacaacgatatcaaagcacacaaagatattgctcattttgaaactgcatatgttgtcaaactacaccgcatagcgaatcttgcacctccacaacaggtttttactttcacccatccaaatttctcaccagacgccaacaatcgaaggtataccaagctgcaatttgaaatgctaccagatacgggatcatgccttgtgcacggatttgctggatatttcgactctgttctatacaaggatgttcatctcggaatcgagccaaacactgctactccaaacatgtttagctggttcccgatcttcttcccgttgagaaagcccatctatgtgccggacgggtctcctatagaagtgcacttctggcggtgctgtgctcccacaaaggtgtggtacgagtgggctgtgacaacaccgtctccgtcgccaatccataacagcaatggccggtcatattgggttggtctatagctaagatcgtcgttttgttttgtgataagaggggaaaaaaaaggaatgtagggtttagttctatatgagtggagttttggtggttcctccctggacgcagtgccagggagccctggaacctgttgtatctcgaaggggtagtttgactcccaacgtcgtgtacttaatttttgaattttgatagcataggcgtctgactttaaaattttggcaatatttcttatcatgtcaatttcggaattgcttacgttccttttcgatcaatcaatcta

SEQ ID NO: 47 - DNA, 4412 bp, Zea mays
atgaaacgacgcctgggcatcatcgccgtacgtgactgttctgtttccgtagcgtgtgccgccgcaacacccaggcaagcccgagaccaaaaataacagaaaggagagccgcgtgtcctcccagccactgccacccttccccacctatcgatctcgagttctctcgaccccacccgacccggagccgcaccgcctcgacccagaccggcgccgacgagccccagcgcccaatggcggcggctttcctcgccctggaggcccgcgtgacatgatccctgtcccccgaggatgggaatatcccccctccaccctcccttctcgactcttcctcgggtctctccttctccaccgcctcgcgctccgcaattggctgctcgtgctcgcgtggccccggatcgccgccaggtccgggaacaagaacaaatgttgcaagaagacatgaaatgggaaagaccgagagagcaagagggaaagataccgtggattggttgggcggtggccggtgctgcagctcatggaacttgaatggaagtagctaattggtgctgggcataggacttgctggatttcagtcgtctgatatactgagacttagtagtgctgatccagtgaacctatccacaccaacttgattacagtctctctgacacaactatggcgccctctgccgctgccccaggcatctctgaggctgagggggcaccacgcatggccaagttcctctgcagctttggaggtagtatccttccccgaccacttgatggctgtcttcgatatgttggtggcgagacaaggattgtcatattgccgcgtgacatatcatatgccgacctagctgcacggatgagagatctctacaaggatgctgataccatcaaataccagcaacctgatgaggatctggatgcgctggtctcggtcgtgaatcacgatgatgtggtgaacatgatggaggagtatgacaaagtcactgccacaggggaggcgttcactcggctcaggatcttcttattttctcagcaattggatgacaatgctgcatcagtggctgtgcattacaatgtagacgagcgggaaacagagagaaggtatgtagatgcgctcaacagccttggtgatgttaggtcaccttcctcccctgtatctgtggagcagctttttggcatcggaggcaatgattcaggaattcctgattttgctggcttgagacatttgaatgtccctcgtccatcacatggtcagaggtatggagagatggattctccttggagccctgcttatgtctcaccaagccagtacagagtgcatgacccgagggattttccaatttcaccgtcatctgcaaggttccaagtaggagcggaggattttgatgacaggattcctgacgactttgtaaggcagtcaccaaaatatcattattatgaggctcaatcaccatcacatatggataatttagtctggcttccacctggtgctgtaattcagcaaaatgcaggtttccctggtgatttgagcaagcacaataaatttttggatgggaacagtggatgtgatcactgtggttcactattccacaagggtcagggttcggtgactgatcctatctatatgaatcctcgttggactcggccagtccaacaacattttgaccaaccaagcatgattaatgattatcccggtcaccatgctaattcttgtccagattactgccgccctggtgagcattatgcgggaggtcaagatgttagattggaaaatggtgtttatgttaaagagcaaaatggtggtcatactcccatgctttataatgagtcacgtcctcacgatagagtctggtatgcgcataccaaccaaagtcatcagcggtatgaggatccaaggctgcattatcctactaatgatagagtgatcgagccatacattgtcgatgctagctctgtaaattccgcatttgcaccaaacaaagtatatgaaatgcattcagcatctcttggtcattctagttctagccatgaaagtcctcactattttcatggtagcagtgagctcataaatgacgcatatcacaaccaacaagttggaggcagtgggtcatatgtgcagccagcagggtctgaagaatcccctggtcagcattacaaccacttttcggcctatggtgcagattccttttatcaaatgcaacaaaatttgccacccattcaatctttgaggaggagagcgaacagtcctgttcacactgcctcaccatatgattccccacacctgccaataccaaatgggagcattaacatgaattctgttagaaatacaggtgatgcgagtcccaggatagcaggtcttattggatatgatcgaatgccaaacccatttactccgcccaatggcagcatactatatagagttggtgggcatgatgttcctgcagctatggagaacactagtgcttttggtcctaggtctaatccaactgctgctcagtatgttcagccttttattgctcctgaatcaatccagcatcaacctggagttcccttgagggaggtttatcctgaaagagcataccctgaacccatgccgtcatcatatgctgatggcaaagtagctgtttctgcattgcccctcaccgaccaattattcaggttggatataaacacaatgaagaaacttgaaggacaagatgatgggaactctactcgaaatgtgaatgaaacaactcttttgcatgctgtggatgaaccaagtaccttaccccaccatgttggatctgtacatgaagtcgatcctaagcaggagaagctaaccgaaaaagaaagcaggcaaaagcaacatgaagctggggctacagcactgcaggaatgtgaggatatttcagaggatatgttgaatttccttcctgaattaattgcctctgttaaaaaggtaacactggaagatgctgctgagacacaaatagcccaatcagatgctaatgctgctgtttcacctgttcctgatgatgacgataatggaaagaagctggatgaggcaacagctggtgtaagcaatgcttcaagttcgagcatggtaactactaaactaccaaatggtctccactctaatccttttgttttgcagaatacaaatgcaaatcaggaccttgatttgcaaggaagccttgatcggcagaagagtttcaagattgagtctacaactgctgaagctgaagctttgtcgaaaggactacagactataaaaaatgatgatttagaggaaattagagagctgggttcaggtacttatggggcggtctatcatggtaaatggaggggatgcgatgttgctattaaaagaataaaagcaagttgctttgctggaagaccatctgaaagagagcgtttgatcacggatttctggaaagaagctctgatcctaagctcacttcatcatccaaatgtggttgcattttatggtgtagttcgtgatggtccagatggaagcttagcaactgttactgagtttatggttaatgggtctctcaaacagttcctgaggaaaaaagacaggacaatagatcgccggaagagagtaatattagccatggatgctgcatttggcatggaatatttgcacgggaagaatatagtccattttgacctgaagtgtgagaatctactggtgaacatgagggatccacagcgaccaatctgcaagatcggtgatctcgggctatcaaaggttaaacagcatactttggtatctggtggtgttagaggaaccttaccgtggatggcaccagagcttctgagtgggaaaaacaatatggtgtcagagaagattgacgtctattcgtttggaattgtcatgtgggagctgcttactggggaagagccatactctgatatgcgtgctgctgaaattattggggccattgtaaacgattccttacgccctcaaatcccttcatggtgtgatcctgagtggaagggattgatggaaagctgttggtccagtgatccagcggagagaccgtccttcactgatatatctcaaaggttgaggaaaatggccgctgcaatgaatgtgaagtgaaggttcggaagccatatttgtcttgattttccttagtcctggagtaacccggctgtcatttgccttgtgtcgaaaataagtatgctataaagcgttctgtcttgatgggaactgttgggctgtaattgtaaataagttttgacttgcttcatcttgctgtgcaaagtagtaattaataggcacgatcaaagctgggcacagttatcttttccccccatacaaaagtgtgtcctaggactaggaggagagatggatcgaacacgactagagctgtacatagtatactgtttgctctgtatataatcatcacttcctatttgaatgctcataagtttgca

SEQ ID NO: 48 - DNA, 509 bp, Oryza sativa
ccctacgcatccccgaccagcaccggcaccggcggcggcggcggctaccccccttcaatggcgactgtgccagttaacccgaagcctttcttgaacaacctgacagggaagcctgtcattgtcaaacttaagtggggtatggaatacaaaggatatcttgtttctgtcgactcttatatgaatctgcagctggctaatacagaggagtatattgatgggcaattctctggaaacttgggtgagatactgataaggtgcaacaacgttttgtatctccgaggcgttccagaggataccgagatagaggatgcggaatgagatagcccgggccatgtccagattgattattgtaatatgctgctgacatgaacaattaagtgtcatgtacaactgatgcagattgacctggatctttaactatgccatgatatggtaatgttatgcgttgaaactgtcgttgctcggaatgtgtgagatcatatttcgtaagaaaataccatttgcctgtc

SEQ ID NO: 49 - DNA, 1932 bp, Oryza sativa
gtagcctcctacacttaccgtcaccgaccgcgaaaaaattcccccaaaaccctagcggcggcggcgcgcgctcccctccccacctccgccgccgcggcgtcgaggcagcaccggagggcgatggcgtcgacggtgctggaggcgacgcgggcgaagcacgaggacatggagaggctggagcggctggcggtgcgggagctgcagcgggagcccgccaacgcgcgcgaccgcctctaccagtcccaccgcgtgcgccacatgctcgacctcgtcatctccacctccggcaagctcgtggaaatctacgaggacaaggataatgctaggaaggatgagatctccaaccatcttagttccacagtgcaagctgaaatctttccaaagttctatgacaggctcaaagagatccgtgattaccataggcgtaatccttctgcccgtttcgttagtgcaactgatgatttcgaagagctactaaaggaggaaccggctattgaattcactggagaggaagcttttggccgatacctggacttgcatgagctttacaatgagttcataaattccaagtttggaactccaatggaatactcagcatatgttggcaccttttctcatgtggagaagatggcacaaaatctgaaaacctccaggcaatacagagaatacctggagcatattttggagtatctgacatcatttctgtatcacacagaaccattgcaagacattgagaagatttttgcaaagttggaaagcgagtttgaagaacagtggatcaatggtgaagtgcctggatgggagagcaaggacccagagaaagaatctgcacaagagtcagtaatagaccttgattactataccactgttgaagagcttgttgagctgggcccagaaaagttgaaagaggctttagctgctcgtggattaaaaagtggtggtactgttcaacagcgtgctgagcgacttttcttgttgaagcatacacccttggaacaattggatcgtaagcattttgccaaaggttcacacagttctgtctccaatgctacttctaatggtaacaatttcaaggataatttgaagaaggaaattgctttaatggaagtaaagatgaggcgcctttgtgagctactagatgagatcattgtacggacaaaggaaaatgcagagaagaagctgactctcacatatgaagaaatggaagcagaacgagaagaggaagaagtgcaagctgatagtgaaagtgatgatgaagaccaacaaatctacaatcctcttaagttgccgatgggttgggacggcaaacctataccctattggctatataagctccatggtcttggtcaggaattcaaatgtgagatatgtggaaaccacagctactgggggcgacgggcttatgagcggcatttcaaggagtggcgccatcagcacgggatgcgctgtcttggaattcctaatactaagaacttcaatgaaatcacatccatccaggaggcaaaagaactctgggagaaaattcaacaacgacaagggctgaacaagtggcggccagacctagaagaagagtacgaagatcaggagggaaatatctacaacaagaagacctacactgatctgcagcgccagggcctgatttagaatccctgatgcgatcctaacattttggcccctatgggctgctgctgaagtggttggccatttgttctattgaacttcgttgacctctgggtagttgtagcactcgatacttgtagcaccatgggtactccattgctcaaatgtttcttttctactacatggtatattgcactatatccctgtaccctgtttgaccatctggtatactgtttgcacaatccagggttaaatcgccattgtgtcggagatgtcggagtcaaactttatatccagaacactagaatggat

SEQ ID NO: 50 - DNA, 2290 bp, Oryza sativa
aaaaagccaaagccccacccaaagcggcgacgcccctctctctctctctctctctctcttctcttctcttctctcctccacgtcgcggctcgcgcctccaaatccccccccgcgaggcgagcagggcgaggcggcgaaagcgcgacgcgcgagcggatcgaggcggcggcgtcggtgccggcatccaccgcgtgcataggttgcgtcggcggcggcggaagcggggcgcgatgacggacggccaccacttcaacaacatatccctcggcggccgcggcggcaacaaccctggccagtttaaactttattcgggaggacttgcatggaagaggcaaggtggaggaaagaccattgaggttgaaaagtctgatatcacttctgtgacatggatggcaatccccagatcctatcagcttggtgtttcaacaaaggagggcctcttctacaggttctttggcttccgtgaacaggatatcagttcattgactaacttcatggaaaagaacatgagaatcacaccagaggagaagcagctttctgttggtggacataattggggcggaattgaaatcaatggcaatatgcttagctttaatgttggttcaaaggaagcatttgaagtctctctagcagacgtagcacaaactcagatgcaaggaaaaacagatgttgttctggagtttcatgtggatgatactactggtggtaatgagaaagattcattgatggatttaagctttcatgtaccaacttcaaatactcaattccctggagatgagaatcgtccttcagctcaggttttatggcaggctatcttgaataaggctgatgttggctcatcagaggaagctgttgttacatttgatggaattgctattcttactccaagaggtcgatacagtgttgaacttcatctgtcattcttacgactccaaggacaagctaatgatttcaaaattcaatatagcagtattcttcgcctctttgttttaccaaagtcaaataatcctcatacctttgtggttatcactcttgatccaccaattcgcaaaggacagacattatatcctcacattgttattcagtttgaaactgaagcagtcgttcaaagggatctgacattaagtgatgaggttttggctgaaaagtacaaggatagactggagaactcttaccagggtctgatacatgaagtgttctccaaggtccttcgtggcctatctggtgctaaagttacgaggccaagcacgttccgcagttgtcaagatggatatgcagtgaaatcatcactcaaagctgaagatggattgctctatccgctggagaagggcttcttctttctaccaaagcccccaacactcattctgcatgaggagattgagtatgttgaatttgagcgacatggtgctgggggtgctagtatctcatctcactattttgatctcctggtcaagctgaaaaatgatcaagaacatctattcagaaatatccaaagaaatgaataccataatctcttcaatttcatcagtggcaagcatttgaaaatcttgaatcttggagaagctcaaggtagagctggtggcgttacagctgttcttcagagcactgatgatgatgctgttgatcctcatctggagcggatcagaaatcagactggcgatgatgagagtgatgaagaggatgaagattttgtggcggacaaggacgacagtggatctcctactgatgattctggagaggagggttctgacgctagtttaagtggaggagaaaaggagaaatcttccaaaaaggaagctagtagctcaaaggcgcctttgaagaagaggaagccaaagggtggggatgcggcggaaggctcggagaaaagaaagccaaagaaaaagaaggatcctaatgcccctaaaagagcaattgcaccattcatgtacttctcaaaagctgagcgagctaatctgaagaacagcaatccggagctggctaccacagagattgcgaagaagcttggggagaggtggcaaaagatgacagccgaggagaagcagccatacgtcgagcagtctcaagttgacaagaagcgctacgcggaggagtcagccgcctaccgcggggcggctgccatggatgtggactccggccctgcttcggactgaagagaagagacctgaattgcattccagattacccttagtctaggagggcgacagacaggatacggctagtggcatctctatttccatgtaaataaaacttatgagttatctggatgtaaataaaactatcgtaggta

SEQ ID NO: 51 - DNA, 2796 bp, Oryza sativa
gagcgctctgtgacactgacagtgggccccacccccgcctcctcttctctcacgccgcctccgcttcgtctcctcgccggagttgagccgcgggatccgtcggagatggcgaccggagaagcggcggcggcggcggcgtcgccgccggagctggcgtcgttcctggcgatcgggcttgaccagcgcacggcggagaacgccctcgccaaccgcaaggtcaccgccaacctcaccgccgtcatcgccgaggctggtgttagtgggtgtgacaaatctgtggggaatcttctctacactgtcgcgacgaagtatccggcgaatgccctggtgcatcgtcccgttgtcatccaatacattgtgtcgtcaaagatcaagacccccgcgcaattagatgctgctctgtcgtttctttctactttgggtcctgatccattggacacagcaaagtttgaagagacatgtggagtgggggtggttgtttcaactgaagagattcagtcaatggtcactgatatcctgaaggaaaacatggaagccatagttgaacagcgatatcatataaatgttggcagcttgtgcggacaggttaggaagtggcacccctggggcgatgctaagttcataaaggaggaaattgataaaaggcttacagagattcttggtccaaagacagaagctgacaatgtaaagcctgtgaaaaagaagaaggagaagcccgcaaaagttgaggagaaaaaaactgcggtagctgctcctgctccaccatctgaggaagaacttaatccctactccatatttcctcaaccggaggaaaacttaaaggtccatacagaaattttcttcagcgatggaaatatatggagagcacacaacagaaaggacattttagagaaacatcttaaagcaactggaggaaaagtgatgacccgctttcccccagagcctaatggctaccttcatattggtcatgctaaggctatgtttattgattttggactggctaaagagcgcaacggacattgttaccttaggtttgatgatacaaaccctgaggcggagaagaaagaatatatagatcacattcaagaaattgtccgatggatgggctgggagccttataaagttacctatacaagtgactatttccaagaattatatgaacttgctgtttgtttgataaagaagggactagcttatgtcgatcaccagacaccagaagagataaaggagtatagagaaaagcaaatgaatagtccatggagggataggcctatagaagagtcactaaaactgtttgaagatatgaggcatgggttggttgctgagggaaaggcaactcttaggatgaaacaagacatgcagaatgataacaagaacatggctgacttaatagcatatagaataaagtttacacctcatccccatgctggcgacaagtggtttatctatccaagctatgactatgctcattgtttggttgactctcttgaaaacattacccattcgttgtgcacactagaatttgacatacgtcgtccttcatactactggctgctcgtatccctggaccagtaccagccatatgtttgggaatattcaaggttaaacatatcaaacaatgttatgtccaagcgaaagctaaataaacttgtgacagagaagtgggtagatgggtgggatgatcctcgcctgttgacacttgcaggactacggcggagaggagtatcatcaacagcaattaactcctttattcgtggaatgggcataacaaggagtgacaacagtttgatacgcttagaacgccttgagtatcatattagagaagagctcaacaaagtagctcctcgtgctatggttgttttgcatcccctaaaggttgttataaataatttagactatggaacaataatagaccttgatgcaaaaaagtggcccgatgctccaggagatgatgcttcggcctattacaaggttccattctcaagaactgtctacatcgagcagtctgattttcgtgtaaaggattcaaaagattattatgggcttgctcctggtaaaacagtactactaaggtatgcattcccaataaaatgtacggaagttatctatggtgataattcagataatatcattgaaatccgagctgagtatgacccttcgaaggctacaaaaccaaagggtgtgttgcactgggttgccgaaccttctccaggtgttaacccgctcaaagtggaaatcagattgttcgagaaattatttctttcagagaatcctgtggagcttgaggattggctgggtgatctcaacccacgatcaaaggaagtgataaagggtgcctatgccgtgccttcgcttgcaactgcagcgctgggggacaaatttcagtttgaacgcctcggttactttgctgtggattccgactcgacggctgaggaacttgtgttcaacagaaccgttactctacgggattcctatggaaaagctggacccaagtgatcgttttgtttgtggttgaaaagattggtgtaacagcatcattgctggtcttttgtattgcaccagcggtaaaatacaccagtgggtatacccctcaaattttgtttacaatcatctggaaccgccttttgtattagccagtcaaactctgtttacttgacagttgcaatagaaaccaaaattctgtggcagctgtgctctctatgttgtcgctatgctgcaacccaacaactggatgtttagtctatccaaaggcttttttcataaactttgccatcaatctccgatggattattctgc

SEQ ID NO: 52 - DNA, 1287 bp, Oryza sativa
acccctcgtctgtctctcttccccaaaccctccacccaacccgcctcctcgagcgacggcgcagccatggcggaagcagcagcagcacctcccgccgccgccgccaccaactacgaggtggacctcggcaacctcatggcctacgacccgtcgcatcacctccccgccgcatcctcctccagggaggagctgagggaggagtgcctgcggaaggggacggagctggcgcaggcggtcgccgacgccctcttcgcgctgccggccaccgaggaccgcgacggccccatggtccgcctcccgccgcccaccacccgcttcccccgcgagaagcatctaccaaggccgaagccccctactaaatgggagcagtttgcgaagatgaaagggatcacaaagcacaagaagaacaaacgtgaatgggacgagcaaactcaaacctggaagcggacttatggctatgaccgtgttaatgatgataaagacattccaatcattgaagccaaggcgacagatgagcctggtgttgatccttttgctcaaagaagggaagataagaagaagtgtgttgaaaagcaagaaaagaacagactagaaaacttgaaaaaagcagccaaagttggtgctttgcctagtcatatacaacttgctgcaacagcgttgcctatcacgggaactaaagcagacatacccaaaaaatctagaaagaaagatctcgaggatgttgctggcatggcttcatcagcaacagctagtggtgggaagttcgatgaaaaattgcctggcgagaaacctccaaaaaatcctggcaaacatagaaagttcctccctgttgttgaaggaaaaggaatgggcaaccaggagaaacagcaaaatgacaaaatcttgaatgctctgctggccaaaagttctgaggatcaaatggatgttggcagggcaattacgatgtacaaggtgaagaaggagaaacaaaggaggaaagataaggaaaagtcttcttcatcgaacaagctgaagccccagaagaaaacactcaagaaatcttcgaagaaaaaggcttaggttaattacattcttcggacctgctgtaggaggtgagcatagttttcgagactcaaggagaattggcaaattttgctgtctgtttgtccaatttgaacacatcggagaaatcttgttattgcaattgttggttatgatgtaagaacctgaatgctattataacatggttgtcatgaatatgcaatacatatgcattataatttcaaaagttctggagttcgttttggt

SEQ ID NO: 53 - DNA, 636 bp, Oryza sativa
cccgaaccctaactccatcttccccggcggcggcgcagcagaggatatcagccatggtgaagtttctcaagcccgggaaggcggtgatcctgctgcaggggaggttcgcggggcggaaggcggtgatcgtgcgggtgttcgaggagggcacccgcgaccgcccctacggccactgcctcgtcgccggcctcgccaagtaccccaagaaggtgatccgcaaggactcggcgaagaagacggcgaagaagtcgcgcgtcaagtgcttcctcaagctcgtcaacttcacccacctcatgcccacccgctacaccctcgacgtcgacctcaaggaggtcgccgcggggcccgacgcgctcgccaccagggacaagaaggtcgccgcctgcaagtccgccaaggcgcgcctcgaggaccgcttcaagaccggcaagaacaggtggttcttcaccaagctccgcttctgagctctctcctgcggcggcggcggcggcgatgggatggtactggtgcacggccatctcatcctttttctctttttctaaagcttttcgctttctgagtagcagccaatgaatggttttggattttctaaattaatctcaatcaccctgatgtaatggtactactgcctgcttg

SEQ ID NO: 54 - DNA, 1658 bp, Oryza sativa
agtttcatcgcagcacacatccatccatccatccatctatccagagagcacagcaacggcgcatatatagtacccctctaccaaagcacaacaaccagaatctcctgagctcgatctagctactagcttgatctatccgatcaatcgactggcccgcgaggatcgatcgagactcgaaagggagggattttgatccggatcggtcgacgatggacatggcgcacgagagggacgcgagcagcgaggaggaggtgatgggcggcgacctgcgtcgcgggccgtggacggtggaggaggacctcctgctcgtcaactacatcgccgcgcacggcgagggccgctggaactcgctcgcccgatcagcagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcacctcccgggacgcaccgacaacgagatcaagaactactggcgcacgcgggtgcagaagcacgccaagcagctcaagtgcgacgtcaacagccagcagttcaaggacgtcatgcgctacctctggatgccccgcctcgtcgagcgcatccaggccgccgccgccgggcagcagcagcagcaggaaggcggcaccgacacgccgcccctgtcgtggcagcacggcggctccgacgggctctacgagtcgccggagctcccggcgcccgatgccagctgctggccagccgagtactgcgcggcggccggcggcgcgcagtcgggcggcacgcctgcaccggagctgtcgagcaccacggccgggtcgtcgtcgctgtccacggactccggcgccggggcgcagcccagctggcccacgcaggccgacggcgccgagtggttcaccaccgcctgcgacgcctccagcgccaccggcggcgtggccatgcgcgacacggagctggagctggcccagccgccgtgccagggcgggcagacgtggacgacgtccgagtcgtcgctgcctggcctcaccttccccgacctcgccgtcgcggacttcgagatcggcggcttcgacgtcgatagcttctggacgagcatggaggacgaccagctgtggtgccccacccaggccgccgtgtgaaaagtcagcacggccgccatgggaatccgccgcggcgagcgagcgcgcgcgcgcgcgacacccgcgggtgcacaaccgccggggacgcgtagcggagcggagaagcggattagaagaaggagagaagctatctgggggattagaacaagattaatcgcctcacgatgccatttttggactcctagctcccagactattctaactccagttcttttccgtttctttctccttttttacttcctagggtaaaaaaaaagaagttaaagtgtagccgttatactagtgttgatgctgctgttactaaagtttgtccgttaaattttactcattctttttgagtaaatacagtactgccactactgtatgtacgagctgaactctgtaggattgacaggattactgtacacttctagaaaccggtaataaaagcaaagctccgacgtcaagtcttgattaatt

SEQ ID NO: 55 - DNA, 855 bp, Oryza sativa
ttcccccaacgccgcctctttggagcgacctcctgtcgacgccgcgtcggcctcgcccccatccccatagccataccaggcctcaatcttcctctccaatctccttgtggctagttcggacagcagcagcagcgtgggtggtgccgctgcgattccggaggagggggcggtagttcggaggcggcgcgatgaggttggagaagtgctggttctgctcgtccaccgtctaccccggccacggcatccagttcgtccggaacgacgccaagatctttcgcttttgccggtcaaaatgtcataaaaatttcaagatgaagaggaatcctcgtaaggttaaatggacaaaagcgtacaggtgcttgcatgggaaggacatgacacaggactccacctttgagtttgagaggaaaaggaacaggccagagcgctatgaccggaatgtcactgagcaaacacttaaggctatctctcttattacaaagattagacatgaacggcagaagaaacatattacagagaggcaaaaacagggtaagacaaagcaacgggagagggatgctaaggagttggaacaggatattcaaatgcttccaaagaaggttaccctatcaacacaaaaaacaaaagtcgtggttaaagtttcccagcagcagacagaagagaatcttatggaagagtaatgaaatggaatcaagttttgcatgttgttatgtaggactgtgtttcatcaaatcgttactatgaacggtgtatttgactgggtaccagcaaagttttgcaccgaccgtctggtttgtgacttccagctatcttatagtatcaatagtattgatggctttgtgaactgttaaaagg

SEQ ID NO: 56 - DNA, 2593 bp, Oryza sativa
attcggacgccgcgtggggggaggaggaagacggcgaccctcgccgcgaataaacaattccaaatggtggccgccaccgcatccaccaccaccgcgaggacgacgaggagcatcaccacgcgtactctgcctcctaccacctagctaggagctaactaggtcgtcggtgctcgagatcgggggagggaggcgcgatgcgggccagggagatgcacccgctgtgctgcctcgtctccgactgcgcgttgggtggaggcggcggagggggaggtggtgaggggggaggaggagactgctcgccgacgaaggcggcggtggggggagaggaggaggtggtggcggtggcgggggtgctgtacaagtggaccaacatcgggaaggggtggcggccgcggtggttcgcgatccggggcggcgtcctggcctactccaagatccgccgccgcgtcgccgccgagccgcctcccgaggccgccgccgccgccgcagccaacggcgtcaggctcatcggcgtgccccgcggcggcgtcggggaccagcccatcggattcgtccctctcaagatctcatcatttagcgaaagtaaatcggatgataaacggttctacatcattaccccaaccaagacgcttcagctgaggactggctctgctaaggaccgtgtggcttggattgaagcacttgtttctgcgaggagtgaatattctcttaacgggggtgtaccgtgtgaccagaatgagggatcattttccactgaaaagcttaggaatcgcttgcatgctgaaggtgttggagaggcaactattaaagactgtgaacagatcattcactcagaattttcacagtatcacactcagatgaagcaacggtgtgaagactatttaaacttcattggcagtcttccaagggaacttgaggtagttaattcgggagatgcatctgctattgagaagccacagtcggagttgttcaaacatgactgttccagctctggaaaatgtagtgagtacagcaacactgaatcttctgatgatgctggcaaacaagaggtagggcagttgtcagatgaggatgagtttcatttctatgatacaaggcaaagtttcagtgacactgctgcaagtcctgacttgaaaatgagatgttcaaatagtgggagtggagctcacaagtttggtgaattactagctatcgacaagacgaatgaatacttattgtcatcttcaaaacgccgttcagagttacccgtaccaatagaaaaggagaaaggtgttagcctttggtcaatgatcaaagataatgttggcaaggatcttacaagagtctgtcttcctgtttactttaatgaaccattgtcttctcttcaaaagtgctttgaagatttggagtattccaatttactggatcgtgcatatgaatatggttcaaggggaaacgggctgatgagaattctttatgttgctgcatttgctgtctctggatatgcttccacggattctcgcccctgcaaacctttcaatccattgttgggggaaacatacgaagctgattatcctgaaaaagggatccgtttcttctctgaaaaggttagtcatcatccgatggtcatggcatgccattgtgaagggaaaggttggaaattttggggtgacagcaatctaaagagcaaattttgggggcagtccattcaactcgatcctagcggtgtgctaactctacagtttgatgatggagaaactttccagtggagtaaggttacgacaacaattaataaccttatcattggccgagtctattgccatcaccatggcacgatgaacataagtggaaacaggcaatattcatgtaagctgactttcaaagagcaatccttcctcgatcgtaatcctcgccaggttcaaggacttgttacggatgctaatgggaccaaagttgcattcttgatgggaaagtgggacgagagcatgtcttgcatcattggtgatgatgcttctaaagtgaactcccgtaatgcaaatcagagtacgggtgccactttattgtgggagaaaaatgtgcctccagccaatcccactcgatataacctgtcatcatttgcaatcactttgaacgagttgacaccaggtcttaaggagaagcttccaccaacggattcaagactcaggccagatcagcggcatctagagaatggggagtacgaaaaggctaactctgaaaaattgcgcctggagacgaggcagaggatggcaaggaagatgcaggagagtggttggaagccaagatggttccaaagggacacagaggatggaacattccgttatgtcggaggttactgggaggcaagggagcagaggaaatgggttggttgcaatgacatattcggcaataatgtgtccactctttgcaccagcgcaagtatatagagaaacttctgtttagtagtcgttgacaccccattaattattgaagacggtacatagttgatcggctgctcccgttgctaccatgcaaacaagagctaacatgctctcctcttgtcatatagaaacactgggacatttatgtggatactgggatacttaactgtgaggcc

SEQ ID NO: 57 - DNA, 4360 bp, Sorghum bicolor
caagccgcaaccgcaaggccgatctgataagccgccgaattcccccaccgttcgagcgccgcccgcccgcccacctcccgctctaaaaccctagatctccctccccttgtcccccaaccccgaccccgccgccgcctcagtcgccggaggaggaggggcacctcgccgcagcagccatgtacctctacagcctgacgctgcagcgagcgacgggcgcggtgtgcgccgtcattggcagcttcagtgggcgggactcgaagaagtcggccgcctccggctccggctccggctccacgcaggagatcgccgtggcccggggcagcacgctcgacctcctccgcccggacccggagacgggccgcctccgcacgctcctctccgtcgacgtcttcggcgccatccgctcgctcgcgcagttccgcctcaccggcgccaacaaggactacctcgtcgtcggctccgactcgggccgcctcgtcatcctcgagtactcccccgaccgcaaccgcctcgacaaggtccaccaggagaccttcggcaagtcgggatgccgccgcatcgtccccggccagctcctcgccgtcgaccccaagggccgcgcgctctgtatcgccgcgctcgagaagcagaagctcgtctacgtactcaaccgcgacgccgccgcgcgcctcaccatctcgtccccgctcgaggcccacaagtccaatactctcaccttcgccctcgccgcgctcgactgcgggttcgacaaccccgtcttcgccgccatcgagctcgagtacgccgagtctgaccgcgaccccacgggacaggctgccaaccaggcgcagaagctcctcaccttctacgagcttgacctggggctcaaccatgtctcccgcaaggtctctgagcccattgataatggtgccaatcttctagtgactgtccctggtggcggtgacggtccgagtggggttctcgtgtgctgcgacaatttcgtgctgtaccggaaccagggtcacccagagattcgtgctgttattccacggcgtgctgacctccctgctgagcgtggcgtcctcattgttgctgccgccacacacaaacaaaagagtatgttcttcttcctgctacagactgagtatggtgacatcttcaaggttgaccttgatcataatggggatactgttagtgagctcaggatcaagtactttgacaccataccagtgacatcagctgtctgtgtgctgcgatcgggtttcctctttgctgcttctgagtttggcaaccatgcactttaccagttccgtgatattggcagagatgcggatgtcgagtcctcttctgcaacactgatggagacagaggagggattccagccagttttctttcagccaagggcactgaagaacctcatgcgcatagatgagattgagagcctcatgccagtcatggacatgcgtgtcgcgaatttatttgacgaggaaacaccccagttgttcactgcctgtggccgtggtccgcgctccacgctgcgcatcctgaggcctggccttgccatcagtgagatggcccgatcaatgttgcctgctgagcctattgctgtgtggactgtcaagaagaatatcaatgacatgtttgatgcttacattgttgtgtcatttactaatgtcacgcttgtgctctctattggtgagaccattgaagaagtcagtgacagccagttcctggacaccacacactcccttgcagtcacgctccttggtgaggactctctaatgcaggtccacccaaatggcatccggcacatcagggaggatggtcgtgtcaatgagtggaggacgcctggaaagaaaactattacaaaggtcggatcaaaccgtctccaggtggtaatcgctcttagtggtggagagctcatctattttgagatggacatgactggtcagctcatggaggtggagaagcaggacatgtctggtgatgttgcatgcctggccattgcgccggtccctgaggggaggcaaaggtccaggtttcttgctgtaggatcctatgataacaccatccgtatcctctcactggaccctgacgattgcctgcagcctctaagtgtccagagtgtatcatcggcaccagagtcactcttattcttggaggttcaggcctctattggtggtgaggatggtgcagattatccagccaaccttttcctcaatgctggtctgcagaatggtgtccttttccggaccaatgtcgacatggttacgggtcagctatcggacacacgttctcgattccttggcctgagacctccaaagttgttcccttgtgtagttagccacaggcaagcaatgctctgcctatccagccgtccttggctgggctatatacatcaaggccattttctcttgacaccactgtcctgtgatacgcttgaatctgcatcatcattttcttctgatcagtgctcagaaggtgtagttgctgttgcgggagatgccctacggattttcaccattgaacgcttgggagagactttcaatgagacggccatccctctgcggtacaccccaaggaagtttgtgattctaccaaagaaaaaatatattgctgtcattgagagtgataagggcgcgttcagcgcagaagagcgagaagctgctaagaaagagtgcctcgaggcttctggtgcagcagagaatggaaatgcaaataatggcgatccaatggagaatggtgatggtcaagaagatggtgctgaggagggcaacacatttcctgatgaacaatatggttatccaaaggctgaatcagagaggtgggtttcctgcattaggatccttgatccaaggagtagggacacaacctgtcttctggaattgcaggaaaatgaggctgctgtcagtatttgcactgtgaatttccatgataaggagcacggaactctactggcggttggcactgccaagggattgcagttctggccaaggaggacccttgctggtggattcatccacatatataagtttgtggacgaagggaggtcacttgaacttctacataaaacgcaagtggaggaagtacctcttgcactgtgccaattccagggacgattacttgcaggtgttggttcagtgctcagactatacgatctggggaagagaaaattgctcagaaaatgtgaaaacaagctttttccaaggacaatagtgtctatccatacctaccgtgataggatctatgttggtgatatgcaagagtcatttcactattgcaagtacagacgagatgaaaaccaactctatatatttgctgatgatagtgttcccagatggcttacagcggcacaacacatagattttgacactatggctggagcagataagtttgggaatatatattttgctcgtcttcctcaggatatctcagatgagattgaagaagacccaactggaggcaagattaaatgggagcaagggaagttaaatggtgcccctaacaaagttgaagagattgtgcagtttcatgtcggtgatgttgtaacatgtttgcagaaggcctctttgattcctggtggaggggaatgtcttatttatgggactgtgatgggcagtgtgggagcactgcttgcattcacctccagggaagatgttgacttcttttctcacttggagatgcatcttcgtcaggagcatccaccattatgtggaagagatcacatggcttacagatctgcttattttccagtgaaggatgtgatagatggtgatctctgcgagcagtatccctccctcccagctgatatgcagaggaagattgctgatgaactggacagaactcctggtgagatcctgaagaagctagaagacatcaggaacaaaatcatctaagcccacggcttagtgtgaagaaactaggcagggcaatgcaactgtccggtgctctttgcttcaagactgtatccagttcgagctgttgggcagcacttcaagatgtggcagcattcaacaagtttggagcatgctgatctgtacaatctttcctgacgctaactggtccatggtccagtccgcgttttatagttgatgagatagagcatgtacggcaccagaatggtttttttgtgtatctcttagaagtgatttagctgatgtcattgactgtttgttacttggcttgatgtaattgggtgaagttattactgttggatattcgtgcattaggcggtggctaccttggtaatgtaccataggacatttttgaagtgtagatgccttgctgtcattgctttttcagattgttcagctgacggaagtccttaattgccacatcagctcggttcatgcgttacaatcagaacatattatttattctt

SEQ ID NO: 58 - DNA, 1402 bp, Sorghum bicolor
ctccctcggtccgtccctggctccgcgcgcaaccggatccaagcgagtccggcttggacacgtcaccagttttcctctccgccgtctgatcgaggttagcaaaaagggaaaccgacctgcaatcgcacgggtaaggtaaaaccaagctgtagcctttttatctgtcggccagtccggtctgtccatccgggagccgggttcgttccttggcgatggaagaaaccctagccgtcgaatccgccgccggcgagacggcggccgcgcaggcgcctgagcggaaggaagagacgctcgaggaggtgctctcgaggcacaggaaagagaaatcaaaactccaggataaggaaacaagcctcaagaaagctgctgcaaaaggaagcaaagctgagcagaaggcaaagaaaaagcaggtagaggaagagattacacgcctctcaagagagttagaggcgaatcatgctgcagagcttgcttcctttgggtacaaaccctctggcagctcagagaagggaaaccttgacaacttagtgaaggccatagctggtgtttcagtttccagcaattcggattctgcaaagcccagcaagggaacacgacggcgagagaagaaggcgaaggaggaagctgctcgagagcagcggatccaagaagaacaaagcaatctcgtgagcgaccgcatgttagaaaacgagaagcttgaaaggaagcttgagcccttggggctgaccattcaagagataaagccggacggtcactgcctgtaccgtgctgtcgaaaaccagctattgctccattccaatggtgctgcacagtacagttaccaggacctacggcaaatggcagccaagtacatgagggagcatgctgctgatttcctcccattttacttagcagaaggcaaggccgatattggaccagatcccatggagagcttcgagaggtactgtgaggagatggaatccactgcagcttggggtgggcagctcgaacttggtgcactgacccactgcctgaagaaacatatcgtggtctactcaggctccttcccggatgtggagatgggcaaagaatacaaatctggatctggaggtagtgatgccggtgatgcaagcatcaggctgtcgtttcacaggcatgcctatggtctaggcgagcactacaactcggtgattccagccgaatcatcttaacaagagaaactcgatgttctgatggtctctaatacattttgattgtttatgagtggtgcttgtctgagtctgaacacaatagatgactttttattttcctggttgctgtaatctttcaatctgtcgatgaaggtagtgtaccaatcaaagctgtattggggagtttgtttcccaaacaattttgctctcttcagtgatatgttttgtggttt

SEQ ID NO: 59 - DNA, 2412 bp, Sorghum bicolor
caaagagccccccaccttcccttcccatctcactgctcggtcctcctcagcgcctctccctcctctctctcgtgtctcgtctcgtcccgaggagaagcggacaaagcgaggcgctgcagatttcgatccgcttcccaatgcctcccatgcccgccgtcgtcctgtgctagctcccgtcccccgctcctccagtctccgcggcgcgctgcctggatccggggagcgcgtggctaggagcctcagatccgagcgaaacccagccgtccgggggtgatatcgtcgctctagctccagattggcggctgccatttcccctcctcttcttcttactgctcaaggtttcaaggcgagtctgttcaactctggtgggttttcgggttgctgctggttttcttcggttggtttccaccagcgtttttagctgcatttttccgggctgtgctcttctgtgccagaaatctacggagcagtcttgccgtcggtttagacgtagagctatagatagatatcttttggcgagcaatcctggttcttgttccgttcccggtgctagtgttggtgtgttagtggcaaggtttactgttgccatggtgttggtctgacggcccatcaaggttttgtgaaagatgtggaagcagttcctcagcaagctgccccggaagtcgtcggcctcgggggattcaggccagtgcagcaatggcaccgggatacagcgcacgagcagctgcagcagcatcccgtctggccgcccggcttcagccatccggcgcatgtcatccgccgtcttcccatctagtgttgtggctggtatcgagccgctggtctcgttcaaggatgtccccaactcggagaagcagaacctgtttgtgagcaagctgagcctgtgctgtgttgtctttgatttctcggacccgaacaagagttctgtggagaaggatatcaagaggcaggcattgctggatcttatagagtttgtcgagtccaccaatactcgcttctcggaggcggcgatcgcggcctgctctaggatgtgtgctatcaacctgttccgggcgttccctccaaactgcaggtctggctcatcaggtggtggcgagggcgacgaggacgagccaatgttcgatcctgcttggtgccatctgcagcttgtttatgagctgctactgaaatttattggatcatcatccttggatgcaaagatagggaagaagcactttgatcactcattcattgtgaagctcctgaatcttcttgactcagaggatccaagagaaagggattgcttgaaaactattctgcacagggtatatgggaagttcatggtgcaccgtcctttcattcgcaaagcagtgagcaacatattctaccagtttgtctttgagactgatcggcacaatgggatcgcagagctgctggaggtctttggcagtgtcattagtggttttgcattgcctctgaaagaagaacacaagatctttctttggagggttttggttcccctacacaaaccgaaatctgttggtgtgtatcttcagcagctgacctactgtgtaacacagtttatagaaaaggacccaaagcttgcaagctcagtgataattggtttgttaagatattggccaataacaaattgtcagaaggaagtgatgtttctcagtgagattgaagagattttggagtctaccagccaggcagaattccagaaatgtatggtaccattgtttcggagaatcactcattgtatcaccagttctcacttccaggttgctgaaagagcgctcttcgtatggaataatgatcacattatcagcttgattgcacaaaaccgccaagtgatcatgcctcttgttgttccagcactagagcagaatattcagaatcactggaaccaagcagtcctgaatctgactgtgaatgtcaagaaaatgttttctgagatggacgatgatctcttctcatcatgcctggccaagtacaaggaggaagaagaaaaacgtgtgtcgctagaagcgaagcgtaagcttacctgggagaagcttgaggcagctgcagctttccagccagtgactggccatacagccgtcctagtaggccaccagccatcagcaaatatgatcgccaccctgatctagctcatgcatgccgcacaagcaaaggtgctcttcccccttttggtgaagcgcagcaagtgtagtgttccctgttttcctttttttttttttttgcatttgtggtatgagtaatcagtgtagtaagttgtaactatttccggatgtttatgttcataaggcaagaatacctgtaatgtaagattgccgagtgctgacactctctttacatgtatctttgcctatttatggatgaacaattgtcctacagtttaatttcacttttcagcttgcctatataggc

SEQ ID NO: 60 - DNA, 2258 bp, Sorghum bicolor
attgctgtggggaggtaggagaggaggagaggatcgagagggctccggcagagccctagacagagacaagagatcgggagaggtcaggggagagagagcaccaaaagatgcgaaggatgctgtctctgctagagtagcacgggaggccggccaaaagcttcagcaaatcttggccgcctgcacgcctaattatcccttgtcgtctcctgtcgcttcctctcctcttggagcaccgttaaccatcgccgtcagtgactgattaaccgacattgctttcttctcctctgctaacagagatgggttaactacgcctgctgctgctagctacctcagcttttcagaggagagagagagagagagagggtctccgtgcggaacctgcatgatgatagtagctggacagcagcagcagcagcagatgctctcatgaatgaatcatcggccaccccaacaccggaatctcccccccgagccgagtcggggacgccctgctgctttgcatcgtcttcttcctagctgtagcttgtccgtcgtctccactagccaccaagtcaccaacagctctctctccctgcctgctcacacacttcgccactgctgctgctgctgctgctgctgggcgtggttggcgacgagtgcgtgcgtggttcacgagcgagcgagctgagctcctccacaagcccagtcgcgcacggcagcagcagcagcctctttgcttgcctgccttgccgccgccgcctcgtccgtcctcccatcgttttgttggcttctccttggcctggctaggctacctgctgtgctcattcgttccgtcccaacacgaggtggggaattggaggaggcgcgtaccaagacagcagagctgctgctgcctgctggccctgcccggccaccgcatcttcagccgcgcacgccgtcttgctcgtgcagtgcttgccaactcggagacaggcaagagaggccgagagggatcgcaggaagggggatcggagagatcatgggggacgccgcagagaccaccagcaagactcttcacaactggatggccgagccgaggccgaggccgagcggccagggcgacgacgaggagacgcttcagctcagcctcggcctccccggcggcggcggaggaaatggagctggcgctgggctgccacccgccgccgcctggagaatgctgccggccagagacaaggagatgcactccgctgctgctgctgtcgacacctcctccatgctctcgctcggctactccgccccagctttctcgcccgcccgctcaccaggcaaggcaaaggggtccccagcagcggctacagagaatgcccggcttgcatccaccaacaacgcctcccaggcaaggcaaagatctccaaataccccagttattgggtggcctccggttcgtgcattccgaagaaatctggctacctctagcaaagcatcccttgaacatcacaatgggaagaaggcagccagacctgaagagaccacaaaaagagctccatttgtaaagattaacatggatggcatccctattggtagaaaaattgatctgaatgcccttggcagttacgacgagctgtctctgtctgttgacaagctattccggggacttcttgcagcacaacaagaccctctggatgccagcacgaaggagtgttcacaggaagaggtggcaatatcgggtttactagatggaactggggaatacactctggtttatgaggattatgaaggtgatagggtgctggttggtgatgtcccctgggggatgtttgtttcttcggtgaagaggctgcgagttctgaagacatctgacctctcctcatctctaacagcatcaggccggaagaggacggtaactgagtgttgagtgtttacctcttagacacttccagcgatgttaatgtgctgtgaagaagaaaatgtcttctgagcttgtatcatctgtgtttctggtttcttccttttcttttgcctactctcttgaaagggatcatgattatgcgaccttttgggttttcctgctcttacctatcttgtttctgcctacgaggattccgagaagcgatgtgtttgcgcgattgacgtggctgtatgtaaatgttcagacgaaccagctctttatgcagcctattctgtttgttgcctttgacgtactgaggagatgtacttttgtttggtgcctgattactgttagaggagtgcagactccagtgcatgtcattaccttttttttccaccttctatttagc

SEQ ID NO: 61 - DNA, 2632 bp, Hordeum vulgare
acaaacacacgagaagcaaaaggcgggagccttggaagcgttccaacgtacgtacccccacaccacaccatcgacatcgaggaggccgccacgtacctcgccctcctccttcctctcttacatctctccctctctcactccactgcctctccctcccaacccccggtcaaatccaccctcccttccttcgcacccaaaccacgctcgatcgccttttccgctcacacgccaccctcttcgatccgtccatcgtgttcctccgtcgatccatcctcgcgtccgatcctcgtacgtgcacggggttggcccgggagagggatcggggcatcggtacggtcaagcgagcaggcgtcatgggaggcagatggtcgccgtcggcggggtgggggccgtggaggccgcggcttctcctcctcctcgtggcgctgacggcggcgacggtggaggggaggttcgtggtggagaagaacagcctgcgggtgacgtcgccggcgtcgctgcggggcgtgtacgagtgcgccatcggcaacttcgggatgccgcagtacgggggcaccatgcacggcgtcgtcgtctaccccaaggccaacgccagggcatgcaaccccttcgccgacttcggcctctccttcaaccccaaggccggcggcctccccgtcttcctcctcgtcgaccgcggagactgctacttcacaaccaagggatggaacgcgcagacggccggagcggcggcggtgctcgtcgccgacgacagggcagagcccctgatcacaatggacaccccggagtcgagcggcaaggagcacctggagaacatcaccgtgccctcggccctcgtctccaagcgcttcggcgatgacctcaagagcgcgctcgagaacggcgacatggtgaacgtgctcctggactggcgggagtccctcccgcaccccgacgagcgcgtggagtacgagttctggaccaacagcaacgacgagtgcggcgccaagtgcgacatgcagatgaacttcgtccgcgacttccgcggcgtggcacaggtgctggagcagcgcggctacacccagttcgcgccgcactacatcacctggtactgcccggaggccttcgtgctgagcgcgcaatgccggtcgcagtgcatcgaccacggccgctactgcgcccccgacccggagcaggacttcaccaccgggtacgacggcaaggacgtcgtcgtccagaacttgatccagatctgcctcttcaaggtggccaacgagagccgcaagccgtggctgtggtgggactacgtgcatgattttgccatcaggtgcccgatgaaggagaagaagtacgccaccgagtgcgctcgtggtgtgatcaagtcgcttgggatggacattgaaaagattaccaagtgcgtcggagaccccgacgccgatgaggacaatccggtgctcaaggcagagcaagatgctcaaattggccatggtgctcgaggggatgttaccatactgccgactttcgtcgtcaataacagacagtacagagggaaactggataaaagggcggtgctacgagcgatatgttcgggatttgaggggacaactgaacctgatatctgcttgactcaagacgtacaaacaaaccagtgcttggaaaacaatggaggttgctggttggacaagaacactaatttcactgcgtgcaaggataccttccgtggtcgagtttgtgagtgcccggttgtgaatggtgtaaagtttgtcggcgacgggtacacccactgtgaagcttccggtgtcggtcgatgccaaatcaacaatgggggctgctggaaggagaccaggaacggcaagtctgtctcggcatgctcgaatgagcaaaccaaaggctgcaaatgtccacaaggcttcaagggtgacggcgtacacggttgcgaagatgttgatgaatgcaaagagaggctcttctgcgagtgcaaggactgcagctgtgagaacacatggggaagctacgagtgcgggtgcggtggtagcaacatgctgtacatgagagagcacgacacttgcatcagcaaagtggcgacttcgtcggtgggctgggggttcctgtgggtcatcttcttcggcctcggcttcgcgggagtcggagcatacgccgtctacaaatatcggctacggagctacatggattcagagatccgcgcgatcatggcgcagtacatgccgctggagaaccaggagacgtcgagccaccaacggcatgtggagcacgccgacatctgagacggccgagggtttttgcatacggatcgagcagcgtcataagagccaaagtctttctcgtcgcagtccgtggttggtggcatctcgtcgggtttggagctgcagttttgaatttccagagggttggttcgtggttagcgtatatgatcccgaaagacgaaatgctcttctctttttttctctttctgatgacgaaactttgaggacaggtttaggatcgatctcgccggaatttagccgtcatttagtcataatttcgatgctcgtggtcttgttcagcgtgatgacattgtgtaaatactgctgttcgttcggactgaatcgtgtttgctgccctttataaagagaccagaagagcatctagcctt

SEQ ID NO: 62 - DNA, 1848 bp, Hordeum vulgare
agatgacaacctgtggcctgtgctacgccctgtattctcatacatgtcgtcaccttgtgacagagatagtcgttttcatctaaacagatgggcgcctaattcctcaggtaattgactctatataaaccctaattaaccacgacatgatgtctgcagcagagctgttcctgcctccatggcttcatctatatataaacccggcaaccactgccgctaagctgcgaagaagctcctcagtttcctgatctccctcgcgtcctcgtccagtcgcgtgcatcacgacagccagcctagccatgaagcctagcgttgccgccctcctcgtgtccttcgtggcgctgctcttggtcgccgccgtgcggggcgatgacgacggctgcgggtcgccggagtcggcggggcaggaccgggcgcgggcgaaccatctcaaaatcgcggccttcttctccatcctggtctgcggggcgctgggctgctccctgcccgtgctggggcggcgcgtgcccgcgctccggcccgagggcgacgtcttcttcctagtcaaggcgttcgcggcgggggtcatcctcgccacagggttcatccacatactccccgacgcgtttgagaaactcacgtcgccctgcctgctgccttccgacgggccgtggcacgacttcccgttcgccgggctaggggccatggtcggcgccatcggcacgctcgtcgtcgacaccgtcgccacggggtacttcacgcgcgcccagctgaacaaggacggagcgcacggccacggggcgataaccagcagcgccgccgtcgtggacgaggagaaacaggccgctgcggccgccagcgaggaagcccgtcgtcacgagggcggggagcaagaggtacacgtgcacacgcacgctacccatggccacgcccacgggtcggcagcgctcgtggcggccgttggcggcgccgaggacgaaaaggacacgatccggcaccgcgtaatctctcaggtacttgagttgggtattgtggtgcactcggtgatcatcggcatctccctcggcgcgtctcaggacccggacaatatcaaacctctcgtcgtcgccttgagcttccaccagatgttcgagggaatgggccttggtggctgcatagttcaggcaaagttcagggctaggtccatcgtgaccatgatcctcttcttctgcctcacaacgccggtggggatcgccgtcggctttggcatatcgcgagtgtacaacgaatacagcccgacggcgctggtggtggagggcagcctcaactccgtggcggctgggatcctcatctacatggccctcgtcgacctcctcgccgaggacttcatgaaccccaaggtgcagagcagggggaagcttcagctcggcatcaacatctccatgctggtcggtgcaggcctcatgtccatgctcgccaaatgggcctagccgcaagcctacaacatgaaacagtttccctacaacatgaaccagttttgctccatgacatatatatgtacagacgtccccctattgggtcgtcgaatttgaaacgatataatctcccaaactaggtaatgccaacccagtagcttaggcatataaagaaaactagttctggactgaaagtttgggaggtgcgcaaagtgtgagtgtttatcgcaaggcatgtcgacattatgtcgccagctttgaccaggctttcaaccaaaactgatggacagaaattcttcacgtagatgatgccatatccgccaaaacaaaatgagtatattattgactttgaccgagaaccaagaaccaactgcaagctaacctgggagtgagagttgagaaattcgcaatgacacgc

SEQ ID NO: 63 - DNA, 1258 bp, Hordeum vulgare
tcaaggcacgatctagctaacttgaatagaccgagtagcgccatcgtaagcaacacccacagaccgatcatggcggcgcgcgccattgttgtcctctcgctcatcctcgcgctggtcgccatctccagtggaggagcgtcggcgcagctgtcgtcgggcttctactcccacacgtgcccgggcatgctcaaagccgtgcgctcggcactgcacccggccatcggcagggagcggcgcgtgggcgcctccatcgtccgcctctacttccacgattgcttcgtccagggctgcgacgcctcgctgctgctggacgacgcgccgggcctgcgtggtgagaagaacgccacgcccaacaagaactccgccaggggtttcgaggtcatcgacgccgtcaaggcggccgtcgaggagtgttgtcccggcgtcgtctcctgcgctgacatcctcgccatcgccgccgaggagagcgttgtcttcctgggtggcccgagctgggaggtgaagatggggcggagagactcgacgacggccagcttcaacggcgccgagaacaacatcccaccgcccacgtcggggctcgcaaaccttacgtccctcttcgccgcgcaggggctctcccagaaagacatggtcgcactctcaggagcgcacacaatcggcctagcacgctgcacaaacttccgggaccacgtctacaacgacaccaacatcgatgccgactttgccaggagccaccagtcaggctgccctcgcgccacaggctccggcgacaacaacctggcgccgctggacctgcagaccccgaccgtattcgagaacaactactacaaaaacctcgtccagaagaggggcctcctgcactcggaccaagagctttttaatggtggcgctgctgacgcgctggtccgggagtacgtcagtagccagagcgtcttcttcaaggactttgtggagggaatggtcaagatgggggacatcatgcctctgacgggatccagtggacagatcaggatgaactgcaggaggatcaactaagattgttctgccctttccgtgggaataattctgatactgtttccatacttgaattcataatgatttacctttttcacttaaactcatttgtttccttttcatttttaaggataaaaggctaaaacatattacaatactgcccctttgtgccatgttcacggaagaattaaacatggatgcaccgacaaaagaacaaagtgcaaagtgagatgtggcaaatcaa

SEQ ID NO: 64 - DNA, 1829 bp, Phaseolus vulgaris
accaaagcaaagaaagcagagaacactgtgctgtgctgtgctgcttctaccatggaccctctctctctcctccaagttcttcagtcacactcctttgcaactgtgcttgctgtgggtgcttcatctcttctgttcctcatcctcaaactccgactcactggcaggcatgcaagactaccttcagtaccagctgttcctggacttcccgtcgtagggaatctactgcagttgaaggagaagaaaccttacaagaccttcgcacggatggctgaggaacatggacccatctattccatcagagccggttcttccactatcattgttgtcaactccgccgctattgccaaggaggccatggtgaccaggtttaattcaatttcaacaaggaagctatcaaaggccctgacgattctgacttctgataaatgtatggttgccacaagcgactacaatgattttcacaaaacggtcaaaaaacatattcttgcaaacgttttgggagccaatgcacagaagcggcaccgtctccacagagaagacatgttgcaaaatattctgagcagtttcagtgaacatgtgaagaggttctctgatcaggcagttgattttagaaatgttttcgtatctcaactttttatattagcactgaagcaaggtctgggacgcaatatagagtccatttatgttgaggagcttgagcgcacattatcaagagatgacatatataagattctagtgcttgatatgatggagggagccattgaggtggattggcgagatttctttccatacttgaagtggattcctaataggagcgtggagaagagaattcagaatttgaatttccggagaggagttgtcatgagggccttgatgaatgagcagaagaagagaatggcttcaggaaaggtagaaaattgtttttatgactacctggtaaccgaagccaaagaactgaatgaacatcaaatttccatgctactctgggagacaattgttgagacatctgatactacattagtgacatcagaatgggctatgtatgaacttgctaaagacaaaactcgtcaggcccgtttgtacaaggagctccaaaatgtttgtggacaagaaaaggttacagaagagcacttatctaagctaccttacttgggagcagtattccatgaaacattaaggaagcataatccagctccaatcgtgccaataagatatgctcatgaaaatacagaattgggaggatatcacattcctgctggaagccagattgcaataaatatatatggatgcaacatggacaagaataagtgggaaaatcctcttgagtggaagcctgagagatttcttgatgagaaatatgacccctcagatttatacaagaccatggcctttggagctgggaagagggtgtgtgcaggttctcttcaggccatgttgatagcctgcacagcaattgggagatttgttcagcaatatgagtgggatctgggacaggggcaggaggagaatgtggatacaatgtgccttaccacccacagactccaacccctgcaagtaaaactcaggccaagaaaggaatacacgaagtaggtgcatttggtgttgctgccttctgaaggagacctgcagaataaaaccagtgaataagactttttatggtgtttggtgttttgtgttttgtgttttgttttgttccattcgaagtttgttgaactgaggtggtttcttatttactatagccagcagagtatgtctggtggtatgtctttcattgcataacaatcatcatcgccatgttgaatgaattatgaattgtttccagccacaaa

SEQ ID NO: 65 - DNA, 2040 bp, Setaria italica
tccaggcgcatatgcttttactttgggcaagtcaagttccaatcaaaatttggtaaattcatgcaaggatagtttgagagaccatgggcatttgccactgcgcccactgccaaggaaaggatggccaataaatagagcgcccataacaaccatatccatccatctcttcatcttttgttttgatagacagacacaggcacaggcagctgtagtgagtgagtagtgagaccggccgggcagggcagcagcggagaagagagcttgagagttgagacatggccatcggaggcggcggcttcgctgaaggccccggcggcgccggctacagcggccgggtcacctccttcgtggtgctctcctgcatcgtcgccggcagcggcggcatcctcttcggctacgacctcggcatctcaggtggggttacctccatggagtccttcctcagcaagttcttcccggacgtgtaccaccagatgagaggggacaagaaggtgagcaactactgccgcttcgacagcgagctcctcaccgtcttcacctcctccctctacgtcgccggcctcgtcgccacgctcttcgcctcctccgtcacaaggaggttcggccggcgcgcctccatactcatcggcggcagcgtcttcatcgccggctccgtcttcggcggggcagccgtcaacgtctacatgctgctcctcaacaggatcctcctcggcataggactcggcttcaccaaccagtcaattccactgtatctatcagaaatggcgccaccgcagtaccgtggagccatcagcaatggcttcgagctctgcataagcattggcatccttatcgccaacctcatcaactacggagtcgagaaaattgcagatggatggggctggagaatctctctctccttggcagctgtgccagctgcattcctaaccattggcgcaatcttcctgcctgagacacccagcttcataatccaacgggatggcaacattgacgaggcaaagatcctgctccagaggctacgtggcacaactagaatccagaaagagcttgatgatttggtctctgctagcaatatctcgaggacaataagacatccactccggaacatattcaagaggaagtacaggccgcagcttgtcatagcacttttgattcctttcttcaaccaggtcactggaatcaacgtcatcaacttctatgcgccggtcatgttccggaccatcgggctcaaggagagcgcatccctcatgtcagcggtcgtcacacgcatctgtgcaacagttgctaacattgtcgcaatggtcgtcgttgacaggtttgggcgtaggaagctctttctagtaggtggcgttcagatgatcttgtcacagatcatggtaggggcagtcctagctgcaaagttcaaggaccatggagggatggaaaaggagtatgcatacctagtcttgatcatcatgtgtgtgttcgttgcaggctttgcatggtcatggggacctctgacctacttggtcccaaccgagatttgcccactggagatcaggtcagccgggcagagtattgtcattgctgtaatcttcttggtgacatttgtgattggccagaccttcctcgcaatgttatgtcatctcaagtttgggacattctttctctttggcggatgggtgtgcgtgatgacagtcttcgtatacttcttcctgccagagacaaaacagctgccaatggagcaaatggagcaggtctggaggaggcactggttttggaaaaggattgtaggggaggaagaggaagagagagaggcaggaagcatagctttgtccaccacatagtgacttttcttttggggtcaaatctttttggtgaaacctgcagaaatggtacaccattttgattagtataaatatgcatgcatgatcaaagtatattgtatagctgcacaaattgtatcctaactagtaactgcattagtctcctaatttgatgcttctggcattatgtaacatgtaaggggcttccagaattataccaaagtaatatgaactt

SEQ ID NO: 66 - DNA, 1227 bp, Setaria italica
atatcaccaagcattcaggcaagcaactcaagtagttgtcatctcctcccttcacactgcaaagagggatcaagtgctcattagctcaagctagctaggcttctgatctaaaagctcctaatcctcctcgcaatctcttatacgaaagcgaagatctccaatggctggcctgtctcttcagcacccactggctttcgcctttggcctcctcggtaacatcatctccttcatgacctacctggccccactgccgaccttctaccggatctacaagaacaagtcgacgcagggcttccagtcggtgccgtacgtggtggcgctcttcagcgcgatgctatggatctactacgcgctgctcaaatccaacgagtgcctgctcatcaccatcaacgccgcaggctgcgtcatcgagaccctctacatcgccatgtacctcacctacgctcccaagaaagcaaagctgttcacggccaagatcctcctgctcctgaacgtgggggtgttcgggctcatcctcctcctcaccctgctcctctccgccggccagaaccgcctcgtcatcctcggatgggtctgcgtcggcttctctgtcagcgtcttcgtcgcgccactcagcatcatccgtcaggtggtgcgcacgaggagcgtggagttcatgcccttctccctctccctctccctcaccgtcagcgccgtcgtctggttcctctacggcctgctcatcaaggacaaatacgtcgcgctgcccaacgtgctgggcttcagctttggcgtgatccagatgggtctctacgcgctctaccgcaacgcgacgcctagggtgccagccaaggaggtcgccgacgacaaggaggacatcatcaaggtgcccgagcacgtcgtgaccatcgccaagcttggcgcaccggccgtggagctcaagacccacgaggtgcgccccgtggagtctcctcccatggaggaggaggtgaagccggagagcggcatggctgcagccgagaaggagcaggacaaggtgatgaacaaaggtggcaacgccgatcaggcctagattcatgagtatccgggtcgtaattaagcaaggctgcacgcttcgtttggaccacgcgaagtgcccgagctgtgcgtgcggaggtgcacaagcatatacatgatgtgagctatgaaagcggtcaagatgaaagaacgagagaagggagaatcttgataggggtcgtagttcgcgtc

SEQ ID NO: 67 - DNA, 1071 bp, Zea mays
cgcctccaccgttcggcaagcgggagggagatgaggggttcgtcgcggaggccggtggccgtggtgatggcctgggtgcgtcgccagccgcccaaggtcaaggccttcctcgccgtcgtcgcggggatggccgcgctcgtcttcatccgcttcatcgtccacgaccacgacaacctcttcgtcgccgccgaggccgcgcacgcgctcgggatcgccgtgctcatctacaagctcaccaaggagaagacctgcgccggattgtcactcaagtctcaagatttgactgccttatttctggctgttaggctgtattgtagttttgttatggagtatgacatccatacaattctagatacagctacacttgcagctactctttttgttatttacatgattcggttcaaactgaggtcgacatatatgctggataaagacaactttgccttgtactatgtggtattgccctgtgctgtgctagcgctacttgttcatccttcaacatcgcacaacattgtgaacagaatctgctgggccttctgtgtttatttggaagcagtttcagtgttgccccagttgcgcttgatgcaaaataccaagattgtggagccgttcacagctcattatgtgtttgcgctgggtgttgcaaggtttcttagctgtgcacactgggtccttcaggttttggacacccgaggcggattgttgactgcgctgggctacggtctgtggccttcaatggttctcctctccgaaatcgtccagacattcatccttgcagatttctgctactactatgtgaagagtgttttcggcgggcaactggtgctgcggcttccgtccggggtggtctgaaaaactgcagcgagaaagaaaagcatactgttcgtcccttctgtgttagatcatacaaagcgacagtcattgtgctcctagcgcccaaacttttgcactcgtaaagtggattagcagagggccgttaatttttttttcagttgtaaactgtttacgtgaatgctgtaccgataccgtgataccgtctgactttttcatccatgctagagttgaagcagg

SEQ ID NO: 68 - DNA, 1904 bp, Oryza sativa
atcctcgcaaccactgtctcgctctccgccgccatcgccgccgccgccttcctctccgccgccgccgttggtactcgcgcttgccgcccgtcgagctcccctcaccgataaaggctcaccgaaggtttcgtcgtcgaccccgggagtttcaaatatgtctggccgaggactgatgaagcaggacttaagcaagcttgacgtgacgaagctccaccctttatcacctgaagttatctcacgccaggcgacgatcaatatcggtaccatagggcatgtggcccatggaaagtccactgttgtgaaggctatatctggagttcagaccgttcgcttcaagaatgagctggagcgtaacatcactataaagcttggctatgctaatgcgaaaatctacaaatgtgaagacgagaaatgtccacgaccaatgtgctacaaggcttatggaagcggaaaagaagatagccctcactgtgatgtgcctgggtttgaaaacactaggatgaagctactgagacatgtttcttttgttgattgtccgggacacgatattctcatggctacgatgcttaatggagctgctatcatggatggagcattgcttctgatagcagcaaatgaaagttgcccacaaccccagacatctgagcaccttgctgcagttgaaatcatgcgtctccagcatatcatcattcttcagaacaagattgatcttatccaggaaggtgcggcgatgaatcagcatgaagcaatccagaaattcatccagggcaccattgctgaaggtgctccagtggtgccaatatctgctcaactgaagtacaacattgatgtgatctgtgaatacattgtgaagaaaatccccattcctgaaaggaacttcacttcccctccaaacatgattgttattcgctcctttgatgtcaacaagcctggttcagaggttgatgaaattaggggtggtgtagctggtggcagcattctcagaggagttttgagggttaaccagaacattgaagttcgcccgggaattgtaatgaaggatgagagcggcaacatcaaatgcaccccaatctattcgaggatcgtttcactctatgctgaacagaatgaactccaatttgctgtgccaggaggtcttattggtgttggaacaaccatggatccaactttgacacgtgccgatagactggttgggcaggttctgggtgaagttggatcccttcctgatgtctatgtggagcttgagatcaacttcttccttcttcggaggctattaggtgtgaggacaaaaggcacagagaaggctgggaaggtctccaagctcaccaagggtgaaatcctcatgcttaacatcggatctatgtcgactggtgctcgcgtggttgctgtcaagaacgatctcgccaagcttcagctcactgcccctgtctgcacaagcaaaggtgagaaggttgccctcagccgccgtgtcgagaagcattggcgcctcatcggatggggccagatccaggctggcacgacgctcgaagttccaccatgcccgctctgaattgtgtttctccaggcagaaatcctaatctttgagagaagatagaagagatgtggaagggcagagagctcctaggcactatttttgtgaggtggatgagaaaacatgaatttgatttggaagccatgtcattgcgtgctatcgaattcagctatgctacaaaagttttgcttacatctgcattctgaattatggagaatcgttttttcaccatgttataatgaatttgaagtggggagaaacctactaattgatcagaattgcattattgcatttctcactgaatccaatcagtgatgtattattgcattgaacatgttgcaagaaaggaacatatcgctctggattttctttt

SEQ ID NO: 69 - DNA, 989 bp, Oryza sativa
atccaaatccaacgtccgcctaaagaaaaacacgcacacacttcttctgcttccctccccttgtttccgctccacttcccttccaagcaagaaaaccgaggcttcagcttagctaggaccgaccgatccgatgtgcggcggtgcaatcatctacgactacatcccggcgcgccgccgggtgtgcgcctccgacttttggcccgacgccgacgactccgacccccacacccccgctcccgagaaaccgccgcgcgcgaagagggagcggaagaaccagtaccgcgggatcaggcagcggccgtgggggaagtgggcggcggagatccgcgacccggtgaagggggtgcgcgtctggctcggcacctacccgaccgccgaggccgccgcgcgggcctacgaccgcgccgcgcgccgcatcaggggcgccaaggcgaaggtcaacttccccaacgacttcggcgccgcccccgcgccggccgcggcggcggcgaaggccgtccctcgcgtcgcgcccacgccggccgtgctcccgccgcccaagatggaggcggtgtccgagggcgccggcgcctgctcctccgacgaggtcaaggagctgtccgaggagctgctcgcgtacgagaactacatgagcttcctcggcatcccctacatggagggcggcgccgcctccgccgccggcgccgaggaagccgcggcgcccgccgggctctggaccttcgaagactacgagctgccgtcgctagcgctctagtaaaaatgtcacaataaaaatgacatgtatgtgaaaaaatttttccctacccgtagtaagtaaccagtgtctttttttaccgtactctatgcgttatttttgttgaaattaatccattgttgaagttgtaactgtgcatggtcggcgccagtctcagtgaagcttttgctgaatccaagtttttctctaatgtaaatatgaaatttccagttaactcagcttgcaattcttacca

SEQ ID NO: 70 - DNA, 1246 bp, Oryza sativa
tgctctgctccgcccgcttcttcgccgccggcttcctcccacccgcaacccaacgccggcgcggcggccgtggttggttaccctacctacgctactacacgcctcaggggcaatggaggctagagcggggctggcgatgcagtcgcgggcggctgtcggggtcggagctggccccggcgtggggcggcggggccgcgccgtgatccgcgtggggaagcggccaaccgcggcgagcctgcgggtcggaggccccgccggaccggcggcggccaagcccctcgccccgctgtactgcctcaaggcgtccagaggccacgacagcttgcataactcagttgatgaagccctcctgttaaagaggaaatcagaagaagttctattctacttgaacggacggtgtatttatttagttggaatgatgggctcagggaagagtacagttgcaaagatattagccgaagttttgggttattcattctttgacagtgataagttggttgaacaagcagttggaatgccttctgttgcccaaatattcaaggagcacagtgaagcgtttttcagagataatgagagtagtgtcttgagggacttgtcctcaatgcgacgattagttgttgcaactggaggtggtgccgttattcggccagttaactggaaatatatgaagaaaggtctatctgtctggctggatgtgcctttggatgcacttgcaaggcgtattgctcaagtgggtactgcctctcgtcctcttctggatcagccatcgagtgatccatacacagcggccttctcaaaactcagcatgcttgcagagcaaagaggcgatgcttatgcaaatgctgatgctcgagtttctcttgaagaaattgcagctaaacaaggccatgacgatgtctccaaactaacaccgaccgatattgctattgaggccttactcaagattgagaatttcgtcaccgagcattccacatcaagtggcccagttggggacttaatagttgattcccagaatcgaaggacaaaggccttgtagaattttgccctctttttttcttcttttggtgtatcctgtatttgtagcatgtgctgtttaacattatattgatttattctttatatatccaaaagagagataaggcaaagcttgttccccttgtaaaaatagaataacgaatggagctgacgcgagatgttccacaaattttcgttctggaaataagaatcgttgcaatatcgtttgccc

SEQ ID NO: 71 - DNA, 1765 bp, Oryza sativa
gatcaaagcgagacaccttttcttttggcctccttcctcgcgaaaaccaccaaaccaaaacccacacacccacagcttttctccccctcactgctttgctctccagtctccacctcctcctcctcgctgccgcgccgcccatccgccagccatggcgatgtcgtcgtcccgctcggcggccgcgatccgggggcggcgggtcggggcgctggcgagggcgaggaggcacgcgacgagggcgatggcgtcgctgttcggccacgtcgagccggcttccaaggaccccatcctcggcgtcaccgaggccttcctcgccgacccctcccccgacaaagtcaacgtcggcgtcggcgcctaccgggacgacaacggcaagcccgtcgtgctcgagtgcgtgcgcgaggccgagcgccggatcgccggcaacctcaacatggagtaccttccaatgggaggaagtataaagatgattgaagagtcactaaagctggcatatggtgaggattctgatttcatcaaagataagaggattgctgcggtgcaggctctttcaggcacaggtgcatgccggctctttgccgatttccagaggcgtttcttgccaaattcacagatctacatacctacacctacatggtccaatcatcataacatttggagggatgctcaagtacctcaaaggacattcacctattaccatccagagtcaagagggcttgatttcgcaggactgatggatgatattaagaacgctccaaatggttcattctttttgcttcatgcttgtgcccataatcctactggagttgatcctacagaagaacaatggagagagatatcctaccaattcaagataaagaatcatttcccattctttgacatggcataccaaggatttgccagcggtgatccagagagagatgctaaggcaatccgaatcttccttgaagatgggcatcaaattggatgtgctcagtcatatgcaaagaacatgggactgtatgggcaaagggcagggtgcttgagtattctgtgtgaggatgagatgcaagcagtttctgttaagagccaattgcaacagattgcaaggccaatgtacagcaacccacctgttcatggtgcactggttgtctccataatccttaatgatccagaattaaagagtttatggttgaaagaggtcaagggtatggctgatcgaatcattggaatgcggaaggcactccgggaaaatctcgaaggcctaggttcaccattgtcatgggatcacatcaccaatcagattggaatgttctgctacagtgggatgacacctgaacaggtggatcgcttaaccaatgaataccatatttacatgacccgtaatggcagaataagcatggctggtgtaacaacaggaaatgtggcgtatttggctaatgctattcatgaggtcactaaaacgaaatgaagctacttcctcttccctcttcggccaatgaaatgaggcttgcaagcggcggcgttttttttttggggggtggtctattgacctttaagatggttgtactagagaaataatccagtgaacatgctggtgtttctccaacttcggattttccctgtatggaggagagaactagaaacctacccaattttgagagctatagatgccgatcctgttatttcaatcgtcagatgttatgcctgtggcagcctggcaggtcacctcagaaacagagatatgtgaaagagaataaatgcaaatgagctgagcattttgacg

SEQ ID NO: 72 - DNA, 2755 bp, Oryza sativa
catggaagcgtaagcgcgaggagagagcggatcaaacaaacgaaacaaaacaaacgctcgcaccgaactcgaatttcctccgcgttgccctcgccctcgccctcgccgcctcgaatcctccctcgccgccgggggtatcccccgttggcccgcctctccgatccgagcctgatcggaggagtcccgcgccgccgcagctggtggatgcgtgcgtgccgctagctgcagatctcctcctctcccggcgacgagcgtctaggcccgtgtggttgtgactaagtatcggatcagcgatctttgagaaaaatacagagtgagaagtctgatcgtctgagggtgcatttgtggagaatgtcagagagcaatgtcgacggcatcgaaatatcagctagtaacgatgagaggagggacagaggggacgctgagatttcagaggatgagccaaggcagacgaggatacggtcgttgaagaagaaggcgctgcatgcatctacgaggctgacgcattcgctgaagaagagagggaagaggaaagtgggctgcagagtgccgaagatcacgatagaggatgtcagggacgcggaggaggagcaggctgtcagctcttttcgagaggttttgtttgccagggacatgctgcctgagaggcatgacgattatcacacgatgcttagattcttgaaagctaggaaatttgatgttgaaaaggcagcacatatgtgggctgacatgctgcactggaggaaggatttcgggactgacacaattttggaagattttgaatttcatgagctagaggaggtgctgcagtattatccccatggttatcatggtgttgacaaggaaggaaggcccgtctatatcgagttgcttgggaaagttgaacccagtaagcttgtacaaattacaacagtggaacgctatattaaatatcatgtacaggaatttgagagagcattccgagagaagtttcctgcatgctcaattgctgctaaaaagcatattgatacgacaactacaatactggatgtccacggtgtgggttggaagaactttagcaagatcgcaagggatttggtgcgctgtatgcagaaaatagatggtgattattatcctgagacactacatcaaatgttcattgtaaatgcggggcctggttttaaactgatctggagtactgtgaagggacttcttgaccccaaaacctcgtctaaaatccatgttctaggaacaaaataccaacacagacttcttgaagctattgactcaagccaactaccagagtttcttggtggttcttgcacgtgctctagccagggaggatgcctgcgatccaacaaaggcccctggagtgatcctttaattatgaagcttgtacattgcatggaatcatctgcgttgaaggacattggccaagtatctgatatagaagaagcaattacaggctctgtaagattgcgtgctctcaagttaccagaaagaattagttatacatcaaatgctgaatctggttcagatgttgatgatcttggatctcctataggacaggaagattttgagtatcatagtttggctccagttcatgaggaggccagggagtcaggatcaacatgcagtggttctgatgataaagttgttgagacgaatacaatatacaaccctcctggaaatggatcgggacagtacagcgcaagacaaaatccctcaataaacagagtttcgcctgagccaggtcacgtcccaaatgatggtgaaggaaatgcagatcatgggatcttgaaatatatttctaaaaaagttctcggtgtaattcttgaagtactctcttttttgcgtattttcatccgtcatcgacaacagttggaaaatgtcccccagcatactacaacagtgcacagtaatcaggcagatcttcagataattaaggaagatcgtgtaaatccttgtctagagcgtcttgaaagacttgagacaatgtttaatcagctcagcagaaagcctccagagattccacaggataaggatcgtgctatacaggattcttttgacaggataaagtgcattgaatttgatctggagaagacaaagaaggtattgcatgcaacagtgattagacaaatgcagatggctgagacattggaagctgtaaaggagtccgatcttaggagaagaaaattttgtacataataaacttagcagcaatgtacaggaacaagaaaagaagagtcgatgacttactaatgccggcattccaacataaaactaaacttcattgctttgtacatggttacccttttctcactttttttttggtctatcaaaaaaccgagcaaatcttactgtgaataagtacagagtggtgacccgaggcaaactgagaagatagtcaagaaagaccgtgctggaagtcacttaacatagtccagcttataatagtccaaaagggatattctaaaagagccaatgcacagcttatttatgttccatcgagcctcctgatctgctgtatgcatctcatcaatgccttgtgcatttttcattttcagaacagtttgaggcaatgggccggaattcatagttcttcataccctttttttggttgatatggtcaatacatgatcaggtttttcattgctttgcctcccttcaaatgtaaagtgtaaatatatgactgcactgcttgctgctgcaagatacttataccagattgacatggtgaaacggccaataaatgccaaaatttaccgttctttta

SEQ ID NO: 73 - DNA, 948 bp, Oryza sativa
ccgaaaacgatacgcgacgcgacgcacggccgctcacctcgctctcgccaccgtatcgcgtttccgcccccgacgcacaggccaaaaccaaccagtccaccacacgcaccaccgcaccgcgcgtcgcgcgagaccaaaaaaaggaaaaaaaaaccccaccaccacgccatcaagtccaccaccatcaccacggctactactagcaattagcaaagcaccgtgcgcggccgcggcgtccactcctccatctggctagacacaccgtgtctccggccggctgcctccctggatctggtcgtggggagggagctaagctggtggtgattttggtcttggaggtgtggcgatgctgcagctgctgatggcgctggccttctcggcggcgccgctgacgctgtacctgccgccggtgcggagcctcagcctcttcgtcgaggcgatcgaggccgtcttccgcgactgcgcgccgtactcccagggcgccatcttccgcttccgcctcggcctctcccgcatcctctccggcctcgcccgcgccctccgctagacgcccggcccggtgacacctctcttcttcctattgatcggatacatgtatgtcggctacaatcgcccgcggcccgcacgtcatcagcttgtgcgattgtgaatctctcttgcatcttgttttctcctcaatttgcccccttcacttgtagtttttgcctagtttcttttccctttttttttgggttggggattggatgtagcatgtagagaagggaataatcaagcttagtaatctgttcagaggggttcgagattttgtgagaaaattagcgtgtttgtgtgcgtgtatggggatgtgctgtgtataattgggaaagtttgcgttcttgatcagaagctgtagttgagaactgaaatgaatagaagcatttgactctttggtctgataatttgatccaa

SEQ ID NO: 74 - DNA, 482 bp, Oryza sativa
gtgcaggtcgacatccaagtcactccaaaccccacacacgcgattcgtcgtcaaggctaagctcagtcacacagtgttcgcgatgatcctggtggccgtagtggcggagctgctcgaggagtacacggtgctggtggcccgggtgctggagcagctgttcaacgacgcgcccttccctcgccggatgcggttcctcatgctgcggagcctccccttcgtgccgccgccgctgccccctccgccgccgtcgcacgccctccgcgtcaccacccgcggctgatcgaccccacgactccctcgccggctcgtaggataggttaagccgagtgtgctctgcttttctcagttggtttagtcgattctgtcggctgctggttcttgtcggacaaagtccaggttcgcggatcaatttgtttctgtacatagtagtatttttttgggtgagaagaaacttgaaagacagtgaagttgtgctttctcgc

SEQ ID NO: 75 - DNA, 2434 bp, Sorghum bicolor
ccacccgtggccgtggtaatcaaatcggacgcacatgcggcgcgcctccctttcacggcctccccccgtctccgcctccacctaatcccggcccgggcaccccaatccgaggcgcctgccgtgcgctttaagtgagcgcaacacaccaaaagctgcagccagcggaggcggagaggagaaggagaagcagcagtagccgcagggccgccaacgcccaacgccatggcggtgggcgcgaccgccacgaagctgcacctctcgtcggcggccgcggccgcgcgccgcccctcgctgctccacctcgcggccgtcgccgtcctctgctcggtgtcctacctcctcggcatctggcaccacggcggcttctccgcgggccccgccgccgccggcggcggcgtctcctcctcggtctccatcgccaccgccgtctcgtgcgccaccccagccctgacgaccgcctcctcgtctccccccgcggggccgctcgacttcgccgcgcaccacacggcggaggggacggaggcggaggccgcgctccgccaccgcagctacgaggcgtgccccgccaagtactccgagtacacgccctgcgaggacgtggagcgctccctgcggttcccgcgcgaccgcctcgtctaccgggagcgccactgccccgcggacggcgagcgcctccggtgcctcgtgccggcgcccaagggctaccgcaacccgttcccgtggccggccagccgcgacgtcgcctggttcgccaacgtgccgcacaaggagctcagcgtcgagaaggcggtgcagaattggatccgcgtcgacggcgacaggttccgcttccccgggggcggcaccatgttccctcgcggcgccggcgcctacatcgacgacatcggcaagcttatccccctccacgacggatccatccgcaccgcccttgacaccggctgcggggtggcgagctggggagcctacttgctgtcacgcaacatccttgccatgtccttcgctccgcgagactcccacgaggcgcaggttcagtttgctctagagcgtggtgtgccggcgatgattggtgtccttgcctccaatcggctcacctatccggcacgttcctttgacatggcgcactgctctcgctgcctcatcccatggcaactttacgatgggctatacttgatagaggttgatcgtatcctaaggcctggaggttattggattttgtctggaccaccaatcaactggaagaaacactggaaggggtgggacaggactaaagaagacctggatgcagagcagaaagccattgagtcagttgccaagagcctctgctggaagaagatcaaggaggagggcgacattgcaatctggcagaagcctactaaccacattcattgcaaggccatccacaaagttatcaagtccccgcccttctgttctaaccaaaacccagatgctgcctggtatgacaagatggaagcgtgtataactccactcccagaggtcagtgacttgaaggaggttgccggcggtgcgttgaagaaatggccggagaggctaactgcagtgccgccccggattgccagtggcagcatcgagggggtcacggaagagatgtttgtggaagatactgagttatggaagaagagagttgggcactacaagtccgtgattgctcaactcggccagaaaggccggtaccgcaacttactggatatgaatgcaaagtttggcggcttcgctgcggcattggtaaatgaccccttgtgggtcatgaacatggtccctactgtggggaactcaacaacccttggggttatatacgagcgtggcctcattgggagctaccaggactggtgtgagggcatgtccacttacccccggacctacgacctcattcatgcagattcagtgttcacactgtacaatggcagatgtgaggcggagaacattctgctcgaaatggacagaattctgaggcctgagggcacggtcatcatcagagatgacgtggatctgttagtgaagataaagagcatcacggacgggatgagatggaatagccagatcgtggatcacgaagatggtccgctcgtccgcgagaagctcctccttgttgtgaagacatactggactctcgatgacaacaaacaatagcaataacgtggaataaaagagttagaatgattattgacatgatcggcaaatcttgtgactgcctcaccgtttgccctgtgaatctggtggagtttgttttctattttcattttgggtattcattttggggggatagttcacataatggagatataatctccttgtgttaagatataagagggaaacccggcacagattttgacataaaaaacagacattgggcaaagtggggtaaatagaaagtacaatattgggatcattttcgtctccgggtgcacattgtttg

SEQ ID NO: 76 - DNA, 2415 bp, Sorghum bicolor
ctccaatccaaacccaaccacaaccacctgcccgcccgcccgaccgaggtctttgcagtgacacgccaccaccagagcgcgccaagctcgtgcacccaaccaactgccgactgacgccgatggcggccacctcgggccacgccgtggtggtcgacatccacgacgaaccagccgccgccgagtcgacggcaaccgcgccgcagctccagccggtgatgctcccgccggtgccctacgtgctccgcttcaccgacctctcctacagcgtcaagaagcgcggcggcgggctggggttgggctgcctcccgacacgccgccccagcaaccgcctcgcgtccttggacgctccgaccaccaccaccaccaccaccaacaccaagactctcctcgacggcatctccggggaagcacgggaaggtgagctgttcgcggtcatgggcgcgagcggttccgggaagtccacgctcgtcgacgccctggcgggtcggatcgcgcgggacagcctgcgcggcggcggcgcgacgctgaacggggagccgctccacgggcggcggctgcgggccatctcggcgtacgtgatgcaggacgacctgctgtacccgatgctgacggtgcgggagacgctgctgttcgcggccgagttccgcctccccagggcgctgccggcggaccggaagcgcgcgcgcgtcgacgcgctcgtcgaccagctcggcctcgcccgcgccgccgacaccatcatcggcgacgagggccaccgcggggtgtcgggcggggagcggcggcgcgtgtcgatcggcacggatatcgtccatgaccccatcgtcctcttcctcgacgagcccacctcggggctggactcggccagcgcgttcatggtggtccaggtgctccgccgcatcgcgcagagtgggagtgttgtcatcatgaccatccaccagcctagtgctcgtatccttggtattcttgaccggcttctcctcctctcgcgtggacgcaccgtgtacgccggcacgccggccggattgaagcccttcttctccgagttcggcacgcctatccccgacaacgagaaccccgccgagttcgccctcgacaccatccgggagtacgagcgcagccccgacggcgccgccccgctcgccgacttcaacgtcaagtggcagcacggcagcagcgcgtcgtccggtgccggcgtggacaaggacaacaacaacaacaagctgatgccgctggagctggcgatcgccgagagcgtgtctcgagggaagctggtggcggggagcggcgggacgggcggcgggagcgcggtgacggtgccgacgttcgcgaacccgccgtggacggaggtgtgggtgctgatcaagcgctccttcaccaacacggggcggatgccggagctcttcgtgatgcggctcggcaccatcatggtgacggggttcatcctggccaccatcttctggcggctggacgacacgcccaagggcgtgcaggagcggctagggttcttcgccatgggcatgtccaccatgttctacgtgtgcgccgacgcgctcccggtgttcgtgcaggagcggcacatctacctgcgcgagacggcgcacaacgcgtaccgccgcatctcgtacgtgcttgccaacgccgtggtcgcgttcccgccgctggtgttcctgtcgctggcgttcgcggtcaccacgttctgggcggtggggctggccggcggcgcgccgtcgttcctcttcttcgtgctcatcatcctggcatccttctgggcgggcagcggcttcgtcacgttcctctcggcggtggtgccgcacgtcatgctgggctacacggtggtcgtcgccatcctcgcctacttcctcctcttctccggcttcttcatcaaccgcgacaggatcccggactactggatttggttccactacctgtcgctggtgaagtacccgtaccaggcggtgctgcagaacgagttcagcgacgcgtcgcgctgcttctcgcgcggcgtgcagatgttcgacggaacgccgatcgggcacatggcggagggcgtcaagctcaaggtgctggaggccatcagcaggacgctggggaccaacatgacggcaaccacctgcgtcaccaccggcgccgacgtgctggcgtcgcaggccgtcacggatattgggaaatggaagtgcttgctggtgaccgtggcgtggggcttcttcttcagggcgctcttctacgtcgtcttgctcgttggaagcaagaacaagaggaagtagtagtagtaacaaattagtaggggttgatgaaacttaattatatataaattcggtgatactgtgatctagtgatgatgaagcaaaatgtatagctcgagaagtaaaaacatattgtatttgttttttttataagaaatatatacacactgtt

SEQ ID NO: 77 - DNA, 1167 bp, Sorghum bicolor
tccaggtccaggcaaatcccgtcttttctcccgtccccatctgcctgcctcggcttgtcgcacgcttcgaagcttctcgcatctactacttggtgctccgtctccgtctccgtctccgtctcccacgccaccgccgccccggccgccggtaggtaatatcagttccaagggcactcaacatggcggccaatgttggggaatcaacaagcggcagcagcagtggcgctgatgctgggggtagctttgagtgcaacatatgcttcgagctgccacaggagccgatcgtgacgctgtgcgggcacctcttctgctggccgtgcctctacaaatggttgcgcatccactcgcactcccccgagtgcccagtgtgcaaggccatcgtcgaggaggacaagctcgtccccctgtacggccgtggcaaggaccgtgtggacccaaggtcaaagaacgtccccggggcggcagacatccccaaccgtccggctggacagaggcctgccacggctccgcaggtcgaccccaacacccacttccccaacgccaacccgaacccgtggttcatgggcgggggcatcccgctggcgaacgcgcggtgggggaactacaccttctcggcggcattcgggggcctgttcccgctgctcagcttccaggtgcatgggttcccggacgccaccgcctatggccagcctgctgggttcccttacggatatggccacggccatggccatgcgttccatggcgggcatgctggaggacatgcccacgccgccgcagctcctcggcatgggcagcagcagcagcaggcggatgtgtacctcaaggcgctgctcatcctggttggctttctggtgattgcgagcctcatcacgttctaggctttgcctgctggttggttggtgtcatattgctgttgccttgctggtaataaggagtagtataagagagacggagacagttgcagatacgctgcgatgtattgtgtgcatttatcttgccctctccatatacaacacgaccgaaactgaattattcagagcggcgcgtttacatggggaagtgttgatagcagaattgttgtacatactgtttggatgtggtcctgtggtctgtggatcacctacatgtatactgtggttttgaacatacattataatgaataataat

SEQ ID NO: 78 - DNA, 2168 bp, Sorghum bicolor
ccgcacgcggcacacgcccccccgctcgccttttccctgccgccggcgccgctcctttcgattttcgaaccctaaccagtttcaaatccgacctccaacccagcctccaaagtcactagatccgcggcgaccatgcggcgcggcggcggccaccggttccccaaaccctccctggcgccctccaccgcggccgaggccaccccagcgctggacgccagcgtcatccgcaacctcgactccgccttctcccgccgcgactccgacgccgccagcctctgcagcagccgccccgcttccgccgccggtgcgggcgtcggcgccgcccccaacttctccgaccgccccacgcaggccgccgcgctccgcgtcgtgaacagattcctcgcccccgacgtcgcgctccgggggcctctgcccgccgcgcgcgacatccaggcggcgctccgcctcctcgtcgaccgtctccacttgccccgcaacgacgccacgttcgaggatgacctcatccaggaccttcgtattctcggctgcccctacaaggtcaatcgctccgcactcaaggcccccggcaccccgcactcgtggccggtggtgctctccgtactccactggctcaccaccctctgctacgcccaaggagacgacctggatgccccattcaacgatctcttgctctacaccacccagagctactcccacttcatgtcggggaacgacgacgccgttgcggcccttgacgaggagtacacctccaaagcccggatgactggtgaggcgtccgttgaaacagttcgtgccctggagaaagaggccgaggaactggagaccgaggtgaataagctcatctccggtccctcgcggcggggagcactggaaacagagaaggaagccttcactgctgatgtttgcaagtttgatgctgtggtgaatacttggaaaaggaagatcaacgaaaaggaacaggcgttggggaatttggagaaagagttggaggccaaagtgttggacacccagcgctctgctgctgaagttcaggatctattgaaacaagtggatgctcagccagtggatgtgaggggtatggatagaatgcgtagggagatgcaggcaattgaaaatgatattgccaacgctgagaaggggaaagcagcactggaggataaggtctgggaagttgaagctaagctggttaccaagcttgacgagcttgagacgcttgctgagcagtgcaaccaggccctcaaaaagttgaaacctactgttccttttcagtacatgataaattcaaaaggatcttctcctgctgagatgctaggtagtggttacaaaacagtactaaaacctgcacttgtggctcgtgctgaggagaacaaaaggatctgtctctcaaatcttgaaagcctaaatgatctaaagaagcagctgcaaggaaatgttaaggttctagaggaggaaaggaataatatttccagcttccaggcaaaaaatgacgaaatggttgctcgtttgaattcactggatcttgaaattataaatgatgactcgagattcacatctgaagctagacaaatgagagatgagttggagaaaaagaagaatagtttgatttctcttgaaaaggaggcagatgatttttttaagatatcggagaagaggctccaagatgcaaaacttaaagctgaagaagatactgaggtggctgctaaggatctgctggagcttcttgattccatggctgaatataaagagtcaatggaaacaacaattgctcagaggaggaaggatctctatgaaactgctgattatatagcaggcctgttcgctggaacttctcagtagcaaaaaacagccattgtgcagtgctagcagagagagcacagctgctgttgctgcaaataagctccggtacttgctagcgtctttacccaagtgctcaaaggaaagtagaaaagtacttgattagcgttctctttctacagtacgtggtattagtatcttggtcatagctactgtaagaggtggaagagattatagcaacatgtattcctcgaccagggctcaaaatttaggcaattttttgtgactttcagtaatttcatgggtattattgtaatgcatacactttattataaatatataactctagacccatattttatgttgtttta

SEQ ID NO: 79 - DNA, 1045 bp, Helianthus annuus
cctccctccttcctccctcttctcctctgtgcgactgcacccatcaccaaatcttcacctatatatctatctccattcatcactgcaatcttcaaaaatcaacgatgatcggaccacagaggccacaaattgtgttgttcggatcatcaattgttcaactcagtttcagcaacgacggttggggcgccattctcgctgacgtctacgctcgtaaggcggatatagtgctacgagggtactatggatggaattcccgacgtgctgtcaaggtccttgatcaagtatttccaaaggatgctgctagtcaaccttcactgatcatcgtttactttggtggtaacgattcaatgggacctcactcatctggtctaggcccccatgtcccgcttcctgaatatattgaaaacatgagaaaaattgctactcatctccaggggctttcagacacaacgcgtttaattttcctcacttgcccaccagtggatgaggtcaaacttaatgaaaacaccagctcaatctttagtgaacttgttagaacaaatgagctatgccgggcttattcagatgcatgtgtagagctgtgcaatgagatgggaataaaagttatcgatctttggactgcgtttcagaaacgagataattggttgactttctttacggatggggtgcatttatcaggtgagggtagcaaggtagttgttgaggagatactaaaggtgcttaaagaagcagaatggaaaccgagtctacactggaaatctatgcccaccgagttttcagaagactcaccctatgatttagtctatagcgatggcaaaactaccctaaacccgtctgactggactttccacagagaaatacagtgggactaataagatagtttcattcataactgcagaacacgcgcatttgtaagtaatgcaatactttctattgcaacaactgagatttgtaccagtgatctttaatcaggttctttgacctttgtacttctttttatgctcataaaacgagcttctaatgcaacatctaaatgtagcattgc

SEQ ID NO: 80 - DNA, 2339 bp, Helianthus annuus
tagtaggaataagagtgcaacaatattaaagagaggtaccataaaagctctgccgtataatgcagctgagccaccacccgtctcctttaatttcttctctctttatatgaacttgaacttattcattcactctcatcacatctcaccggaaaacaatgtcactttacaccgtcaaagtcgaggattcaagagcggcgaccggagacgtgccgtcggcaggaccggtttataggtgcatttatgccaaggatggtcttatggagttgcctcccggttatgactctccctgggactttttcagcgaatctgcaaaaagaaacccaaagaaccctgcgcttggtcgtcgtcaaatcatcgatggaaaggctggtggctattcatggctatcatatcaagatgcctacaattctgcaatcagaattgcttccgcaatcagaagccgatctgttaatcctggagatcggtgcggcatatatggaccaaattgtccagaatggatcatttccatggaggcttgtaacagcaatggcataacctatgttcctctatatgatacacttggtgctaatgcagttgaattcatcatcaaccatgcagaaatctcattagtttttgttcaagataacaaaatacctgctattctatcatgtcttccaaattgttcatcaaatctaaaaactattgtgagctttgggaatatctctgaatcacagaagaaagaagccatggaacatggtgttgattgcttctcctgggaagaatttgcttccatgggaaatttggaagatgaactgcccgcaaaacataaaaatgacatatgcacaataatgtatacaagtggcacgaccggagaaccaaagggtgtcatactaagtaatgctgctttcatgtctgaagtcttgtccatgcatcaattacttgtagaaacagacaaaccgggcacagaagaagatacctacttctctttccttccattagcacatatattcgatcagatcatcgagacatattgcatctacagtggggcctcaataggattttggcaagcagatattagatatttgattgaggaccttcttgtattaaaaccaacgatattttgtggtgttcccagagtttatgaccgcatttataccggtataatggctaagattttagctggaggcactgtaaagaaggcgttatttgattttgcatacaactataaattgagaaaccttgaaaagggaatacaacaagacaaatcagctcctctgttggataagctagtgtttgataagattaaacaaggatttggaggacgggttcgtcttatgttatctggagccgcacctttgccaaaacatgtggaagaatttttgagggtgacatgttgtacagtcctttcacaaggatatggtctcacagaaagctgtggtggatgctttacatccatagcaaatgtgtactctatgataggaactgttggtgtacctatgacaaccattgaggcaagactagagtcagtgccagagatgggatatgatgcgctcagcagcgtgccacgtggtgaaatttgtctcagaggaaacacattattttcggggtatcataaaagagaggatcttactaaagatgtccttgtcaatggctggttccatacaggtgatatcggggaatggcaagcggatggtgcaatgaaaataattgataggaaaaagaatatattcaagttgtcacaaggagaatatgtcgcggttgaaaacattgaaagcgcatattcacggtgccctctggtgaccgcgatttgggtgtatggcaatagttttgaatcttttctcgtggcggttgtggtccctgatcgaatggcaattgaagaatgggcaacaaagaataatgaatcaggagactatatttcattgtgcaagaatccaaatgttagaaaatatgttcttgatgagcttaattctgaagctaagaataacaaacttcgtggatttgagatgctgaaagccgttcatctggagcctgttccattcgactttgagagagatttgataaccccaacatttaaactgaagaggcagcaacttctaaaatactacaaggattgtatcgataaactatatgctgaagcaaaggcatctaagaaatgaacgttaaacacgcacctttcatataagtgttctctgttcttgatttgtagttttgtacgaagtaaatccttagtttagtttggacctcgtgtgttatggtctagagggctaaaccctaaaccttatatgtattttaaacgaattatggtttgtactttgtaatcatgaacttgtgttttatttaaaacgtacacaagtataatt

SEQ ID NO: 81 - DNA, 1381 bp, Solanum lycopersicum
ggacattatttttctgataataaaagaaacttcatgaacccaaactccaaacaagcccttacttgtattcctctagatccaaaccccaccgttaaattctcgccggcggtcatccttccgacgtcgggaaatgaaacgtggaagcggattctcgttccacgtcaccgtcgtcatagccgccattgcattcatatacttctcaacggtgttcgtcttcattgatcagtggtttgggctttggtcgtcccctggaatgcttaacgccgtcttcttcaccgtagttgctgttatgtgcatttccaattatgcccttgccatctacaccgatccgggtcaggttcctagctcatttgtacccgacgttgaagaccctgataatattgttcatgagatcaaacgcaagggtggagatttgagatactgccagaagtgctccctttataagcctccacgtgcacatcattgtcgtatatgtaacaaatgtgtactacgaatggatcatcattgcgtgtggatgaataattgtgtgggccatgcgaactacaagatcttcttcatctttgttatgtatgctgttgtttcttgcatatattccctggttttgcttgctggtagcataaccataaactctccaaaggatgaccagcaaagtgaaggctctttcagagttgtatatattatctcagggcttatactagtccctctaagtttggcgctgggctttttcctgtgttggcatttttacctgattttgcaaaacaaaacaacaattgagtaccaagaaggtgttagagcgatgtgcgttgctgaaaagggaggttatgtctattcacatccatatgatcttggtgcatatgagaatttgatagcagttcttggtccaaatgtcctttgctggctgttgccctccacaaaacatatagactctggccttcgttttcggacatcatttgataacgtaccgaggacgcctgtatcaaaatgaaatgtttcttcttacagcagagatgtaaagtgtttgatcaccaaagcagtttggtgcagctgtgtaagtgtagctagctccactcttcgtgtaaaggagctaacaagaaccctgtttcagactgtcaaacgatacaacacggaggcagtcatcaacttttttgtattctaacagttgtaagagatgttcagtcctccatcggcaatcgcactgtagtcgaaggtaactagagaattgaagcagttggacatagcatactagcattgttcatagttttgggttatttacgtgatgtacaaatagaagtccccttttcaagctaacttagagaatcctgctgtagctcaaatggttgtaaattgtaatatatgcaaattgcaactacaaaatgagtta

SEQ ID NO: 82 - DNA, 954 bp, Triticum aestivum
tccatccatccatcgctatttacttcccacaggcaagtagtggagttcgattcaggggttcagccatggcagctccgagagcactcgtcctcggcgtcctgctgctgatcgccgtctccaacaccgaggcggcgtccgtcgtcgtcggcatggccaagtgcgccgactgcaccaggaagaacatgaaggccgaggaagccttcaagggtcttcaggtggcgatcaagtgcaagagcgtccacggcgactacgagagcaaggcggtgggtgccctcgaccgcaccggcgccttcagcgtgcccctggccgccgacctccacggtgccgactgcgtcgctcagctccacagcgctgcctccaacacgccgtgcctcggccaggagccatccaagatcgcgccggtgtccgagggcaccaccttcggcgttgtcgccggcgccaagaccaacgtgttggcatcgccagagtgtgcgtcggcgaccctgctcgggccgatcaagaagcacatcatcgagcacttccaccacaagaagcccgtgccaccgaagccggagcccaagccccagccccacccagactacggcccggtacccaagcctgagccgaagccgcagccccacccggactaccaccccatccctcccacgcccacctacggcggcggcggcggtggcggtggataccacggacaccactaactccgatctgccaccgtccggcccaacactgaaatttcatcaccgggttcagtgagtgatcgaggtcgttgctttggtcttctgccattcgctgccccgttttagtatctgcactgcagagttgagagttcagaataaactttgtgaggaacacatgcatggattagtgtgcttcgattgcttttttatgattgtaatttcggtgtgtgctttgtataagaagttattgtggatcaagtaatttaatcaagtccat

SEQ ID NO: 83 - DNA, 1635 bp, Triticum aestivum
ggctcgcagtctacgacgagctcatagacccaaggagcggcgccatggtgatctcggtccccagccaccggcgctccatgcgcgacgcaatgctcggcgggggccgccagctccacaagccccttcgctgcgccttctacgacgggattcccggcgaaggcctcgccgccgcgctcgccgaggccactgggagcgtttccctctcccgcacccccgccaccgacggcagcgtcggagggaaggcggcgaggaacgtgctcatcctcatgagcgacaccggcggcggccaccgcgcctccgccgaggctctccgggacgccttccgcctcgatttcggcgacgcctaccaggtgttcgtcagagatttggggaaagagtacggcggctggccgctgaacgacatggagcggtcgtacaagttcatgatccgccatgtccggctctggaaggtggccttccacggcacctccccgcgctgggttcacggaatgtacctcaccgccctcgcctacctctacgccaacgaggtggtggccgggatgatgaagtacaagccggacgtgatcatcagcgtgcaccctctgatgcagcacatcccgctgtgggtgctcaagtggcagagcctgcagcccaaggtcccgttcttcaccgtcatcaccgacctcaacacctgccacccgacatggttccaccacggcgtgacgaggtgctactgcccctcggccgaggtggcgaagagggccctgacccgcgggctcgacccgtcccaaatccgcgtgtacgggctgccgatcaggccatccttctgccgcgccgtgctcgacaaggatgagctgaggaaagaacttggcctgcaccctgaactgcctgctgttctactgatgggaggcggtgaagggatgggcccggtggaggagacggccaaggccctcggccacgagctctacgatcaccggagacgccggccggtcgggcaggtcgtggtcatatgcggcaggaatcaggcgctgcggtccaccttgctgtccctgccatggaaggtccctgtcaagattagagggttcgagaagcagatggagaagtggatgggcgcttgcgactgcatcatcactaaggctggccctggcacaattgcagaagccttgataagaggacttccaattattctcaacgatttcatccccggacaggaagtagggaatgtgccttacgtggtcgataacggcgccggtgtgttctgcaaggacccaggggaagctgcgagacaagttgcccgatggtttaccacagaaactgacgagctcaggaggtactcccgcaatgcgctgaagctagcgcagcccgaagcagtgttcgacatcgtgagggacatccacaagctccagccgcagcctgccgctctaacccggatcccctactccttgacctcaccattctcataccatatatgaacccgcggaacctcttgcagaatatactctgcaaagtgaatatgccttcaaacttggctgtgcctgggcttggctgcctgctgaagaacctgtatataccatgtacataactggatggaacatctatgttggtgcttctgtagttcttgactgcttgtattggactattggtaattggaatgta

SEQ ID NO: 84 - DNA, 2224 bp, Hordeum vulgare
aaccgatttcagtttcaatttcaatcacagcccagcaaagtcggcgagaacgccgcccccgctttcaaaaacccaccccggtaacaaacaccgtacctctcctcccccccctccttcgccgtccccttcctcctcccgctcctcccctttcaaatcctctcccctctccctataaacctaggggagggagcggccgcagaccactcccagagcccagatctatctggcccctcttcgatcgccccggcttcctcgtccatggcgactccgccgtcgccgccgccgcccacgcgcgcctcctgcggctcctttctccaggaactgcaggaattatggggagaaataggcccggatgaactagagagagataggatgatcttgcaattggaggaggactgcctcaatgtttacaggaagaaagtggaacaaactagaaagcaaaagacagacctgcttcaagtgatgtccttgggtgaagccgagataggaaagatcctttctgctctaggagagcgtgaatccttttccagggcggagaagctcgggggtacattaatggaacaacttgcaaaactggaaccagttctggacgatctgagacggcggagagacgagcgcataaatgagtttttggctgttcagctgcatattgttcgtctacaagctgagatttcaggaaccattaatcacggggatcctgcagctcctttagtggatgagactgacctatctacaggaagactggctgaactgaaaactcagcttaatgagctccagacagaaaagaatctcagactgcaaaagattgatggtcagatcaagtgtattaatgaaatgtgcaacatgatgtctcttgatcttaagaagacattatatgaagtccatcccagctttgttgaattggaaagaatcaaagccatgagtataagtgatagcacacttgataggcttgcaggaaaagttcatgcactaaaccaagaaaagaaacagaggctccggaagctacaagatcttggaagcacactcattgagttatggagtctaatggacacaccattacatgaacagaaatgctttgatcatgttacttctttgatttcagtctcacccaatacagtgatgccccaaggatgccttgcacatgaccttattgagaaggtagaggttgaggttaagagactgaagcatttgaaagctagtaaaatgaaagagcttgtcttgaagaaaatgactgagcttgaagaaatctacagaagtgttcacatggatattgatagcgatcatgagtggcggattctcaccgaacttattgattctggtagagcagatctctcagagctgcttacggatatggatgaccgaattacagaagcaagagatcttgctctaagcagaaaggacattctagaaaaggtggaaaaatggacattagcaactgaagaggagggttggctcggtgaatatgagggggatcaaaatcgctataatgctggtcgaggagctcacataaatctcaagcgtgcggagaaggcaagggtattggtcagcaaaattccatccctgctggagaatttgactgctaaagttagagcttgggaaaaggagaagggcgcgccatttctgtataataagatgaggcttttggatagcttggacaaatacacctctgaaaggcaacaaaaggaagaggaaaaacgccgatcacgggaacttaagaaactacaagagcagtttgcagcagaacaaggtgcaacctatggagcgaagcctagtcctatgcgcccgctttcggcaaggaaacctcttgggcagagtactaatgtcaacattgttggtggaactcctaacaaccggcgtgtgtctaccccaatttcacgcaagggaggcttgtcttgtggaaagatgaaggacactggcaagacagctgcttctataccggcaaattatgtttctcttcccaaggattgctccgacaattcttgcatgtgaaaatgtaatcacccatccgacaagttggtctctagcttgtaatttcatacgtttgatctgatataggtttaactgcttgttaatgcttgaattgttgatcttaacttctgatgcaaaacctgtgctgctttcagctttctgcagaatagcaatttgatccatgtctcagatatttgcgcacaaggagctttctgttttatatgatattcattatatatagctatttgcccacagt

SEQ ID NO: 85 - DNA, 1867 bp, Setaria italica
ctccccgtccccccacgcacaaaggcgacgcaagcagcgttgctttcctttcctctccctgctctgcctcgccgcttccccccctcccctgcctgcctcagcgattcttccgcttttcctttttcaaatcgccatttcctcgtgcgcgtgtcgactccgtcgtgctcagctgccgggttcgggaggacgccgcctcggatgaggccgcgctgaccggagccggatcattcgcccacccatggcgcggccgcagcgagtgtacgaggcttggaaagggaacaataaattcctctttggtgggaggctcatattcggacctgacgccaagtccctgatcctgtctgtttcgctcatcgtggtcccggtgctggtattctgcgcgtttgttgctcggcatctccgccaccatttctcggcgtacaatgcgggatatgccattcctgcggtagcgttagtgtttatgatctatgtgcttgtgctgctcttgattacttcagcccaggatcctgggattgtgcctcgcgcagcacacccaccggaggaagagttctcgtatgggaatgcattgtctgggggcacgcctgggaggctgcagttcccccgtgtaaaggaagtaatggttaatgggatgcttgtgaaagtgaagtattgcgatacctgcatgatttacaggccccctcggtgttcacactgttcaatatgcaacaattgcgtggagcgctttgatcatcattgcccctgggttggacagtgcattggacagcgcaattaccggtactttttcatgtttgtttcttcctcgactcttctctgcatttatgtatttgcaatgtcagccttgtacatcaagtttctcatggatgagggttatccaacagtatggaaggctttcaaacactctccagcttctttggggcttttgatatattgtttcattgctctctggtttgttggtggacttactggatttcatctgtacctcattagcactaaccagaccacgtacgagaattttcgatacagatcagacagcaggcctaatatctataatcaaggatgcctgaataacttcctagaagtcttctgtagcaagacaaaaccttctaaacacaagttccgagcctatgcacaagaggaagtgcgacctccaacagttagctttggtagggaggtcgaagaggaaccagttggtggtcctcggtcgaaagttgaagatgatcttgaaattggtagcgatcttttgaagatctctcagcggcgaaattatgaggacgttgatgtagaaatgggaggtcgtcgcagcaatgagatggaaggaatggccagtgggaaactagtaataggttcagaatcacatattcctgcagttgggagtgatgtacgggtacgacactcaagctgggatcggcgaagtgggaactgggacatgtcatcagatgtacttacaagaagtgcatcagatgtaattgaacgtagtgtgtttgccaccgaggctgcacatccatctcaagcagaaactcacaagtgaattatttgtgcattcagagcatgtgtgggaaatttggattgcaaggccgtttaactcatggtggcacacccagacagcaaggaagaaaacgcccatcatgcattttgactttgactgccttgattggtttttttttcctgatcctcatcatgtatgaacaattatttagtcaaagaattagccccattggtgtcatatattcgtgtgtttgtgccatagtcttatctgacattgcctgtaaattgcaaatgcaaatccaattgcaattcttctttggctatttctttgagaatgcttaatgtcataacgtgcatctcacctagcccttaccatcatctt

SEQ ID NO: 86 - DNA, 2112 bp, Setaria italica
tcgcgcactcccaccccgcccgcgccccaacacacacgcccacacctcccccacagcccgcacccctcgccggcggccgcattgcccctgccctgccctgcccccagcccggacggacggaccgagcgatggacgcggcggcggggacggcggcggcgctgccggaggcgtggtcgcaggtgcgcgcgccggtgatcgtaccgctgctgcgcctggccgtggccgtctgcctcaccatgtccgtgctgctcttcctcgagcggatgtacatggccgtcgtcatcgccgtggtgcgcctcctccgcctccgccccgagcgccggtaccgctgcgagccgctccccgaggacgaccccgagctcggctcctccgcgttcccctccgtgctcgtccagatccccatgttcaacgagcgcgaggtgtaccagctgtcgatcggcgcggtgtgcgggctgtcgtggccgtcggaccggctggtggtccaggtgctcgacgactccacggacgaagtgattaaggaaatggtgcggatggagtgcgagcggtgggcgcggaaggggatcaacatcacgtaccagatccgcgacgaccggagggggtacaaggcgggggcgctcaaggccgggatgaagcacgcgtacgtgcgggagtgcgagtacgtggccatcttcgacgccgacttccagcccgacccggacttcctcaagcgcaccatcccctacctcgtgcacaacccggagatcgcactcgtccaggcgcgatggagattcgtgaacgcggacgagtgcctgatgacgaggatgcaggagatgtccctggactaccacttcacggtggagcaggaagtgagctcctccgtctgcgccttcttcggcttcaacggaaccgctggcgtgtggcgcattgccgcagttaatgaggccggagggtggaaggacaggaccacagtggaggacatggaccttgctattcgggcaagcctcaagggttggaagtttgtctacctcggtgatgttcaggtaaaaagtgagctgccgagcaccttcaaggctttccggttccagcagcacaggtggtcgtgcgggcccgcaaacctgttcaggaaaatgctcatggagattgtgacaaataagaaagtgacgatctggaagaagatccatgtcatctacaactttttcttgatacgcaagattattgcacatattattacattttcattctactgcctcatcatcccggcaacgatcttcgtccccgaggtccgcatacctaagtggggctgtgtctacattccctcggccatcacccttctcaattctgttggcactcccaggtcctttcacttgcttttcttctgggtcgcctttgagaatgtcatgtctcttcacagaacaaaagccacattgatcggcttgttagaggctggcagggccaacgaatgggtcgtgacagctaagctcggcagcgctatgaagatgaaatcagctaataaaggaggactcaagaaacagttcatgaggatatgggagaggctgcacattacggagctcggtgtgggaaccttcctcttctcctgcggatggtatgatctcgcgtatgggagggaccatttttacatctacctcttcttccagtccatagctttcttcattatcggttttggctacgttggcacaatcgtcccgcagtcgtaacagaagtgttcagatcatccgcctccggcttctgcattgtcttcagcaagtttcgtagtggataaccagtttgaagtaaagatcataaggtcctctctctcatcgtctttttggggaccggtcatgtagccttccgttgcatgcgctactgtaaaataggaactgcagtgttgtaagatcactgcaggaaaatttagagattggtgccgtatgggcaggaaatgttgtggtgtttttgcttatatattatagcaagtacgtgatgtgtttcaaggggcgcaggatggcttcttccaatgtactagtaacatacagaaaaaagaggttcagacatgtgttgagaaaaatcaagtgttcatgcttctcctgtacggccctacatttcacacgtgctgaatatacagtcctctcttgtggg

SEQ ID NO: 87 - DNA, 2351 bp, Setaria italica
cggcttgtggcggccggccggctggttgggccttgtccgtggctaatttggtcagagattcgaggatcccgggcggaagccccgccgttggtgaggattggatcctggatttgaggtttccggacgctaggatcacggcttgctgctgcggcggcggggtgacagatccctcttgctgtccgcggcctgcagagcaggaggcaggagctatgagacaatgacagaggagagcgccaagaagagcaagctttcgtggtccaagtccctcgtgaggaagtggttcaacatccggcccaaggcgcaggacttccatgctgattccgacgccggccagggaagggatggaggtggtggatcatggaggcccaggtgctccgcgagcgaagcaagtgcaagcacggccaagaaaagcagaactgaccggtcatcatccaagcggagtgccgaacgcgctcgccgagggaagaataatttcgatgtagcacgcctgactgaagtccaagattacaggatctttgctgcgacgtggaatgtcggtggtaagtcaccaccaagggggctgaatttagatgaatggctccatacctctcctcctgccgatatctatgtactagggtttcaggagattgttcccttgaatgctggaaacgttcttggcactgaagataaccttccagccaagaaatgggtgtcccttatcaggcgtacactgaacaagaatcctggagctagtggttgtggtggctatcataccccttcaccggtcctggatccagttgtagaattagatgctgattttgaggggtctgcgagaaggcaggagaattttcctttcttccaccggcggtcgttccacaacctcagccgtagtttaagaatggatggggactacatgttcccacagccaagactggatcgcaggtttagcgtttgcgatccagtcaacttgggaggcagacctagcgattttgatggaaatttgagatgccctggatcacctgatgaggagattatagatatggaagtgagcgatgctgcgcaattttcaccattccctcatagctacactgcatctgcaccttctgaacagaatgatgagcaatcaaacagctctaggtattgcttagttgccagcaaacaaatggttggcatatttctcacagtttgggtacgcaatgaaataagagacgatgtgagaaacttgaaagtttcttgtgtcggcagaggattgatgggctatcttgggaataagggttcaatttcaataagcatgtctttgcaccagacaagcttctgcttcatctgttgtcatttgacctcaggggaaaaggaaggtgatgaactgcgcaggaattccgatgttctggaaattttaaggaagaccagattccctcgggttcgtggttctggtgatgttaagtcacctgaaacaattcttgagcatgatcgtattatatggcttggggatttgaattatcggattgccctgtcgtactgttcggcaaaagctcttgtggaaatgcataactggaagcaattattggagaaagatcagctccgcatgcaacaaaggtatggacgagttttccaaggttggaaagaaggaaggatatattttcctcccacatacaaatattcattcaactcagatcggtatgctggagagggtatgcaccccaaagaaaagaggagaacaccagcatggtgtgatcggattctctggtatggtaacggcctcaatcagctgtcttatgttcgtggagaatctcgtttctccgaccataggccggtgtacagtattttcttggcagaggttgacattgtacaccagaggaggagaaacatgggctatttcagttctagaattgaggtggaagagctcttgccgcattctcagagctacagagaaataaagttttactgagttgacttatagcatgatgtaaggttaggaggttggtcaaatgttctatatgtagggttccagattcagctcactagatgatcagatatactgaagaaagaatgtgcaaatactaacataaaaggacattgggcaattttgctgcttgccatcggaagacgacgaagcttgtgtcgttggaaaaggatcagcccatgtcactaactatacacttcatccaactttaggctcttagttcctcctagcaaaatattttgtttcaccctcttttttcagttggaccttggaatgtcaacaaacgccgaatgttaatttcttcacctctttctttttctttttctttaagcttagaaactttgtaaaactcagcagtgtgtcccatgcaagttgtggaattgttttaaggcaatgataccgggaattagct

SEQ ID NO: 88 - DNA, 2830 bp, Setaria italica
cccactcccactcccactcctcactctctctcactggagtggggaagaagtggggaacacgagctgagacaagaggggggaggagagggagatcggagcaagtaagacagggctcaccgatctcgggccgggatggggtgcacggcgtccaaggtggagcaggaggacacggtgcggcgatgcaaggagcgccgccgccacatgaaggacgcggtggcggcgcgccagctgctggcctccgcgcacgccgactacctccgctccctccgggtcaccgccgccgcgctctcgcgcttcgcccagggccacccctcgctcgccgtctcccaccacaccgcccccgtcctcctctccgccgccgcgccgcccccggcccccggcgccgcccacgcgctccccacgccggcgccgtccaccgccgcgtcgtcctcgctcccgcccccgacgccgctcgcccagcacccgcacccgccgccgccgccgccgcagcagcagccgcagccagcggcggcgatggcggcgccgcagcctgcgccggtgagggctccacgcccgcggcggctcagggtgccgcacatcctgtcggactcaagcgtggccagccctgcgcagtcgtccttccgcaagcagccgccggtggggacgccctcctcctcctccgcgtgggagtgggagaacttctacccgccgtcgccgccggactccgagttcttcgaccgccgcaaggccgagctcgaggaggctaaccgcctccgcgagttcgaggaggaggagaaggcccggacctacctccaccaccaccacccctacaacctcaaggaagaagacgaggtcgacgacgacgacgatggcgaggtggaccacgaaccagaggggatgcactgcggcggatgggaggacgacgacgagcattacgcgtccacgaccacgtcggagaccagatcggaggagggagagatggggaatagatcggaatgcgggttcgccgccagatcggagtgcgggtacgtggccagatcggagtacggcgggacggcaccctcggagtacgccgccgtaccattgtctctgaggagggatgagaggtcggaggctggcgactcctcctccacggtcacggcggcgaccgagatgcggatggtggtgcgacatcgcactctcgccgaaatcgtggcggccattgaggaatacttcgtcagggcggcggacgccggcaacgatgtgtccgagctccttgaggccagccgcgcacagctcgaccgcaacttcaggcagctcaaaaagacggtgtaccactccaacagtgtgctatccgcattgtcatcaacatggacgtcaaagccaccattggctgtacgatacaagttggacaccaatgcgctggagatggagtcgacggaagggaagagccatggatccactctggaacgtcttttggcttgggagaagaagctctacgaggaggtcaaggcaagggagagtgtgaagattgagcatgagaaaaagctatctactctacagagcctggaatatagagggagggatagttcaaagctggacaagaccaaggcctctataaacaagctgcaatctctgatcgtagttacatcacaggctgccaccactacatcctctgcaattgttagagtccgtgacaatgagcttgcaccacagcttgttcagctttgttttgcgctattgggtatgtggcggtcaatgaatcatttccatgagattcagaatgagattgttcagcaagtctgcggtctggtggacaactccatggctgagtcaacatctgaccttcacaggcttgcaactcgtgatcttgaggctgctgttgcggcatggcactcaaacttcaaccgccttatcaagtatcaacgtgactacatccgtgctttatacggctggctgaagctcacactctgccaagtggataacagcgccccacaagaggcccatgcctcgatgatctcgcgtgaactcaccagcttctgtgacgagtggaagcaagcgctagaccggcttccggatgctgtggcttcagaggctatcaagagcttcgtgaatgttgtccatgtcatctacactaagcaggcagaggagatgaagatcaagaagcgggcagagacgtattcaaaggagctagaaaagaaaaccaactcgctcaggtccatcgagaagaagtactaccaatcctactcgatggttggcctcggccttcctggcagcgggcgcgatggcattgagacccacgcgtatgatgcccgtgatcctcttgcggagaagaaaactgagatcgcccaatgccgtcggaaggtggaggatgagatgacaaggcacgctaaggccgtcgaggtcacccgatcaatgacgctgaacaacatacagacaggcctgccaggaatattccaagccatagctggtttctcagcgacagtggtcgaagccctggatgttgtgtgccgccgagctggatcggtgcggtagaagcccacgccaccatcagaaattcagaattaccaagagaccatttgcgcgcctctcttttcttggtgattcagtagtttcattttatagggaaagtgcaatatatatatatagctcaaattagtgatgagatatagttgaaggctccctggatgttttgccgcctcaggatcgttttcggttgtagataatgtgattttgcccaggatttgttgggttgggtctcgtctcgccccttttccgcgaagtgcgaggggatatataatgtacagacattgtggtcaccttgcactctaatgttgaatcaagcctgtgcttctagccttctatctaacaa

SEQ ID NO: 89 - DNA, 1964 bp, Setaria italica
ctccgctcccgggccccacccgtcagcgactctccgggttagccgttgcatgcgcccccacgcgatgacgtcacctcccgttcaaatttcaaaatttccgaccgttacccccttcccccgtctccctcctataaagtcaagtcaaaccaatggagtcagaatatcagatcaccgacaaggccatctgcaccaccgtctcccccggctctccttcccccttcgccctctcctccggctcgagatcccccacccatggcgaccgccgcggcagggagcaagaggggcggcggccggggccgcaaggcgctcgtggccgtgctcgacaacgacgccaacatctccgccgggaaggccgccaaggccggggacctctcggcctcctccgcgccgaaggcgaagcgggcgcccgccaggagcggcaaggccgccaaggccgcggcggctgcggcctccgtagtggacgacgtggcggagctccaggggatgctggagcggctgcggctggagaaggagaaagcggaggagatggtgagggagcgggacgaggtcatccggaagaaggaggaggagatcgagaccaaggagaaggagcaggagcgcctccaggccgagctcaggaaggtgcagcgcgccaaggagttcaagcccaccgtgagctttcctctcgtcaagtcgctgcttgagaaggagcaggacgcaggcgacaagggcaagaggaagaaggggaagggcaaggccgtcccggagaggaagaagccctgcacggcgtacgtgctctggttgaaggaccagtggaccgagatcaagaaggagaaccctgaggccgacttcaaggaggtgaccaacacgctgggcgccaagtggaaggcgctgggcgccgaggagaagcagccctacgaggagcggtaccggcaggagaaggaggcctacctccaggtggtcggccaggagaagcgcgaggctgaggccatgaagctgctcgaggagcagcagatgcagtggaccgccaaggagctgctggagcagtacctcaagttcaggcaggaggccgaggagggcgacggcaagaaggggaagaggaagaacagcaagaaggtcaaggaccccgccaagcccaagcagcccatgtcggcctacttcgtgtacacgcaggagaggcgcgccgcactggtcgctgagaagaagaacgttcctgagattggcaagatcactggggaggagtggaagaacatgacagaagcccagaaggctccctacgaggaagttgcgaagaagcagaaggaggagtaccacaagcagatgggggtttacaagaagaagaagattgaggaagctgcgagcctggagaaagaagaggaggagcagaagaaaatcatgaagcaagaggctctccagctgcttaagaaaaaggagaaggcagacaacatcatcaagaaaaccaaagaaaagcgccagaagaagaagcaggagaatgttgatcccagcaggcccaagaagcctgcctcttccttcctcctcttcagcaaggaagcgaggaagcagctactcgaggagcgcccgggcatcaacaactcgaccctgaatgcacttatctcggtgaagtggaaggagctgagcggtgaggagcggcaggcgtggaatgataaggccgcacctgccatggcggcatacaagaaggagatggaggagtacaccaaggctcacagctcgtccgcttgacaggataacagattcatgtgcacgttgtggtgcagttcaactgttggattgggttgaacattttcaaataaggattctcatctctgaatcctggtgtgatagatgacttggtgtgaattgttaacttcggatcagtttagttggcgtagttgtattagatgtagcttgcttcattcttgaacaaattggtttggttaaattttgtggcagttttccacaagttaagaagtttcagtgagtttcac

SEQ ID NO: 90 - DNA, 2753 bp, Setaria italica
ctcccggctcggacgcagtgcagcgggtcagcggaggagcggatagcagcgccggagatggacacgcccgaccgtgccgccgcgcagcccgcggcctcgcgcgccgaggactcgccagttttcagcttcatcaacaacctgtctccgattgagcctctcaagtcggcctacaacgccaatagcctccagggataccagtccatcaacataacctccatttcctccatcttcacttccccgcatgacaatgcgcacaaggaaccaaggctcccgaagagctctcttggtgaaatttctgaaagtgaggtctgtgctgacggcaagaatacaaacaagccaactaagtctacaaatgctgtcaggttgtttgcctgcactagcactgtcactcaagaaacccacacggttacatgttcagatgtggttgatcctcccaccgtgccatgcaatttggctcagcctgctcagttcgataacggcagtccagatcataacaccactccctgccatggtgtcagatcagaccttaagcaggacaaatgccggaaactagatgttgtccaaaccgttaaaagtacagtggagaaaaggaaatgcttgttttccactgaaatccagctcctggatggtggccagcctgtgaatgacaacaatgaagtcttgggatgtgaatggtcggacttaatcgccacaacctcgggtgagcttttggcctttgactccactatggatgaccatcatagaggaatgcacctggcggctaaaaatgcggaatcttgtggatacttgctgtcaaaacttgcaggagatggtgaaatttcagagagagcatatcctaatgcatctggtcaagtatactatcaagaactcgtgatgggagaagaccagacagaaaatgcccaaatatttcaggatggccaacaaacaatctcgactgaagaaattcaggataatatttatgaagcaaatggatgtattccattagactacaaggtggagagccaacaacaacgtggcgtacgaagacgctgcctggtattcgaggcagctgggttttcaaatagtgttgtgcagaaagagagtgttgaggatctctctgtctcaacatgtaaaggcaaaggccatgtgcaaactcagccccgtggattgcgtggtataggtctacatttaaatgcccttgcattaacaccaaaagggaaaatggcctgtcaggatcctatggcttctgctttgcttccgtcatcagcatctgaaaaggatgcgcatggcaaattgctctgtgcaggagagaattttacacactcaggtggtgagctgttagaatttcccatggatgattgttcatctggaggttttcctttaaatgatcatgtttcaagtcaaagtgtcagccctcaaaagaagagacgtaaaacagataatggtgatgatggtgaggcatgcaagcgatgcagctgtaagaagtcaaagtgcctgaaactttattgtgagtgctttgctgctggtgtatactgctctgaaccttgttcatgtcaaggatgtctgaacaaacccatacatgaggaaattgttctctccactcggaagcagatagagtttcgtaatccactagcatttgctccaaaagtgattcgtatgtctgatgctagtctggaaactggggaagatccgaacaatactccagcttcagctcgtcacaagagaggatgcaattgcaagaagtcaagctgtcttaagaaatactgtgaatgttatcagggaggtgttggatgctccagcaactgcagatgtgagagttgcaaaaacacttttggcagaagagatgctgagactgaactcactgaagaaatgaaacaagaaggtgaacaaacagaaaacagtggaaaagaaaaggagaatgatcaacaaaaagcaaatgtacagagtgaagatcatcctctcgttgagcttgtcccgataacacctccttttgatctttccagttctctgctcaaactgccaaatttctcaagtgcaaagccaccaagaccttccaaagctcgcagtggaagctcccgttcgtctgcttcaaaagctaccacaacattgcagtcttgtaaatcatccaaggctgcaggtagtggtatcgatgaggagatgccggatattctaaaagaagctgattctcctagccgtgtcaagactacttcacccaacagaaaacgagtctcgccaccgcataatgcactcagtatttccccgaaccggaaaggtggcaggaagttaatattgaagtcaatcccctcatttccatcacttacgggagactcaaacagtggttctgcaatgaacaacaccgataacacattcagcgcatcgcctctcgctttaggaccatcttaaagctgtgaagtcgaatatgggaccggagtacgacttgtagtccgcatatatgcctcacttcctacgccgcctgcaccaggctcgaggtaccgtcagagaatagtaggttagatttaagctgtagtgatctgtatttgtaaaatatgtagcctctcaataatctgtatgtaagatgctgtgttcgcttgtagctgttatttttattgaattgtagcaacactataaatcacctcttgaggaggtttccacaattccattccatgtttttagtcgcaaactctccttgagtctgaagccaacccctattactgaacaaaataaactctatcaggcagctcatgtgtgagcgtgacatctgttcaggctgggcc

SEQ ID NO: 91 - DNA, 2917 bp, Setaria italica
ctggaaacagaagtgcgtgtcctcccagtctcccattggcactgacacgatagaatcataagatgctgtcaagctgccgtcgaccagcgacctcgctgctgctgctgctgcgctagttcacctcgccgtgatggcgcccaaccaccggctccccctccgcctcgccgtggttctccttcttctcctgcttctccccgcggcctcccgcgccagggacaccatctcgccgggccagccgctccggggcaacgacaccctcgtctcctcgggcaccggcaccttcgcgctcggcttcttctccccgccgggctccaacaacacctacgtcggcgtctggtacgccaagctgcccgtccgcaccgtcgtctgggtcgccaaccgcgccgaccctgtccccggcgcggtgtcgcacaacgccgatgccacgctctccgtgtccgccggctgcgcgctcgccgttgcggacgccaacggcaccgcggtgtggtcgtcgccggccccgccgcccgacacggcggggaggccgtgcacggcgcggatccgcgacgacggcaacctggtggtgtcggacgggcgcgggcgcgtggcgtggcagggattcgaccaccccaccgacacgctcctcccggggatgcgcctcggagtggacttcgcggcggggaagaacatgaccctgacggcgtgggtgagcccctccgacccgtcgccgggccccgtcgtggcggcgatggacacgtcgggggacccggaggtgttcgtctggaacgggcccgacaaggtgtggcgctccggcccctgggacggcgtgcagttcacgggcgtccccgacaccatcacctacaagcccctgggcttcagcttccgcttcgtcaacaccccccaggaggtcacctacagcttccaggtccgcgacgccagcatcgtgacgcggctggcgctcaacggcacgggcggcgccgccgggctgatgcagcggtggacgtggctggagaccgccggcgcgtggagcctctactggtacgcgcccaaggaccagtgcgacgccgtgtcgccgtgcgggcccaacggggtgtgcgacaccagcagcgtgcccccctgccggtgcctccaagggttcgcgccacggtcgccggtgacgtgggcgctccgggacgggcgggacgggtgcgcccgggcgacgccgctggactgcggcaaccgcaccgacggcttcgcggtgctcccgcacgccaaggtgcccgacacgacggaggcggtggtggactacgggtccagcctggagcagtgccggcagcggtgcctgaggaactgctcctgcacggcgtacgccagcgccaacctcaccggcgggccgggccgccgcgggtgcgtcatgtggaccggcgggctcgacgacctccgcgtgtacccgggctacggccaggacctctacttccggctcgccgccgccgacctcgctccaacaagcaagtcaaagaagaaggtcaatattgtgattgcagttgttgtcagcataactgcactggcaattcttctagcagtcgcagggtttttcatttggaaagcaaagaaaaccaaagcaagaaaaccaggatcaagcacatggagagctggtccacgcagtaaggaggggagtgaaggaaaggatcatggggatgatctggagctgccagtatacgattatgagacaatagcaaaagccacagaggatttctcaactgagaacaagcttggtgaaggcggtttcgggcctgtatacaagggcaagcttgaggatggacaagaaatagctgttaagacactttcaagaacatcaacacagggtcttgaggaattcaagaatgagattttgttgatagctaaactccagcatcggaatcttgttcgattgattgggtgcagcatttctggacccgaaaagatacttatatatgaatacatggaaaacaaaagcttggactgctttctgtttgacacaaccaagagcaaactacttgactggcaaacacgatatcatataattgaggggatcgcccgaggtttactgtatcttcaccaggactcgagatatagaatcatccacagagacctcaagacgagcaatattcttctggatgaggagatgactcctaaaatttcagacttcggcatggctagaatgtttggcaatgacgatacagaaatcaatactctcagagtagttggtacatatggttatatggctcctgagtacgcaatggatggagtgttctcggtgaaatcagatgtatttagctttggtgtcatagtgctggaaatcattactggtataaggaaccgaggtgtctacagctactctggccacctcaaccttctagcacatgcctggagcttgctgaatgaggggaagggcctagatttagtcgatgaaaatctggatggctccttcgattcagatgaagtgcttaaatgcctcaaagtagggcttctatgtgtgcaagagaaccccgacgaccgtcccctgatgtcccaggtgctgatgatgttggccagcactgacactgcctcgttgccaactcccaagcagccgggcttcgctgcaagaacagctgctgccgaagacaggtcgtggagcaagcccgactgcagcattgtcgacagcatgaccatcaccatggttgagggtcggtaggaggctgggtctcctacttatcatagcacgagatgagatgtatatcttagagtactagagtggcattggttcctttgctatcttgttcggcgaatgcaggaaatgcagggtattatagttttgtggattgtgtgtttacttttaggaacaaatatagtgtgcaaaagatgtataattggtcctagtatagagtgaaaagaattctagagattttagatcaaactgaatgggtgaacagaccttgca

SEQ ID NO: 92 - DNA, 2178 bp, Setaria italica
acacgccagggcgcctgcgaaacaccagcagtgtagcgcagcgagcacgagtttggtttggtggcgcgcctttactgccgcccgcccaacccaacactatcccagggcggattttaattgcccccccgccagcctccctccctcgctgccttcggatgccgctctgcggcgcaagcgtgccgccccaagtaatgcagtgaccttgaccgagcgagcgagcgggcgagcgaccgacgacgcagctgcgcgccaccgccccgcgactcgatgggcgagaggaggcggcgcgggagcgccacagctgctgctgctcccggagctgctgctgctgctgcgcgggctgaggaggagaaggccgcgtcggcggcggcggcggggaaggctccgccgccgacggtgtggttcgcgctgaagcggtcgctacactgccgctccgagccatcggatgtccacgtgccgcgggccaaggccggtcccgccgcggtcggcggcggcggcgggaacctgtcgtcgatcgtgaccaagcgcgcggccccgcggtcgggctgctcgcgctccatcgccaacctgcgggacgtcatccacgggagcaagcgccacccggggcagccgccaagctgcagcccgcggtccatcggcagcagcgagttcctcaaccccatcgcgcacgaggtcgtgctcagcaccaactcccgctgcgagctcaagatcaccggcttcggcggatgcggggggctcggcgccgtcgggaccgccgccgcgcacgacgccgacggcggcgggggatctgacggcggcgtcgtgtcgtccttcgtcggcacgctccgccccggcacgccgggacccgcgtgggccggccacggactgccgtacagcggctccatgcggggcggcgtgcgctgcacgccgccgaggtccccgaacgtgctgctggagcggaacggctccctggcggtcggccaccgcgcgtcctgcgaggacaccgccaaggccggcgccggcaagggctccggcgggctcagctgccaccggtgcggcgagcacttcggcaagtgggaggccctggaggcgcaccacctctccaagcatgcagtgacggagctggtggaaggcgactcgtcgcggaagatcgtggagatcatctgccggacgagcctgctcaagtcggagagcagctgcgtgcggatcgagcgggtgttcaaggtgcacaacacgcagcggacgctgtcccgcttcgaggagtaccgcgaggccgtgaagctcaaggccagcaagctgcccaagaagcacccgcgctgcctcgccgacggcaacgagctgctgcgcttccacggcgccacgctctcgtgcgcgctcggcgccggctccggcgcctccagcagcctctgcgcctccgacaggtgcgccgtgtgccgcatcatccggcacggcttctccgccaggaaggaaggcaaggccggcgtgggcgtgttcaccacctccaccagcggccgcgcgttcgagtccatcgaggcgccgccccccgcctcctgcggcgacgacggggcggacccggccgccgcgccgcgcaaggcgctgctggtgtgcagggtcatcgcggggcgggtgcacaagccactggagaacctgagggagttcgcggggcagacgggcttcgactcgctcgccggcaaggtcgggccctactccaacatcgaggagctgtacctgctgaacccgagggcgctgctcccgtgcttcgtggtcatctgcaaaccgtagtagcatggcagagctagagacaccacaccatctcatctcattgttactagtaattaaccattcttttttcctttgttatgttctgctctttgtcgtgcgtctcggttgctactctgttgccgtttgtttcagctaacagctagtagtagtataacactgtgggctatgcgtgcatgccttcatgtgctcgtgggcatcgtcttcagagttcagagcagctaagcagacggcatcgaaccagtcgtgctctgcctcaagcagagtatacagttcatcttcagacttcagatcactcactttgacaaccggcatggtcgtctctcaatagactagtacccggtaggttacaaaacaacttcgcgttcaaactttgtagcaccaacccctgctccgttgaatggtcgttgggtacagcca

SEQ ID NO: 93 - DNA, 3678 bp, Setaria italica
ctccaacgtctctcctcctaccccgccgccgtcgcctccattacccctcgccgcctttgaattccaccccccccctcccccactcccgaggctcgaatcagagatccgccccccttctctcaccgtcctcaccaccgcaacacggagaggttgagggagatgcaacacgacatggcggaggtggacggggacgccccgatcccggcgttcgcggtgtccaagggcggcgtcgtgctcaagcacatcttcctcaacgcgcccccttcgtcgccggatcgcggcggggcggtgggtggcggggaggagcaggaggaggaggaggacccgccggtgacggtggggcggcaccccgactgccacgtgctcgtcgaccaccccagcgtcagccgcttccacctccagctccgggcccgccgccgccagcgccgaatcaccgtcaccgacctccgctccgtgcacgggacatgggtgtccgggcggcggatcccaccccacacgccggtggatctggtcaacggtgacacgctgcggctcggggcctcgaagagggagtacaggctgctctggctgtcgctgcgcgaggcgcttgagatggaggatgcgccgtacatgccgccactgcctgaggacaaagaggagccacatgcttatcaggaggccagcagccagttggtggctcctgagcagagggagtcagcagacatggaggcccatcaggagacaagtcaacaaattatattagaagatattgattttccagccaaagtgatcccctcagcaccaccattacctgactttgctcattccttttctgtggaaaaatcccatgagaacattgagggagtgacagaggatatgttagtcgacaagaatccaatttcagaatcttttggctctttgatcatacaggaaatgccagctgcattgacaaatgctggaagaccagccctgtcagacaagcgggatacatcaaaccaagtgtccaagagatccaagttaaagtcagtcaaatcacttcgtattgacactggcaggagcaaggatagaagcagtgcactgaactacagctctcagaaaggagaccaaaatgagattcttgtatgttctcagagctgtggggtggagtgcgctgcctgcatagctttgtttggtatttctgaatttgaaagagctgaagaaaaggaagagatgattgcagaagataagggccatatgcatcccccagccagcattaccatggagggagataagaaagagccaaacactgagaattatggcccacaagattcagttgattcaaagttacagaagaggataggcttgtttgattctgctctccctttgtttggcttgtttgattctgctttccctttgcatttcaaagatgatgccttcacagacaaagaaattccacagtggagttctgctactgttaatacagaatctgatcctgtttcagaaaatcttgcaacaccagaactgaagcatgatgactttgtccatcttaacttggaggaaagtttctcaaataaggagaacatggccccaaataagattgttgagggtcctgagaactatcagcttgacagcacagtttgtgggaatttatttgacaatttggatactgaagaaatcgaaggaaatgaagagatctgtccactggacaaggagaatatcacccccaatctatcaggtagcataattatggagaggagccatataggtctgaagcctatcatttcccaagagttgatggattccatttcccctctgaatttagctcacgacaacttttcggaaaatgaaaagtccattctgaacactggaaatcagatgaaatcaaatgaacctatctctgagaatcttagtccgctaactccagctgataaaaaattgcagaagagccagatagagtgtatgcccatttcacatctggaattcaaagatgacatccttctggatagggaaaactcagtgctggcacctggaaagtatgatgccatctcccctgagaggcaggaaaatctgtcctcagacaaagagaacgtgactcctgcttctaaggtaaagcccactgttaggagagttcttggttcaaggatggataattcagtgtcagcaaagaagacttcaaataaggagaaatgcattgtgttgtcagcaaagtccgaaagaatccacacaatagattatgatgttttctattcagataaggagaatttgacccctgtgtcttcaggaggcatgaaagcaaggaagtgtcttcccaagaatctcatagttgatgcagatcaagaccaggaagcattctgctctgacaaggagaacatgacaccacaatcttctgcagctcggaaaacaagggatatgtctgaaaaccgtgcacgagtagaaagtgcaatcacaaagaaaagggttgctgataggctccccttccagacccttctttcgaattctcctttggggccggctagctcgcttgattgtaactgtgttgttcctaggacagctgacatcgctgctggtgacttggcgatcaagttggaagataaacttaacaatcttgcacttcataagcaagaatcaggtagggctggacaatggatgaaatcctggaccatggtggctaacaccgacagccttcttgatgatgaatctaggaagtctattatgctgttaaaaggcataaaaggaactcacctgttcgtaccaaggattgtgatcagggagctagattccatgaagcagcgggagggcctgttcagacggtccacaaaggcgacctccgtactccaatggattgaggagtgcatggcgaccgagagctggtggatccacgtccagagctcatctgaaatgctcccagtcgcgccaaccccgcctgccaccccttcagcgcagcgcatcgacgaagaaatcaaggttggttcagctggctccttcaacccaatggcagccttgttctccccgagaggctttgagctcgcggacatcgtctccccaaaacctgaggaccgcgtcctcgactgcgcgctactgttgaacaagctcaggagcgaccacaacgtcgtggtcctgaccaacagcgtggcgctcaagatcaaagccatggcagagggcatggtttgcgagggggcgagggagttccgcgagtccctgatgaacccttgctcgagccggttcatgtgggcggcgagcgcgccgcgggggccggcctggtcgcgcctggacgcggcggcgctggcggaggactactacaacagccaccaccaccagcacggcgctcggaagcagcagcagcagcagaggaagcccgccgaggccgccgccaagggcctgaagctgatcctgcgtcacaactcgctgtacgcgcaggcgacgacggacgcggccaggatgacaccgctgccgctggtctccttggcctcggtgtgagtgtgagactgtgagtgctgtcgatcagttccatggttctcgatggaagacgatgaggtttacagagtcgtgcatacgaagcttttgtttaccttgctataccgtggagagtcgcgggggtggtggtgaaattagcttttgcctgttgggtggtgacgtgaacgtttcgctggtatgatttccatgcccgtgcggggggtaaaaaaaaaactgtgggccgtgagagccgtgtaaagcttttga

SEQ ID NO: 94 - DNA, 2472 bp, Setaria italica
cgctgccggctgcagtgccacgccgccgcaagggattctctttctcggatctgggagcaaaaaccactgctgatcacaagcaagatttttaattggtggaagctgttagcagtagttggatttcgatgagtctactggtctctagtatattgcagtagggggtttgcagttctgtgggactcatgggctcttctccctccaaagccactggagaggatgccctggttctgtgcaaggatcggatgcgccatatcaggcgagccattgactcaagagatgcactgtcagcagcgcacttatcatatactcaatccctccgtgctgttgggacagcactgcgacggtatgctgagtctgagatctcaccagaatcatcgctctctatttcggaagtggataagtcaccgtcgcattcttctatggcatctccctcgccttcgcatgcagtagagaatgttgcctctccggtgcatcgagcaagtccattgactactccgccctcaacaagaatccattgcatgaaagcgtcaggaaccacacctttgacgttcatgattgatccatctgctgctgaatttgttgggcaagaatccccagtttcagcttttgtgccgcccccgccaccattacctccagaattatgtacttcatgggacttctttgatcccattgatgctgctggtagctcatcctccaacaatgagaatgggctaaccttgaacttcagtagattgaagggtttgagagagtcaagggaagctgaagtagtgccgctgaaagaagaagaagaagaagcagtcgtgtctgaaagaaggcatacagaacttcctgatggtaatgcagtgcctaagcaggaaagagagccaaaacaaagtgggatcagtaaacaaaggcaacctgtggatgcttcatcccaagctacttcctctcagcagattgctgcaaaggtggaggaaagcgaaatggaaaaagaattgtgtgcagagacagaagatccttcagagttcatcactcatcgagcaaaagattttgtggcaagcatgaaggacattgaaactcggtttatacgtgcagctgaagcagggaatgaggtttccagaatgcttgagaccaagaagatcagactggacatatgtcctaaaataccaggttctccaggcaagctaccaactgccccatttttgtcagcacttcgagtctgctgcaatcgtgatatcattctcaaccaggaaactgcacagcatgtctcaaaggttgtcacatggaagcgttctgtctcatctctatcgtcatcatctaagagtgcactcatgacatcgataattaaagacgacgtggatgacagtaatagtgattttgttgaggaatttgccatggtatctggaagccactcttctacattggacaggctacatgcatgggagagaaaactatatgatgaaatcaaggcaagtgaaaatgtgagaaagacctatgatgagaaatgtaacctcctccggcgccaatttgcacgagacctaaacgcgcagctgattgataagactagagctgttgtaaaggatctccattccagggtatctgttgcaattcaagctgttgatgcaatctccaaaagaattgagaagataagggatgaagaactggagccacagctcgttgagctgattcaagggctaatcagaatgtggaaatctatgttggaatgtcaccacaaacagttcatcacaatcacactggcataccatgtgaaaagctcaacctcggcgcagcaaggcgagcaccaccgccaggcggcgatgaatctgtggaacgagatggacagcttttcctccagcttcaggaactgggtcactgctcatcagtcgtatgtcgaggccctcaacgcatggctccagaaatgcgtcctgcagccaccccaagaccgacgcaggcgcaagcgcaaggtctcattccctccccgccaggccgtctccccaccaatattcgtcctatgcagagactggctcaccctgacggagtcactccccgccgaagagctatgcaagtccatcaaagatgtgatgcagctcctccgtgactcatttgaccaccaggatgaccagagcaagcccaaaagtgagtcacaggagtgcgggatgctggagaacaatgagcaggaggaggcaaagagcggaagtgtaccggcagctgaagggctgcagtcgagactgacgatggttcttgatcgcctgacgaagttctcggaggcatcactgaagtgctacgaggagctcaagcagaactacgagatagctcacgatgattacaagagagtcggaccaaatgctcaacttgcttagccctatgtggatggtggcatgtctttttcatatctgttctggatgacaaattctagtgttttggtatataatttgtggatgatcagattatagtacaatctttggcctaatatttagtgacaatctttatgcc

SEQ ID NO: 95 - DNA, 831 bp, Setaria italica
aacccaaccggccgaggaaaattttgcgcgagggagggtaaatatggcgggaaagtttggcgccacctgttcccgcgccgccgcctccctatttagcccgcgccaccgccgcctcctcttcccctcaactccaactcctcccagatttctccccttctcccaccgattgctcccgagaaccctctcgaccatcgccatgaccgctcccaacggcgccgccgacaccgacgccgtccacgagcctccccagaagatctccaagatcgcgcccctgctcaaggtgaagaagctctccgacaaggccgtcctgccgtcccgcggctccgccctcgccgccggctacgacctctcgagcgccgcggagatggtggtgccggcgcgggggaaggcgctggtgcccaccgacctcagcatcgccatcccggaaggcacctacgcgcgcgtcgcgccgaggtcgggcctggcgctgaagcactccatcgacgtgggcgccggcgtgatcgacgccgactaccgcggccccgtcggggtcatcctcttcaaccactcggatgtggacttcgccgtcaagcccggggaccggatcgcgcagatgatcatcgaggtgatagcgacgccggaagtcgcagaggtggaggacctcgatgccaccgtgcgtggcgagggagggtttggatccaccggcgtctgagccgtgacggcccacttcgctcgaaggagggatggtagtttcatcagtctctagattaggatggcgatgcaaccttggtgtctttagttggctggaagcgctcctgaagtcgtggtgttaagcgtgcgtttggttcaggg

SEQ ID NO: 96 - DNA, 1285 bp, Zea mays
cagagcagaaacttagccagagattcgtccaggataggggctgtatcgtagggagtagtcgttgcggagattgggtcgaagcggactggacaggagccgagcaaactatctgcagaagaggttaaagggttgccgtgcggactccggagctgtgagaatctaccccgaggtaagctcttagagtcgtagtcaaagaggagaagccaggccgggaacaaacagaaaagagaagagcaacaggagtacaggactcagtgcaccaagaataggaaagagcaaagaccataacagttaacttcaagatgcttgaagtgaggactgcaagaaggccggctctcgccgacatctctggtggtgggttctttatgaggacagtagaatcgccaggagctgtgctggtgaatggtgctgtcaagcggccggctcggcagtttctatcaccttcaagcaacaaggagaatgtgccaccagtgggagctttcagggctacaccaaagaggaggacccccttgcctgactggtacccgaggacaccactccgtgacatcacatcaatcgtcaaggcaattgagaggaggagaagtcgtctgcagaatgctgcagctcagcagcagatccagtggacagaagacccttcccgatctgtggatccaataactccagtacaggcagagcagggtggtgtgccaacaactgtggatggtcaaggtgttggaagccctgcaacctgtttggaggatggcaagctgaagacatcgtcctatccatcatctgactgctccttgcaggccactccatccaaaccaaacgatccagctctcgcagatctcgtggagaagaagctgtccagctcgatagagcagatcgagaagatggtgcggcgaaacctgaagagaacttcgaaggccgctcagccttccaagaggaccatccagaggcgcgtcctgatgtccatgcgatgagctgagaaagctatctgctctgccatggcttcccttgtctgctgctttcttagcagcaagtcgtaaccaaccattacgccagttttgcctgaaggaggggtggggccgtgggggctcctggttctctgcttgaggaccccggggtatgcggcttactactagctctctgcttgagggtacacattatggtgactgcgtatttttaatttgagaaattagtagttctatgtatagttttatagtgtggaacggatatgagaaattagtagcaattgtgacttcgacagcttgaatactgttgttatggagtagttcctctatac

SEQ ID NO: 97 - DNA, 1314 bp, Zea mays
aaactgacagactgtagcaataattggtcgctccccgatccatctgggtttcgcctgccagcggcgagatgtccttcttcttccgggccgcatcgcggcagcgcccgttgccgcaggagatcgcgcgctccctcaaggactccctcgttgccctcgacaccaagaccggcgccaaggctctcgaggatgctgagaaaaacatacttacattgaggcatacgcttgctggcgatggagaagtggaaccaaatcaagagcaggttttgcagatagcccttgagatttgcaaggagggtgttctttccctctttgttcagaatcttccttcattgggttgggaggctagaaaggatcttgtccactgctggtgtattttgttgagacagaaggttgatgaaagctattgttgtgtccagtatattgaaaatcattttgatcttttggatttccttgttgtttgctataagaacttggaagtcgcgttgaattgtgggaacatgttgcgagaatgcataaaatatcctacacttgcaaaatatatattggagtcaagcagcttcgagttgtttttccagtatgttgaattgtcaaacttcgatattgcatctgatgctctgaacactttcaaggatttgctaaccaaacatgaagatgccgtctctgaatttctgagctcacattatgaacagttttttggactctacacaaaacttttatcttcaactaattatgtgacacgaagacaatcagtgaagtttctttcagagtttctgttggaggccccaaatgctcaaataatgaagcgttacattttggaagttcattacttaaacattatgatgggcctgctaaaggattcaagcaaaaatatcaggatatgtgccttccacatttttaaggtatttgttgccaatccaaacaagcctcgtgagattattcaggttttggttgagaatcacagagaagtgttgaagctactccacaatctccccacaagcaaaggtgaagatgaacagcttgatgaggagagagatttaattatcaaagaaatcgagaagcttgtgcggttgtcagtataaaccctcaggaaattcgagcgtatccttgaagacatactgtgcaatatgctgccttgtatagagcttgtttttcatgtatggaaaaaaagtttggccacaaattgcattcttcacgagaacacttagcatttctgtcagaaaattattttcgtgtagcagaatttgcaacaggaataatctgcattatggtgtggtgttgataccattaaggattggtgaaagtgcctgccatttg

SEQ ID NO: 98 - DNA, 2250 bp, Oryza sativa
tgggttggtgcttggctagccacggtattattgcgtgaaagagggggaggtgaggacgtgaggtgaggtgaggtgaggcagagtgaccacagcgacggcagcgtagccatggcgaccaggccgggccctttgaccgaatggccgtggcataggctggggaacttcaagtacgtggtgatggcccccgtggtggcgcacggcgcgcgccgggtgatgcgcaacgggtggggcgacctcgacatcgccttctccctcatcctgccgtcgctgctgctgcggatgatccacaaccagatctggatcagcctctcccgctaccagaccgcccgcagcaagcaccgcatcgtcgaccgcggcatcgagttcgaccaggtcgaccgcgagcgaggctgggatgaccagatcctgttcaatgggttggtgttctacgcggggtacctggcgatgccgagcgtgaggcggatgccggtgtggaggacggacggcgccgtggtgacggcgctggtgcacacgggccccgtcgagttcctctactactggttccaccgcgcgctgcaccaccacttcctctactcccgctaccactcccaccaccacgcctccatcgtcaccgagcccatcacctctgttattcatccttttgctgaacatgtggtctatttcatactgtttgcaatccccatactgtcaacaatttatttgggaaatgtttcggccatgggcattgtggggtacattgcttacattgacttcatgaacaacatgggacactgcaattttgagttggtgccagagtggattttccaaatctttccaccccttaagtatctgatctacaccccatcgttccattctcttcatcatacgcagttccgcacaaactactcgctattcatgccattttatgactacatatataacaccatggacaagtcatctgatgagctgtatgaaagctcactgaaaggaacggaagaaacacctgaccttgttcatctcacgcatatgaccaacttgcaatcagcctatcatctaaggataggaattgcatccatagcctccaaaccgtacagtgactctgcgtggtacatgtggacgttatggcccttggcatggctgtcaatggtacttgcatggatttatgggtcctcagcatttgtcgttgagagaattaaactaaacaagatgaagatgcaaacatgggcaataccaagatacaacttccaatatggccttacgtgggagagagaaccaatcaacgacttaattgaaaaggcaatattggatgctgatatgaaaggggttaaagtgattagtctaggactactgaatcaggcaaaacagctcaatggaaacggtgaactatttagacagaagtatccaaaattaggagttcgaattgtcgacggaagtggcttagctactgcagtggtgctaaaaagtattccttcagatgcaaagaaagtttttcttcgtacaggcacttcaaagatagctcgtgccattgccattgcactatgtgacagaggtgtccaggtgatcatgaatgaaaaggaggtataccacatgctcaagtcacaaataccagagaacagggcaagctatttgaaactctcgagcgacaacgtacctcagctttggatagtacacaatattgacgacaacgagcaaaagatggcgccaaaaggaacaatttttattcccatatcacagttcccccttaagaaacttcgcaaggactgcacttacatgagcaccccagcaatgaggatcccggaggaaatgaagaacatccactcctgcgagaattggcttccaagaagggtgatgagtgcttggcacattgctggaatacttcatgctctggaaggatggaacatgcacgagtgtggggatgagatgatggatattgagaaatcatggtcagctgccattcggcatggattccttcctctcactaaagcttgacacctctggaagcatggatggtgtattccatgctagtagatgatgctatgatttccagcaacggcataatccattcattatctagcttgggaaccagatggattattcacttattatcttactatgtttgtaatactgagcttgggtactgataagtcatgaggaggcacagtgcaaacgaacttaattccaatagctcagtattttataatctatagtctatgtcagttctgtaacattacgtttatctcttatttgaatcttgtgggggaataattaaaa

SEQ ID NO: 99 - DNA, 3784 bp, Oryza sativa
ggcagagccctccctcatgatgcaaatgcatttagtgagggcattcaaaacacttgcaagagtttggtgagaggagggaggctctgtgtgagatttgttctgcatctgaccttaagcttcttcttcttcttcttccctagatttggagagactagagccaggccagttcatcactggtttgttggggagcattgtttcttgcttgctgcaaagcagaaaagacagagtcaaatctttagtttttatttacatatttctttcttttttgcttcctcctctttgatgctcttttctttaatttgagttcttgatcctgccaaaagcaaaagcccctcacttttagctgaggagagaagtccaaaaggaaaaggtgaaggcttgtcctccttgcatctcaactcaaaccctccatccccctccaaactccttcaaaccaaaaatctccaatttttaccacaaaaatccccatcttttcctccaaatccatttgatttcacccccaccaccaaacaaaccctctcagatttcttctccccacttctccattgccattctgccagtgttcttgattcaagaaatgctcattttctgatccatagttctccaaagatccaattttctgaaatctctccacgaaaatctctcattttttctcctcctcgatgcctcgttgatccaaaatcgccacgaagaagaaggagaagctgcgatttctcaggtcgctcgattccctatgcatctctccctatggaagcccctctcccactgcgccgccgtcctcctcgccaagaaccaccgccgccgcggcggcggcggcggaagcaatggccaccgcggtgacgacccggcgtcgttcctccgccagctgcgcgacgcgctcgacgccgcgtcggaggacggctcgctgtgcccgcccccggacgccgcgggcgcgggcgcggacgccgacgcggacgccgccgtgtcgcgctcccgctcgctcgcgcggctccgggcgcagcgcgacttcctccgcgccaccgcgctcgccgcggcgggcggcccgttccgctcgccctccgacatcccgctcctccccgccgccatcgccgggttcctcgccatgtacccggactacgccaccacgtccgacgtcgaccgcctccgcgtcgagcactactcccacctcgacgccgccgcccccggcggcggcgcgggcggcagggtctgcctcgactactgtggtttcggcctcttcgactccggctgggactcctcctcctcgtccttcacattgtccgagctcaatgccaacctcagcaaccacgcgctctacggcggcgccgaggccggcacggtggagaacgacatcaaggagaggatcctcgagtacctgaacgtgccggcgagcgagtacgcgctggtgttcaccgtgagccggggctcggcgttccggctcctcgccgagtgctacccgttcgagaccaaccggaggctgctcaccatgttcgaccacgagagccagtccgtgagctggatggcgcagagcgcgcgggcgaagggtgccaagacgcgcaccgcgtggttccggtggccgacattgaagctctgctcgacggagctgaggaaggagatcgtcggtaagaggagagggcggcgacgggattctgcggttggtttgtttgtgttccctgcacaatctcgggtgaccggcgccaagtactcctaccagtggatggcgctggcgcagcagaatggctggcatgtgatgcttgatgcaggcgcactgggccccaaggacatggattctctggggctctcgctgttcaggccggatttcatcataacctcgttctaccgggttttcggtgcagacccaactgggtttggttgccttctgattaagaaatcagttattgggagcttgcaggggaggaatgggtgtaatgcttctgggatggtgaggattgttccagtgtttccgcaatatctaagtgattctgttgatggatttgatgcaatggatggtctcgaagatgattctggtgtccacaaagatgagaagccagcgtctgatgcccgtaatggttcgcagctgccagcattttcaggtgtgtacacatctgctcaggtcagagaggcatttgagagtgatcctggccgtgacagcagctcggacagggatggggcgagcaccatttttgaagaaactgagagcatctcagttggtgaggtcatgaggagcccggctttcagcgaagattgctcttcagagaattctttctgggttgatgttggccaaagcccattggggtcggagaagggtggtcatttcaagaaagggaaacttggatccccattaccatcttcttggttcgctggcagaaagagtaacaagaggatgtcaccgaacctaacatccaggatatcaagaagccctctttatgatggtcaggtgatatcttttgatgcagctgtattatcagtttcacatgacgcggactgcctcaaggaagaccctgaagaagaaatctatgagaatggtcggcggaatcacttcaggcaagttagtgaaattcaagaggagccagaggttgaagaagttgtatgtcaacatgctatgaatggcggtggggatcacaaagaaagtgcgataagaagggagactgaaggggaatttcggcttttgggagggagggatggaaacagcagatttgctgggggtcggctcttcggtgttgaagagattgatgcaggtttaagcatgggccgtagggtttcattcagcactgaagcaaatattattgcggatagactacaccgggcctcagatgctgctgaagcttctggatatgcattccgtgatgatgatggttgtgtaagtgatgggtatgataatgctcaggactggggcaggagagagccggagataatatgcaggcacattgatcatgttgatatgatggggcttaacagaactactcttagattaagatacctgatcaattggctagtaacttcactgttgcagctgaggttaccaggctcaaaaggtggtgatggagacccccttgtccacatttatggcccaaagattaagtacgaaaggggagctgctgttgctttcaatgtgaagcaaagtgatggcacttttgttaatgctgaagttgtccagaagattgcggagaagaatggcatatctcttggcattggttttctcagtcatataaaggtggacctgaaccacaaacagttaaatggagcattcgatatacctgaggcttccttctataagaacggccgcaaagacagtaaaaaggtgaccataagagttgaagttgtgactgcttcccttggcttccttactaattttgaagacgtgtacaatatgtgggcatttgtcgccaagtttctggatccttcatttctagaaagtgagcgcctcaccattgctgctgaccactcagagggacaaacttgagctttatctgtaatttgcattcagcaaaggagaggaaggtgatttttctcctttatgccttcgaggagtatttggtagtggatttagcagatttgtttattctttgcttagttcctcgacatgtgaccttttttgtttcatgtagagtttgctcaaatatgtaccagcagctcaccagtagagcttctttccactgaacaatgtttgtaaagcagctcactgcctcactcgaaatgaaatagtttgagtgctttgtaatacacttggttaggcatgtgttcatcatgcagtttttatatcatcacttaacactgtcgcatttgc

SEQ ID NO: 100 - DNA, 1856 bp, Sorghum bicolor
actctcgccatcactccggcctcttccacggccgcctccgccagtccgcttccgccgccgccacctcgccgccgaccaccatagcatcaaatacttcagagctcgcgcccctcgcgcatggttcttggcttcttgctttgtgctcgacgttcactgtaactaatcgactataagcgtggtgaccactgacgagatgatgccggtggaggcagcggcggcggcggcggcggatgactggtcggagtgcgcgttctcgctgacctgcgaggaagactgcgccgacctcggcgacggcgtcgtagacgacggcgagttcttcccgctctacaatgccggcgacgaggaggaagaggagtacttggagcagctggtgtttaaggagaccagcttctgctcctcctcctccgactcaggcgccgactgcgacggcgacggcgacggagacggcgaaggagacgaagagtacccctcgctcgcctccgaggagtggttccggcaagctcgcctcgccgccgtcaagtggattcttgaaacccgcgggtgcttcggtttcggccaccggacggcgtacctcgccatcgcctacttcgatagcttcctcctccggcgacgcgtcgatagggaggcgatgccgtgggcggcgcagctgctgtccgtggcgtgcgtgtccgtggccgccaagatggaggagtgccaggtgccggcgctgtcggagttccacgccggcggctacgatttcgactcggcgtccatccggcggatggagctgctggtgctgtccacgctcgggtggcgcatgcgcgccgtcacgcccttcgacttcctcccctgcttctcctcccgggtccacccgcacggcggcgccggcgccggcgccggcggccacgtcgccctcaaggccatcggtttcatcttcgccacggctgaagctggtagcgtgcttgatcacaggccgtccactgtggctgcagctgcaatcttggctgcaacctatggacctctgctgaccaaagaagcactgggttccaagatgagctacctttctccatcttgtcttattgagaaggagcatgtacatgcctgctacagtatgatggttggggacatgaacaggagaggtagcaagagatcattgccatgttcaggcaccaacgagattgccactagtacatatgattctgttcttgttgatgatgacgttacggacaccgcggcagccgccattgccactgtagtggcggcgaggaataagcggatcaggctggagctgacgggcatccgttgagaaagctagcaccaccggggacacaatttttagccagatgtctaggggggggcttggtttgatcttccctttcattttctttccttctttttttaacttatatgtttgcaaaaaaaaaaaagaagagattttttaggttctttgagccattgccatgggttggcattggctgttgtcagattggattggtttggtttgtgagaggtggaagagatgaatgaacaaagcagagggctgagctttcctatggagaggagagcttaggttaataagcccaatgccagtgcccaaacagggcacatttcacagtgaactttacttcaaagttgcactgtttgataaaccatttgttgatgcaatgttgcattgcatatggtgagatgctgctgctgcagagagaagatgcaaaacaagtggtaacaacacttgagaggttgagggttttgccattgtttatagagagagctgtttccctttttcacttgtgcaagtggatgtgagagtggtgtttcactctgcacttgcaagggttacattcgtttgtaacaaaccctttgtacttgtgtaaccc

SEQ ID NO: 101 - DNA, 2817 bp, Sorghum bicolor
tgctgggctgggcccgagcaaagcaaaaagcctcgaaacatcttggagccatgggcctcggttgctggacctcgacctggacctgtacgcatctgcaggcgccatggcccgaaaccggaagataccctgagcgggccgccactgaggcctaatactagcccactggcggacgagctcgtataaaccctagctggggactatcgggtccggggaaaacccccttcgtcgtcctccgtcgccacagcagagcagcgagcgagcggcgcgcgcgatggcgggcggcggcgatcgccagggcgcgaagaagcgcaagcgcgagcatgcggaagggaaggccaagcctcggccgcaagttaagggaggtggggacggagggaagcggaagaagcactcggccgcagatggcggggccggagaggctgtggcgaggaagaagactccggttacccacaaggagaagcgcatcgcggccaaggaaatgtcggaggccaggaagatgaagaggaaacggcattacagccttgagaaggaactaacgaaactgtgggaaaagatgagatgtcacgatgtgagcaaagaagagaggtccaaggtagtaagtgaggctatcaagaaaatggatgggaaatatttggatattgccacatcacatattactgcacgtgttcttcaaacatgtgtaaagtggtgctcgcagtcagagagggatgctatttttgatgttctacatccacatttgctcgatctttctcgcaagaaatatgctgttttccttgtaaagaagcttatagaactcgcctctaaaaaacagtttgccagtttcatctcttctcttcatggtcgtgttgccaaacttcttcatcatactataggagctgcagttgttgattatgcatttcagcggggaacaaaacgtcagaaaaaacagttgttgctggaactgtactccactgaacttcagctattccaggatctgactttgcaaagttcctgctgtttgatagatacaatttccaagcttgggttgcagttatcatctgtcctgcagtacatgactattgtgattcataaaatcttggagaaaggtactgttgagtattcaatagtgcacacggccatattggagtactttacaattgcagataagacctcagcctcggacgttatttgtcaacttatcccccttcttactcaaggagcattaatcatagatggagatgaaccatcaaatgctccggagctaccaaagaaaacaaaagctaagaagaaaaggtcgaaagagccacttatcgttaggatcatgcagacaagggaaggtttaaaactaggaattggttgcctcaagcatggcagtgcaaaggacaggaagaagatcattaaaagtttgaaggggcacattctgaagcttgctctaagtgattttggatgccttttccttatctgcattctttccattgttgatgacacaaagcttgtttctaagattgtcattcaagagctggcaaaacatttaaagcaactcatttttgacaagaatgggagacggccattgctgcaactactaaaccctctttgctcacgctatctttctccggatgatctggcttgtctgaactacaatgtgccgtctcttagtccaaaagagggtgacacatcagaaaacgtagtaaatggtatgactgatgaagaccctaatggcttagtagtcatgcaaattgtgtctgagagcaagaaggatccattacaaaggcgacatgaactgttggtgaaaactgagctggctgaggctctcatccaatcatgccttgaaaatgttggagaattacttcgaacaaattttggcaaagaaatattatatgagattgttgttggtggtaaagacaatattttggagggcctcactgataggatccacatgttgcatgatgcaatagtgtctgatgcagcccaaccgaagactgaagatattgaacatgcatttgagaatttcttttccagtcgtgtaatcagaagaatgataattgactgtccagcatttgcagtcactctctggagaaaggttcttgaaggaaagtgcaagatatgggctgaaggatacagctcgaaggtggttgcaggtttcctggaatcgccaagtaaggaggtcaaggatcttgcaaaacctgagctgcagccactggttgatgctggcatccttaaagtgccagaccctaaggttgttcagaaataactcgtgcgtgcggacatttttgcgtcaatgaaggatccaagggccatccattcttgtgtaagggacatggatagatttttgtcgcttgagcacgttctgcccataaattgttagtcactgagtgtacgctagtccgctataaccttataataggatatatagtaaaccagatccagtatttcgttttgaactctgaatgctcctttttatctgtaattttgttgggagattggtgttcttgtcctgctttgaaggccaataatgattttattgttgttttttttaatccgaaggcacccttctctctcattcgttctggtttagactctgccagttagctaaaagccaaatgaataaattgaaggaaagaaaaatgaagaagacgactagttaaacaatgttcgatatgatatatttgcaaatttgatgttattttttatacgttgttaaaatatatgatatgatgaaccatatggtgctgaaaattttgaagggaaattcatataggaaaaccctaactcttctaaatgaaacaaatgtgaactctttttttcacactggtgaaaactgaatttcattaccgtagc

SEQ ID NO: 102 - DNA, 2818 bp, Sorghum bicolor
cgcgaataaataaagcggggggcgagctcgtctgaccgacgtggtgagctgttcttccgcgctctctctcttcctgtgcgtgcccgcggcatatgctggctggcctgcctgcagcggtggtgttcctcttccggctattaaggtcgtgcttgatgagtagtaggtgattaaggtgagggacgagggcgacgacgacgaggagagcccgggtcgtcgctgcgagagttctccgtgtgtgctagcccgcgtgacagagaggaggaggaggaggaggtggtggtggtgtcagtgcgtgccaatggcgccgtcgtggtgggggagggacgcgagggccaatggcgtcgttagcggcggcggcggcacgcccgtggtggtgaagatggagaacccgaactggtccatctccgaggtcgccgcatccgaggtgtcgccgggctcgccggcgggtgccggcgggggcaaggccgggcgtggcaagaacgcgcggcagatcacgtgggtgctgctcctgcgggcgcaccgcgcggcggggcggctgacgggggcggcgtcggcggcgctggccgtcgccgccgccgcgcgccgccgggtggcggcggggcggacggactcggacgcagccccgggggagagcacggcgctccggacgcgcttctacggctgcatccgggtgttcctggtcctctcgctgctgctgctcgccgtcgaggtggcggcctacttccagggctggcacctctcggtttccctcgaggaggaggtggacgcgggcctccaggccgtcgacgggctcttcgccgccgcctacgcggcgtggatgcgcgccagactcgactacctcgcgccgccgctgcagttccttaccaacgcctgcgtcgtcctcttcttgatccagagtgtcgaccgcatcgtgctttgcctgggctgtttctggatcaggctcaaggggatcaagcctgtgccgctagccgccgccgacaaggaggacgtcgaggccggtcccgaggacttccccatggtgctcgtgcagatgcccatgtgcaatgagagggaggtgtaccagcaatcgatcggcgcagtgtgcagcctggactggccaaggtcaaatttcctggtccaggtgttggatgattctgatgatgctaccacttcggcacttatcaaggaagaggtggagaaatggcagcgagagggggtgcgcatagtttaccggcaccgggtcatccgggatggctacaaggctggaaacctgaaatcagccatgaactgcagttatgtgaaagattatgagtttgttgtcatctttgatgctgatttccaaccacaagcggatttcctgaagcgcactgtaccccattttaagggaaaggatgacgtcgggttggttcaggcaagatggtcttttgtaaacaaggatgagaacctgctgaccagacttcagaacataaatctttgcttccactttgaggtggagcagcaggtgaatggggcgtttctcaacttcttcgggttcaatggcactgcgggagtgtggagaattaaggcacttgaggagtctggaggatggatggagaggacaactgtggaggatatggacatagctgttcgggcacatctcaaggggtggaagtttctcttcctaaatgatgttgagtgtcagtgtgaattgccagaatcctatgaagcatacagaaagcagcaacaccggtggcactcaggtcccatgcaattgtttaggctctgctttgtggatataatcaaatctaagattggattctggaagaagttcaatctcatatttcttttcttccttctccggaagctcatcctacccttctattcattcactcttttctgtgtcatccttcccatgacaatgttcgttcctgaagctgaactccctgcatgggtagtatgctacattccagcaacaatgtccattctcaacatcctcccagccccaaaatctttcccgttcattgttccataccttctgttcgagaacaccatgtcggttaccaagttcaatgccatgatttctggcctgttccagctcgggagtgcctacgagtgggttgtcaccaagaaatcaggtcgttcttctgagggcgatctcttagccctcgttgagaaacactctaagcaacaaagagtaggttctgcacccaatcttgatgcactaacaaaggaggagtcaaatcctaaaaaggacaccaagaagaagaagcacaacaggatctacaggaaggaactcgcgctgtccttccttctgctaacagcagccgcccgcagtttgctgtctgcccagggcatccatttctacttcctgctgtttcaaggggtttcattcttggttgtcggcctcgacctaattggcgagcaagtggactgatagcaatataaggaatataatgggtttttttttttgcttgaagaaatcttcgcaagcatcaaagggctctttgtaaagggaagagtgtcgccctctttggtgcttacacgaggaaaaccttggtccctgttgcaggggtcaaaagattcaccagagatactgaaatgtggaggagctgtagataggtatagtttgggtttagcctgtgagatgcttttattctttcaggtttcgattcttttgtaagaatatttctgtccctggatgggctgttctctctttctttttttctttttgagatgacagactttaccttcaaatgaagataatacttgtgttcaccgtgtatttgatcaatcaatcaatcagtcaatcaattaccatgattattgaggtacatctcctagaagtagtataatgtaaggg

SEQ ID NO: 103 - DNA, 3367 bp, Sorghum bicolor
ggaagcatccattccactccatcctctcaatcgcctccgcctcccccaaatttgaaacctccgaggcggacgcgacgcgaaggcgtgcgtcggtggtcgagattcgagacggccgtctgggcgaccgcgccgccgccttccactccgtcgtctctcgccgcgccccgcgggggttgcacgcacttgggcgcgcgttcgggcgcggggttggatgcggctccggcttcggccgacggaggtgctccctggtcgcgacggccacgccgggaccgtgggcgaggtgagtaatcatgccgagtggtaaagcaaaagctccaaagggtggggaggatcctggaattccgccagttccttgtgaaggggaaattagccatgagccacagagacaacggtcgctcaacgggaggactactggtccgacccgccgttcgaccaaaggaaattggacacccgaagaggatgctatattgtcccgcgcggttcagacgtaccaagggaaaaactggaaaaagatagcggaatgttttccagacagaaccgatgtacaatgtttgcacaggtggcaaaaggttctaaaccctgaattggtcaaagggccatggtccaaagaagaagatgaaatcatagttcagatggtaaacaaatatgggccaaaaaagtggtcggccattgctcaagctttgcctggacgcataggaaagcaatgtcgagaacggtggcacaatcatcttaacccagccataaacaaggaggcatggacgcaagaagaggagattactcttattcatgctcatcggatgtatggaaataaatgggctgaactgacgaaatttttacctggaaggacggataatgcaattaaaaatcactggaacagttcagtaaagaaaaaggttgattcatacatatcttctggcttactttcacaagtcccatgcctccctctgattgaatatcctgcacaatgcgattctttatcatctatggaccaagaaaacaacggagatagtgtttgcaatgctcagaacactagcatggccttgagctctgatttacaagtaaatgtggatgccaacaagagagaagcacaagactctcactcgtccttgtgtcaaggggcatgctatccttccacagaggctgtaggatctgttttgcctgatgagaaccaccatgttccttcatctttttctcaaagaatggacctgcagatggatatggatgaaggatcaggaaattctatgtttgcagatgatcaaactctttgtagcacatcaaatcaagaaaagtctatggtgccatttgttgttgcacaggaaatgcctgtctctgtgctatcaggtgtttctagcgctgagcagaaactgcacttaatctctgatgctgaaagtttgaaatctgaactttggaaagatgtttctttgcaaactcttatttcaggagttacagttgacgctgatgcttcaagattaaatcatccagattcttccaaaatggacaccaattttttgacacaggcctacccattacacacatcaaatccatccggtgtgatggaaactgtgtatgaaccgatgccgtcggagacaatctctccctcttttatatgttcagatggtttgtctgttgcacccgaaaatagatctgagccaagagaaatgccagactgtgaagcacagatggccacatcctcaaacattttttgtgatggcgatcaatctgctatacctggcagcagtgatgacaggccagaggctttcacgatgactgagagcattacaaactgtgggggtcaacagtcaacagatgccgaagaacctatggccactacagcaaaagaacagttatcgaaagacattgagactgtgccagatgaaaagaagggtgagggagctctattctatgaacctcctcgattccctggtttggatgtcccatttatcagttgcgatcttgtaacttctgctgatctgcaagaatttagtccccttgggattaggcagtggatgcggtcgaccatgaatgtccccactcctttaagattatggggctctccaacacatgatgaaagcccagatttgctaaagagtgctgctgaaagcttcccatgcacaccatcaataatgaagaaaagacagagaggtctattgtcccctactccagataaaagaattgagaagaaatctgggattgcaaagggggtgacagatatctcctatatgatcacgaccacatgttccatgaatgcaaccaacgatggagacattgttactgaatcagttgtgtgtgctgagcaaccttcttttaaacatctagacaagaaacttgagttctctaatatcaacatggaaaactctgatggagcatctaaacaggccaaagatccacaaaatgcagggaacaaacgactcgtggaggagtcctcgccaaacgttgcaaatcctaacactgatctgcaagacaatatacaacctgtacggattcttgttgagcacagcagcaataaccttattgctgctgatcatggtgcaaagccatcttgtaaggaagtaattagttcaaaatcaaagcctacagaactacttgttgaaaaatcatcaccatgtatcaatgcggattacgaatatgtgaacttattggctgataccccaggtgtcaaaagaggtttggaatctccttctgcatggaagtctccttggtatattgatatgcacatgcactttcagggttttgtcagcccagcagacagaacttatgacgcattaggattagtgaagcatttaagtaagcacagtgctgctgctgcagtggaggcctgtgaggtgctagcaagtggcaacaggacttctgataaggaaaacaaggataatactgatggcaaggagccagtggcaagaaaatcacaggtcaaaatcatggccgaggcgcgagtcctggatttcgacgaatcttccacacctgcaaggacagcagataagaaatttggcagctgtctcgggagatctgttagctcacccattcttccctcccccaacctgagaagtttccgataggtagaattctgagagatacaccagatatggtataattatacattagccgtatgtacatgtatatgttcctagagcgcattgttctttcattactctatgttaccatgatgtcagcgtacagtcagcccagaaactagcatccaaaaggcagcagtatcagtgaagtgttgaaacttccctatcattcaattaaaattattattgattagttgcttacactggagatgtctcctggcacttaatttgtacatgaaacatggtgatggtgaattggtcactccggagtccagcgcgcagatcagtctgataatgcc

SEQ ID NO: 104 - DNA, 1652 bp, Sorghum bicolor
gtcgccgcttcgcccccccaccccctgttccccctccactccgcctccttcctattcggcggtgcggctcccttccctataaaccccgccggcaccgcactggaggaatccccccacaatccccaatccccgtcgctcgcttcccgccgtccggatagctatggccaccgccgtatccacccccgttgacctgtcgccggcgccggcgccggccccggcaccgagacggcgtggccggccgccgaagaacccggcccccgccgaggcgccgggcagcagcccggtgtccccgctggctgcggcggcatcggaggcagacgcgggcggggagtacgagcggcagagggccgcgaggatccgggagaacatggagcggatgcagaagctcggcatcctcgacctcgcgcacaccctcagccagtccgccgccgcctcgggcagtggggggcggcggcgacggaagcccgtggagcaggggtccgttgacgcggccagggtgaagccctcgccgccgccgccctcgcggaggtcgctcaggttgaaggacgtggaaccagtaagctattgtgaaattgagccaaagaaagaggaacactctgaagatggcaaaacagtggtaatagaggtaggagcaaaggaagaaatatacactgaagagcatgacaagctcttgggtacatgcaacactccttggactctctttgtcgatggctatggcaaagatggaaagcgcatctatgatcaagtgaggggccaaacctgtcaccagtgccgacagaaaactcttggtcatcatacaagctgctgtaaatgccagattgtccaagggcagttctgtggagattgtctgtatatgaggtatggtgagaatgtgttagaagttaaaaagaatcctaattggatatgtccagtttgccgtggcatctgtaattgcagtatatgcagaactaagaaaggatggttccctactggtgctgcgtatcgcaaggtggttggacttgggtacaaatctgtggcacactttttaattgcaacacatcgagcctcatcagttaacccagaggattcaagctcagctgacaaaaagaagttgctgtctgctaaatctgaaacctcgtgcatttctgatcatgatggcctggatgccaatgagaatccagaggatggagaaacgagcagcaaagctaagctgaacaaatcaactcactgccaagtgaagagttctgatggtgacaaagatgatagcagaagcgtggtgacatctgattgccaggatgatgaagccaacaaggatgctgggtgtgtcactccatcttctaagccaatgtcaaggaagaggaagtacgttgaacgaagccctgactgcatcgcaagcaggctgcggtcacggctcaacatgcacatgaccagtgatcaggttcatggatctcttttgcgatgaagttctggctcttttcacttacaagcagttcatggcatgtgagtgaagatgtttagtttcagcaggtgatcgtcgcggcagtgttttgcatagctatgtatttatggcattagtgccaatagttgattgtagatttgttgtgctagtatctgatgtgaggtgttgcggtagcctgcagtttaatgtacaattcatgttatttgagtgaaga

SEQ ID NO: 105 - DNA, 2008 bp, Solanum lycopersicum
tcatctctttctcactttttcactttcactatcaatggagggtcgccattctcatccatctactccaatccccgaagattttgttcagaagcgtggcaagaaacggggaagctataactgtggtagatgtggacttcccaaaaaaggacatgtttgtgatttgactaaggagtttagtgaagttcctactccaacatctagtgatgctaagtcatttgttttgccttctcagctttctgttattcgttctaaccctaccccacctttacctccgccacgtcagccggttgtgcagctccggcgggcgctttcgtttgatgatattggtgttactgacgaatcgcctggatctgatgatgagggggagggggagtttttggattttgagagtgagttggatttaggtggatctgggaagttgccggcgaattgtttgtgggaagtgcttaagagattgccaccgtcgtcgttgctttcttcggcgaaggtgtgtaagggttggagggatgtttctaggaggatttggaagtcggcggaggagcttagacttgaggttcctatgaaagctcagattggacttgttggatcggtgttgcagaagtgtcctggacttgttaagctttctcttagaatgaaaagtgatgtggatgccacaatgctggcctgcattgcattttcctgccctaatctggattcactggagatcctcacttccgatacctcagtcaatcgaatcactggggatgacttaggtcgttttgtagctgataaaaggtgtcttaccaatcttaagatggaaggctgctcaaatcttggaggctttactctttcttcaaccagcctttccactctttgccttttggaactcttttgtcactctaagatggtcttcaactgccccaatttgaaggaaatctccctgattttttcttgccaagagaatgaaaacactgatcttacagctatggtgaatggtcttggaaggagctgtccaagactacagaacattcatgttgcctcagttcggctgacacatgctgttgtgcttgctctaacagcagcaaatttaaggggattaagaatgctttcacttgtactaggatcagaaattactgatgcatctgttgctgctattgtttcgagctactcaaggcttgagttacttgatttgagtgggtctagtattagtgacagtggcattgggatgatatgcaatgtatttccggagacattgttgaaactactccttgctctctgtccaaacattacgtcaagtggcatacaatttgctgcagctcagttgcctaacctagagctaatggattgtggaatgagcatatgcgatccagatctagacagtccagcagcacaggaaaatgataatgttgatatacaaagaacaccaagtagtaaattacaccttatttatcagaaactgattattaagcacagccacttgaagaaactcagcttatggggttgctctggcttagatgcattatatctcaattgtccggagcttaatgatttgaacctgaactcttgtatgaatttgaatccaggaagattgctactccagtgccccaatctggaaagtgtacatgcatcaggttgtcaagacacattggttgaagctcttcagaatcaggtttgtggtgattttatggttgaagacgatcattttccttgtaaacgtcttcctgatggctcaaaaaggatcagagttcctcattcatacagtccccagccatttgatgatggaaagagaaagagaaggctttcaaagcaacgttgtgcagtgcttgtttattagtcagaaactcatcttgtactggctttgttgttgatctaggccatcttatttgtctaattctttgtatttatagtgatctgaggtcaaggcctaatcatgtaatcttcatttatagaactaaactcaatgttatcaatacagggattatattccctatatcaataaaaagtgcttggcactgtgaactttgtgata

SEQ ID NO: 106 - DNA, 938 bp, Arabidopsis thaliana
gtgacaagacgattctggattctggatacagctggaagagaattaaaagaaaaagaaaaacacttccaacgaagaagatcgatttgcttcgagtctctgaaagaagaagaaaaaataatggggcgtatggattatctagcgatgaagaccgacgacgtcgatacggtggcgttagtcaattccgatatggaagagctcaaggtcgctgcgaagaaactgtttagcgatgtttcgaagcttggtggattaggcttcggtgtttcttttctcaaattcctcgcttctttcgctgccatttacttgttaattttggatcgtaccaattggaaaaccaagatgcttacatcactcctaataccatacatcttccttagccttcctagtgtcattttcaactttctcagtggagatgttgggaaatggattgctttcgttgcggttgttctcagacttttcttccctaagcatttcccagattggcttgagatgccaggttctctgatcctgctactggtagtttctccacacttccttgctcaccatatacgtggaacctggataggcactgtaatcagccttttcattggatgttaccttcttcaagaacatattcgagcatcgggtggattcaggaactcattcacacagccccgtggagtatcaaacactttagggatcattcttcttttggtctaccctgtctgggctctaatcgtccgtgtcatgtaatccacattcctctttcatcgacaagttgtttcttgctcggctgctccaataaactgcgtgaaacatcgagcagagcaagtctctatggtgttcctttcttctgattatgttgcatacccaaatactacctcaagctcaatcaatgttctatgtataaaaaaatctcatttttcaactatttgtttgtcctactataagaaaaagttctt

SEQ ID NO: 107 - DNA, 1463 bp, Hordeum vulgare
aaaatgaaaatccgtatctgtgtccatcgccctgccgcaagcagcggaaaacgaacccatctttcctacttaacccccgcgcttttccagtaatccagagacaccgtagcgagagaggagacgcggcggcggccatggcgatccccctcgtgctcgtcctactcccgctcggcctcctcttcctcctctccggcctcgtcgtcaacactgtccaggccgtattgttcttgacgataaggccattctcgaagcgattgtaccggcagatcaacgtattcctggctgagttgttgtggcttcagctgatctggcttgtggactggtgggcaggtgttaaggtacaggtgtatgcggatccagaaacttggaaagtaatgggcaaagagcacgcccttctcatatccaatcatcgaagtgacattgattggctggttggatggattttagcacagcgttcaggatgtcttggaagcgcaatagctataatgaagaaatcttcaaagttccttccagttattggttggtccatgtggtttgcagaatacctctttttggagagaagctgggcaaaggatgaaaaaacacttaaatcgggtcttcaaaggttgaaagacttccccagatcattttggcttgccctttttgtagagggtacaagatttactccagcaaaacttttagcagctcaagaatatgcagtttcacagggtttgacagcgcctaggaatgtgctgattccacgaactaagggatttgtatcagctgtaagtatcatgcgtgactttgtcccagctatctacgatacaacagtgattattccggaagattcgcctaaaccaacaatgctgcgtattcttcagggacaatcatcagttgttcatgtccgcataaaacgccattcaatgagtgatatgcctaactcggatgaggatgtttcaaaatggtgcaaagatatatttgtagcaaaggacgcgttattggacagacatataacaactggtacttttgatgaggaaattataccaattggtcgtccagtgaaatctttgatggtggttctgtcttggtcatgtctcctcctatatggcgctcatagattcttacagtggacccagctcttgtcaacgtggaaaggagtgatcctctttgctactggattggcaatggtgaccgccgttatgcatgtattcatcatgttctcgcaggccgagcgctcaagctctgctaaagcagcaagggaccgagtgaagagggattgatagcccgtgtgaaattcagtctataggggaactgccaatttattatgttcagaatatatgtagacacaggctccatgggtcaaaatctagtatgtccttgttgtcctcggtaagagcttcaggagtattgtgtggtgagaactgtggacttccttctttctctactttgtaatgacttgtaaagatttgttttgccataccagg

SEQ ID NO: 108 - DNA, 1949 bp, Setaria italica
cacgacacagctcacgagggataacgccaaaccaaaaccctcctctcccccaacccaaaccctagccggcagcccccttgatgaccgccgccgccgccgccgtagatgcacaggctctccctcaccgtcattgacgccgccgccgccatgcccgcggcgctccggctcggcggctccccggcgctccgcctagccgccgcgcgccgccctggcccgcggcccccgccgtggctgcgcttcggtgtgggcggcggggccgtggcgcgaagggggctgctctgctccgccgaggccgccaggcggggcggcgagggcgaggacacggaggtggaggatgcgcggaggggaagcgggagccgcgcgggggcggagaggaggacgaggggcgggagcgcggccgccgcggtggggacgagcgtcgagcttctggcgattcccggggtcgggccgcgcaacctcaggaagctcgtggataatggcttcgagggcgtcgcgcagctcaagcagctctacagggataagttctttggcaagtctagtgagcagatggttgagttcttacagagttctgttggcattgtacataagaaccatgctgagagtataacatcatttattaaagagagtgtcgatgaggagctgaaggatacagattcatctaaacccactcaaaagaagaggttgaccttttgtgtggaagggaatattagcgttggaaagaccactttccttcaaagaatagctaatgagactattgaactgcgtgatcttgtagagatagttcctgagcctattgataagtggcaggatgttggacctgatcacttcaatatattggatgccttctatgctgagccacataggtatgcatacactttccaaaactatgtgtttgtgacgagggtcatgcaagaaagggaatctcaagctggaataaaacctctcagactgatggaaagaagtgtattcagtgatcggatggtgtttgtccgtgctgttcatgaagctaattggatgaatgagatggagatcagtatctatgattcctggtttgatccagttgtgtcatcactcccaggtctcattccagatggatttatctatctaagagctagtccagatacttgccacaaaagaatgatgcatcgcagaagatcagaggaaggtggtgttacacttgactacctgcaaggtttgcatgagaagcatgagagctggttgcttccttcaaaaggatcaggtcctggtgtattatcagtcagtcaactgcccatgcatatggagggctccttgcctccagaaatacgggatcgtgtattttacttggaaggaaatcacatgcactcaagtatccaaaaggtccctgctcttgtcttggattgtgaacctgacattgatttcaacaaagacatagaagctaaacgacaatatgctcggcaagttgcagagttcttcgaattcgtcaagaaaaagaaggaagaagctccgtcggatcaaacaagtgctgacaaggaccgcatgaacccgcatgtcatgcttcctaacagaggtcggctatgggtccctgacggcaaccccttcacaggctcccctatgaatctggatttcagaagagccatgtcttcgtacctctcaacctaagactcaactgcagaaagaaactagccgccctcgctcactgacctcgcaacgcaaaccgcttgttatgcctcaagtcaaaccctaggctgcccgatgctagccactgatgtaaaatagcccggctgtgtctctgtcctgtaaattacgatcttagcgctagtcccacgtttcgcagtactagcatacgcgtctgtctgacttgatcagatggtgggtctaatctgtaccttatgctcgcttgcttgaagcattctgttgaacagatccggagtctgggacgagaacacgtgcgtgtgctgccgtacttg

SEQ ID NO: 109 - DNA, 1969 bp, Setaria italica
cgacaagtcagcaacaataattcatggcgggatggatgtgacatccccaaaaccctaaacccgcgccactcgaagccgccccgccgcacccgcgcgggtcggcggccttaatcgcggccgaaccgccattgttgagacccttccctgccgtcaccgcagccagcgatgcacaagctcctcccccgcgccgcctccgtcctctacgccgccgccgcggccccactgctgctctcctccccacgcatgcctgcgctgtgcctggccggcagcccgttcgcaacctcgcgtccagtcgcgaatcctagccgcatccgctccccgccgtggctgcgctgtggcggcgggaggaggggactctgctcggccgaggcggcgaggcgcgggggcgatgcggaggaggagaaggagaagggtggcgggggtcgcgcggtgccggagaggaggcagcgaggtcggagtgatgcgctgggggaaagtggggagctgcttgccattcccggggtcgggccgcggaacctgaggaagctcgtcgacaagggattcgatggcgtcgcgcagctcaagcagctctacagggataagttctttggcaagtctaacgagaagatggttgagttcttgcaaaattcagttggcatcatccacaagaaccatgctgagagtataaccttgttcattaaagagagtgttgatgaagagctgaaaggcactgatacatctaagcttcctaaaaataggaggctgaccttttgtgttgaagggaatatcagtgttggaaaaactacctttcttcaaagaatagccaatgaaactattgaactacgtgaccttgtagaaatagtacctgaacctattgcaaagtggcaggatgttggccctgaacacttcaatatacttgatgctttctatgctgagccagagaggtatgcatacaccttccagaattacgtatttgtgacgcgggtcatgcaagagaaggaatctgcatgtggaatgaaacctctccgactgatggaaagaagtgttttcagtgatcgaatggtttttgttcgtgctgtccatgaagcaaactggatgaatgagatggagatcagcatctatgactcctggtttgaccctgttgtgtcatcactcccaggtcttatccctgatggttttatttatctaagagctagtcctgacacttgccacaaaagaatgatggtgcggaaaagatcagaggaaggtggtgttactcttgattaccttcgaggtttgcatgagaaacatgagagctggctgcttccttccaagggaggagcttctggtgttttgtcagtcagtcagcttccagttcatttggagggttccctgcctgcggatatacgggatcgggtattctacttggaaggagatcacatgcattctagtatccagaaggttcctgctctggtcttggattgtgagcatgacattgattttaacaaggatattgaagccaaaagacaatacgctcggcaagttgcggagttctttgaatttgtgaagaaaaagaaggaatcttcaacagcagagacgattgatggtgataagagtataaacaagcagattatgcttccccagagtggtggtttgtgggtacctggaagcagccgtttgccagaatcagctctgaagtcctttgatttcaggaggacaatgtcttccttcctctcaacttagggtttgttaacaccttacgtgccatactgccctcagtttctgcccacgacctgaattcacgtggtccatcaacacatctcgattgcagaacatataggatcttttaactgacgaccttgtaaatgtgtaaagattacttgcaaatttagggttttagctagtgctagcgtgcaatgtatagttggtattcaactctgcctgtaaatgtgatcgaactgctttcgtaacagtacttggtagtactttatttggggtggcttcacaattc

SEQ ID NO: 110 - DNA, 1746 bp, Setaria italica
cacggaagtagaaacatataacccgtagctgccgcctcccatggatcccccactccgtcgccagtctctgccccccgcagctccatggccggcggctgcgccctctcggggggctgcccaacagacttcgccgccttcgccattgcctccgcggttcttgctttgctcattttccgtgctctctttcccttcatctatcggaagggcaaaagaactggtgtttggcttgtaatagttcaaattattggaagcactgatctgttgctctcactggtgatgtcaatgaactttctgaagttaaagcttgggcatccttggaaatcatgttatctctgggcagtttgggcagaagggccttttggatttggattgttgatcagttgccgcattgtacagggatttcagttatatcacgtttttgttaagcaccggttgccaccgatcaggccttccattattttagtagttatactccttccatggatatgtggagctgctgtttttcattggaataaacctttgaatcaccggtgtcacatgcaggctcagtgggtgattccagtaatgtgtatacatggattttatattgctggtttaattgtcatcacattatccattcgacatattgaattcagattcagtgaatttaaggatcttctacaagcaattattgtttcaacaatagcagtaggattttggattgttgcatatgtcctgaatgaaattcacgaagatattgcatggattcaagttttctctagattttcccttcttgtcatggcaagtattctggtgctgctattcttctcaatgtctatttctcaacctctgcattcacaaataagtctaggaaagcaagagtcgactgcctttatgactatgggtgaagcattaggtataactgataggggttcagtaaagaagattaatgccactcattttgattcgaatcaaccattggacaagctgcttgaggacaaaagattccggatgtctttcatgtcatttgcggacagttgcttagctggagagagtgttcatttctatgaagaggtgtatgacctgaagaagatacatctggatgattccattagaagaatatacatggcaagacacatcattgaaaaatatattgacgcaggtgcagaaatggagataaatatttctcacagaactcgccaagagatactaggaacacctgatctaactcatccaaatctgtttgacagtgcagtgagtgagatattgcagctgatcaaaatgaatttggcaaaggattactggtcatccctgcactttgctaagctgaaggaagatatagagagagggcccaacggccctgagctcatgccattggattactccccaagagttacttttgtgcggtgtactgatgatcccttttacgaagaacacgctgcgacttgtaattgaacggttgatagacaatgtggatgcggttgtatgcttggctcggccttgtcacgtcgaaatggggaaaaaaacagcagtttttttttatagatatgtccagttctgtcagatgggacaacggacaatggcgtgctttcttggtgatgctcacataaactctttgaaggcttcattcattcttatcctgatttgtacaggtattgcacttgaaaatgcaagagctgacttgttgggacccgatcgtttgctatgcttttgaaatggtgcgcatagcatattagcatcaacatcagctcaaacaaaaaaaagagg

SEQ ID NO: 111 - DNA, 1851 bp, Setaria italica
tgccaccggagcgctttcccctcctctctcttgctcagctccgttcttggatcgtctcgtttcacaagggaggactgaggaggaggaggagagatcgaggccacgatgatgcagcagatgcagcaggagccgtggaacgccgccgccgtggggctcctccggccgaccaagtcggcgccctgctcgcccatcaagccggcggcagcggcgggcatggtccggacccactccgactccttccacgtcgcgcacaaggtgcccgtcggcgacacgccctacgtgcgcgccaagcgcgtccagctagtggataaggatccggagaaggcgatcgcgctgttctggtcggcaatcaacgccggcgaccgcgtggacagcgcgctcaaggacatggccatcgtgatgaagcagcagaaccgcgccgaggaggccattgaggccatcaagtcgctgcgcagccgatgctccgaccaggcgcaggagtcgctcgacaacatcctcctcgacctctacaagagatgcgggcgactggacgaccagatctcgctgctcaagcacaagctgcagctgatccaccagggccatgccttcaacggcaagcgcaccaagacggcgaggtcgcagggccgcaagttccaggtcaccctcgagcaagaagccaccaggctcctcggtaacctgggatgggctctgatgcagaaggagaactacacggaggcggagggggcgtaccggcgggcgctgctcatcgggccggacaacaacaagatgtgcaacctgggcatctgcctcatgaagcagggccgcgtgcttgaggccaaggacgtgctcaagcaggtgcgccccgcggcggtcgacggcctgcgcggcgccgactcgcacctcaaggcctacgagcgcgcgcaggagatgctgcgggacctcgaggccaagctcgtcggccgcccgcgcgccgatcagctcgacacgagctggctcttcgacgcgctgctgctgggatcgtcgtcaagtatctggcagccgcagccgtgcatcgaccacttgctgccaccttcagctccggcacctgtcccggccccggccccggcgcggcgcgaccacttcgccgatgagaacgcctgcgtgagcaagaagctggcggcgctccaggcgaacatgctcaatgttgacgcgcagcccttctactctctgcggatgccgccacttgcgacgaagccccagaacacagtgcagcagcagccgcagcagaagccaactcccgtccatgatcccttgggcaacctgaagaggacacggtccggcaattgcatggacaaggcaggagcagtggtggacaaggagcagagcaccgacgagaacagcggcaggaggaagtcgctctcggctgaggacagatggccggaactgcccgaccacagcgcattcgacgaggctctcgtcgcggctgtcctagccccggtgctcgacgacgaaccagcagccaccgaagggaacggccatggcaagctgccggcgagctgcggcacgagcccagtggtgaaggagaagatcggcaagaggctgaggatcttccaggacatcacacagacagtgaacaacttctgattcgttttggttttcttcacttttcctactcacaacaggcaggcttgaggtggcgacgccgcgaaggagatgggcttgttctcctgggaagctcctgtctggcaactaagttaatcaggaattcgattcgattcgattcaagtttaatatgatgctgatttccaattcaatttttaacacaccaaaataacagctgattcttttgttcgcttcttcagcttggcacttcaggaagcgtgtgttttcctg

SEQ ID NO: 112 - DNA, 1219 bp, Setaria italica
cttcctctctcgctctcacaccattaatcactagcctctcaagaacagtacaacgaccacgggcagtagcatcagctcggagtaggagacactcgacgacgaggagggtgcccgcctgcctcttcccggcggcggcgatgaggtacggcgaggtggcgcacttcagccacccgcagcaccggctccggctggagcaccacgacacgccgttccggtgcgacgggtgccgcgaggtcggcatcggcgcgcgcttccgctgcccgtaccctggctgcgaccacgacctccaccgccagtgcgcgctcccgctctcgccgccgccgccgccgctccggcacccgttctacccgcgctgcgccttcgccttcctcccgcgggcgcctggcgcgccgggctcccgctactgcaacgcgtgcggccgcgacgtcgccggctacgtctaccactgccgcgcgtgcgggttcgacctgcacccgtgctgcgccgcgctcccgcacgcgctcgacgccggcggcggcgtcaggctgcgcctccacccggactccagggccaccggcgtcgcggcgtgccaccggtgcggccaccgcgggcgcagctggagctaccggagccagtgcgggagcttcagcctccacgtggcgtgcgtcatggacatgctcgtcgagagctggcacggcatcggccgccacaagggcgtcgccggcgggggcgggaacgtgtacgacggcgggatgctggtgcccgggtgcggcgggtacagggttccggcgatccggggcgcggcgaagagcgcccacgcgagcaggggagggtactcgacttggggcaggaagaaaggcaaggtgaagcgatgctgcgagatcgccgggttcgcggcgcaggtggtcatctcggcggtgctcggcgaccccaccgcgctcatcgccggcgtcatagggtcgctcatcgcgcggtgatcacggccgggcgccgccgccggcccagagcagcagagagacatgatctattgcatttttcatttcaaacgtgcaaaaacactgtatacatgtgcgtcgcagtcgccactcgctagtgcgcgcatgcacggccacgtaggcagagacttcgtggtgactggtgaattactttagaacctcctaaacttcctatcgatggatactgattataagtattaaatatatattaatttacaaaaccaattgtaaggtggaggttaatt

SEQ ID NO: 113 - DNA, 4318 bp, Setaria italica
gaacaaaccaccctgttaaaattctgcacattgcaatcctgctgagctgaaaaaggagtgcgagcggtaaagctcaccgcaagtgagcgcagctgtgctccgcctctgcctcctgaccccgcgccccacactgcactgccctcctcctctttatcactcgccccgacgccgcgctagcttctgacctgaccaccgcagcgcggagcacaaaagctcaccactaccgccacccccacccccacaaacctcgcctgcacgtcaccgataccgaggcgcagcccaggccggcaggcacttcccccgtctcgctctgcttgctgccccaccgcaggccaagaaagaagcgaaagcggcgacgccgtctccaatgccgcagggcgccgcggcggcggcctgagagtgcgagccgctctgtcgactgtcgaggtcgggcgggggaacgcattgcgatggcggagtcggctttggcggacgggaaggcggagaaggcggccagtggaggagggggcgatgcggcgggggaggggaagaagagggccgaccaggccgtggcgttccacgagctgttctcgttcgccgacaagtgggacctcatgctcatggcggcgggcagcctgggcgcgctcgcgcacggcgccgccatgccgctcttcttcctcctcttcggggacctcatcaacggcttcggcaagaaccagacagacctccgcaccatgaccgacgaggtcgccaagtatgcgctctacttcgtctacctggggctggtggtctgcgtctcctcctacgcagagatcgcgtgctggatgtacaccggggagcggcaggtgatcgcgcttcggaaggcctacctggacgccgtgctgcgtcaggacgtggggttcttcgacacggacgcgcgcacgggcgacatcgtgttcggcgtctccaccgacacgctgctcgtgcaggacgccatcggcgagaaggtcggcaactttatccactacatcgccaccttcctggccgggttggtggtcgggttcgtatcagcgtggcggcttgcgctcctcagcgtggccgtcatccccgccatcgccttcgccggaggcctgtacgcgtacacgctcaccgggctcacttccaagagccgggagtcctatgcaaatgcaggcgtcgtcgcggagcaggcaattgcccaagtaagaacagtgtactcttttgtcggagagagcaaagcacttaattcctattctgaggcaattcagaacacactgaagcttggttacaaagctggtatggccaaagggcttgggatcggatgtacttacggaatagcatgcatgtcttgggcactggtattctggtatgctggtgttttcatcaggaatggacagagtgacggtggcaaggcttttactgcaattttttctgcaatcgtcggtggcatgagccttgggcaggctttctcaaaccttggagccttcagcaaagggaagattgctggttacaaattgctggagatcatccgccagaaaccctccatagtcaatgatcataaggatggaaagtggttggctgaggtccatggaaacatagaatttaaggaagttactttcagttatccgtcaaggcctgatgttatgatctttagggatttctctctcttcttccctgctggtaaaactgtcgcggtcgttggaggcagtggttctggaaagagcactgttgtggctttgatagaaaggttctatgatcctaatgaaggccaggttttgctcgacaatgttgacataaagacactccaactgaggtggttgagagaccagattggtttagtaaaccaagaacctgctctttttgcaaccactatccttgagaatatactgtatggaaagccagatgccactgttgcagaagttgaggctgcggcgactgcatccaatgctcatagttttatatctcttcttccaaatggctacaacacaatggttggtgagcgaggcacccagctgtctggtggtcagaagcaacgtatagcaatagctcgtgctatgctgaagaacccgaagattctactccttgatgaagctaccagcgctttagatgcagactcagaaagcatcgtgcaagaagctcttgaccgtttgatggttgggaggacgacggtagttgttgcccatcgtctgtccactataagaaacgtgaacatgattgctgtgattcaacaaggccaagttgttgagactgggacacacgatgaactcctagcaaaaggaagcactggagcatatgcctccctggttcgttttcaggaatcagcacggaatagggatcttggaggtgcatctacccgcagatcacggtcaatgcacttgacaagctcactttccaccaaatctctcagcctcaggtctggaagtctaaggaacttgagctaccagtacagtactggagcagatggacgcatagagatgatctcgaatgcagataatgaccgcaaatacccagcaccacgtggttacttcctgaagctcctgaaattgaatgcacctgaatggccttatgctgtattgggcgccattggttccgtcctctcgggatttattggtccaacatttgccattgttatgggtgaaatgctggatgtgttctactacagggaccccaatgaaatggagaagaaaacaaagctatatgtgttcatctacatcggcacaggcatatatgctgttgttgcttatcttgtgcagcattacttcttcagcatcatgggagaaaatcttacaaccagggttaggaggatgatgttatccgcaatacttaggaatgaagtgggttggtttgacgaagaagaaaacaactcaagtcttgtggctgctcgtctagcagtcgatgcagcagatgtgaagtcagctatagctgagagaatatcagtcatcctgcagaacatgacgtcccttatgacttcttttgttgttggttttatcattgaatggagagtggcactccttatcctggccactttccctcttcttgtgcttgccaactttgcccagcaaatttcaatgaagggctttgctggtgacacagcaaaggcacatgccaagagcagtatggttgctggtgaaggagtgagcaatattcgcaccgtggctgcattcaacgctcaaagcaagatcttgtcactcttcagccatgaactgcgcataccagagcagcaaatccttcgtcgtagccagacatcaggtcttctgtttggactttcacagctatgcctgtactcctcggaggcgctcattctctggtatggttctcatctcgtccgatcacatggatccaccttctccaaggtcatcaaggtgtttgttgtccttgtggtgactgccaactctgtagctgagactgtgagcctagccccagagatcgtccgtggaggtgaatccatccgatccatctttggcatcctcaacagggcaacaagaattgagcctgatgatcctgagtcagagcgtgtcaccaccatccgaggggacattgagttgcggcatgtggactttgcctatccagcacgcccagacattcaaatcttcaaggatttcaacctgaagatccatgctgggcgtagccaagctctagtcggagccagcggttcagggaagagcactgtcattgctctcatcgagcgtttctacgatccgactgggggcaaagtcagtattgatggcaaggacatcaggaggctgaacttgaagtccttgcggctcaagatcggccttgtgcagcaggagccggtcctcttcgctgcgagcatcctagaaaacattgcgtatggcaaggatggtgcgaccgaggaggaggtgatcgaggcggcaaagacagcaaacgttcacggcttcgtcagccagcttcccgacggctacaagacggcagtcggcgagcgtggcgtgcagttgtcaggcgggcagaagcagcggatcgccatcgccagggcggtgcttaaggacccggccatcctgctgctggacgaggcgacgagcgccctggacgcggagtccgagtgcgtgctgcaggaggcgctggagcggctgatgaaggggcggaccaccgtcctggtggcccaccgcctctcgacgatccgaggggtggaccgcatcgccgtggtgcaggacgggcggatcgtggagcacggcagccacaacgagctcctgacccggccggagggcgcctactcacggctgctgcagttgcagcaccaccgtgtctgacggcgttgtgcaagtgcatcctctgattaatacatgatgatgacaccttcgttttggagactgggatggccgga

SEQ ID NO: 114 - DNA, 2294 bp, Zea mays
ccagcccaacttacagaagcccataaaatagtcatagcttctgtaactaccggcccaggaagccatccgctcctcttcgaacaatggatctacttctttacaggctatattagaatgtcggtggtccagcccaacttacagaagcccataaaatagtcatagcctctgtaattaccggcccaggaagccatccgctccctctcgaacattggatcctatgctctcctctccctgctcgcagtcagggcacagggactgcctccggagaccggagcaggccgcaagcgtccaggttcgagacgccagcacgctctcgcagtacagcagcattatcagggagcgtgccgtgggagtgggaggttgcctcaggtgcggagcagtcgccggcggcgaccatcggtgtctgagatgaaggagagaggcggctccagggcggcagtggacgagcgctacgcgcagtggaagtcgctcatccccgttctctacgactggtttgccaaccacaacctcgtttggccatccctctcctgccggtgggggccacagtttgagaaagctacctacaagaatcgtcaacgcctttacctatctgaacagaccgatgggagtgtgcctaatactctggttatcgcaaactgtgaagttgtgaaaccaagggttgcagctgctgaacatatctcgcagtttaacgaggaagcacgatcaccttttgtaaagaagtacaagactatagttcatcctggtgaagttaacagaatcagggagcttccacagaacagtaagatcatagccacacacactgacagtccagatgtacttgtttgggatgttgaagcacaaccaaatagacatgctgtcttaggagcttctgaatctcgtcctgatctgatattaacgggacaccaggaaaatgcagaatttgcgcttgccatgtgtccagcagaaccatatgtcctgtcaggaggaaaggacaaatttgttgtcttgtggagcatccaagaccacatatctgcccttggggattcctcgtcttctcccggagcatctggcagcaagcagtctggcaaaattgcaaatgaaaaggagagtcctaaagttgatcctagaggtatattccatggccatgacagtactgttgaagatgttcagttctgcccttccagtgcgcaggagttttgtagtgtgggtgatgatgcttgtcttattctgtgggatgctcgaactggcactgacccagctgttaaggttgagaaagctcacagtggagatgttcattgtgttgattggaatccccttgatgttaactatatcttaactggttctgccgataactctgtccgaatgtgggatcgtcgcaatctgggttcgggaggagctggttctccaattcacaaatttgagggccataaagctgctgttctttgtgttcagtggtcacctgacagagcatctgtttttggaagttctgcagaagatggtttcttaaatgtttgggaccatgagaaggttgggaagaagaaaaattctaatgtcccagctgggcttttctttcagcatgctggtcatagggataagatcgtagacttccactggaattcgtcagatccttggacaattgtcagtgtctcagatgatggtgagagcactggtggaggtggaacactgcagatatggcgaatgagtgatttgatctaccgcccagaggatgaagttcttacagagctggagaatttcaaggctcacctggccagttgcgctccgaggaattgagtcatgtgaaaactctgagtaggttatgtagtttcctggccataagtatggccccaattgacattggatctgtcttctcatgctcctagagctgtacccttcgaggtgcttgtgcctttgtgagcttgtgttgaaccatgttgtatgactaaatagtccgcaaacgagtcagctggatggctaatctgtaggccaactattgggatattgttggatattatcaacaaccggttcagattcgtgatgagattgtccgcaattgtttagttttgtgccttcgtgtgtgggtttacgttcttggcatatcgtttggtcaaaggcctattttctgcgtgcatttgcacatgaactaatagaacaaacagataaaccatttttttttcttgaaagcgcaggagaattgcgtgatattatattaaagaagagggacggcctctacggcggccagtaacagacatacagaaacccatccataactaaagaaaactaacaagagctaccacaatgctagctaactagtaggg

SEQ ID NO: 115 - DNA, 2531 bp, Zea mays
tagctaatcccaaatcccaatcgaatcgactcccccctgttcgtcggattctcttcctccgtccgcacccagctaacgccaccgaaaacagaaaatttacccgccgcccaaaaaaaaacagaaaggctaacctccttttttctctctctatctttctctccatctgtggacttctccggttttgtttgacgagatgcctgcgctcgccgtcgacgccgcgacacccgtggcgcacgccttcgcgtcctgcgacgcggcgcgcttccccgccccgcccgtggtgggccccgccgccgcggccgaggccgccccctggtcggccgacctctccgcggcgctctacaacgtggacggctggggcgcgccctacttcttcgtcaacgacgacggcgacgtggccgtgcgcccgcacggcgccgcgactctcccgggccaggagatcgacctggccaaggtcgtggccaaggccgcgggcccgcgcgccggaggcgggctcggcctgccgctgccgctgctcgtgcgcttccccgacgtcctgcgccaccgcgtcgagacgctcaacgccgccttcggctacgccgtccgctccaccggctacggctcaaggtaccagggcgtgtacccggtcaagtgcaaccaggacaggtacgtcgtcgaggacattgtggagttcggcgcgccctttgggttcggcctcgaggccggctccaagcccgagctgctgctcgccatgagctgcctcgccgcgcgcggcggcctggacgccctgctcatctgcaacgggtacaaggacgacggctacgtctcgctcgcgctcatggcgcgctccatgggcctcaacaccgtcatcgtgctcgagcaggaggaggagctcgacattgtcgtcgaggccagccgccgcctcggcgtgcgccccgtcgtcggcatgcgcgccaagctgcgcaccaagcacgccggccacttcggctccacgtccggggagaagggcaagttcggcctcagcgccgcgcagatactgtccgtggtcaccaagctcaaggccatcggtatgctcgactgcctccagctgctgcacttccacatcggctcccagatcccgaccaccgccctgctctccgacggcgtcggcgaggccgcgcagatctactgcgagctcgcccgcctcggcgcggacatgcgcgtcatcgacgtcggcggcggcctcggcattgactacgacgggacccactcggcgcagaccgacatgtcggtggcgtacagcctggaggagtacgcgggcgccgtggtggccgccgtgggccgcgtgtgtgaccgcaagggggtgcagcaccccatcatctgcagcgagagcggccgcgcgctggtgtcgcaccactcggtcctggtgttcgaggccttctcggctacggcgccgggacgcctggacgcggccacggcctacctcctcgacgagctcacggacgactgccgcgccgactaccgcaacgtgatggccgccgccgtgcgcggcgactacgacacgtgcggcctgtacgccgaccagctgaagcggcggtccgcggagcagttcaaggagggggtccttggcctggagcacctcgccgcggtggacgccttctgcgagctcgtcgcccgcggcatgggcgcgcccgagccgccgcgcacctaccacatcaacctgtccgtgttcacctccctgccggacatgtgggccatcgggcagcagttccccatcatcccgatccagcggctgcaggagcggcccgccgtcgacggcgtgctctcggacctcacctgcgacagcgacggcaaggtgagcgagttcatcggcgggaggcacagcctgccgctgcacgagctgcccacccacgccactcgcggctactacctgggcatgttcctcgggggcgcctaccaggaggccctcggcgggctgcacaaccttttcggcgggcccagcgtggtgcgcgtgtcccagtgcgacgggccccactgctttgccgtgacgcgcgccgccgcgggcccgtcctgcgccgacgtgctccgcgcgatgcagcacgagcccgaggtgatgtacgaggtgctgaagcagaggaccgacggcgccacggccgccgccctcgcccgggccttcggcgcaatgccgtacctggtgttcgaccccgaggccgccgtgatgtccggcggcgagagcagcgactcggagcggtcggccgccggcgccgccgaggaggaagacgatgaggagtgggagttcatgcgcgggctcaccgtctgatgacgtgcccgcccgcccgccccgggtgaaacaaggcgagtccgtcgccaggaagttgtcagtggccggccggcgttggtttacataataacccccaccgcccggtgttgtatcgtgtcgtggtcgtagtcgtcgggtgtctcgtcgtcgccggagttgtttggcgccacctttttattccgaacgcgtcagtgtccactgttcgcctttccttttttttctctctctttcatgggaataatctgaaggaaac

SEQ ID NO: 116 - DNA, 1981 bp, Zea mays
tccccctcaaaaactatccacccctccacggctccacccctacccgccgacgagcgcgatcgattgattcggttcgagccgggcggaggaggagggagcgccgcggggcggggtgagcccaccagatccgactaccgcagcggctatgatgaagtcgctgctgccgcagagccagctgcggcgctcggcggcggcggccgcgcggtcgtcggcgggcggcgccgcgggggcagacggggctatgtccgacggcggcggcgcggggccgcgggcgcccgcctcctccaccttctggttcctgctccacgcgctctgctgcctcatctcgctcttcctcggcttccgcttctcgcgtctcctcttcttcctgctcttctccaccaccgcgctctaccgctccagcacctcctcctcctcggccgcggtccttcgcgccaccaccacgacaaccaccaccacgaccaccacgacgacgacgaccaacaccttcacgctctccttcgccgccgccaacactcccccttccacccccgctaaccgcaccgcgctggatgtggccgacaagggggcggcgtccgggaacccacagagtcacgtcgtggtggggaggcacgggattcggatccggccgtggccgcacccggaccccgtcgaggtgatgcgggcgcaccggatcatggagcgcgtgcaggaggaacagcgccgctggtacggcgtcaaggagccgaggcaggtgctcgccgtcaccccgacctactcacgcgcgttccaggcgctccacctcaccggcctcctccactcactccgcaacgtgccgtacccgctcacctggatcgtcgtcgaggcaggcggcaccaccaacgccacggcgtcaatgcttgcgcgctctggcctcactttcgttcacatccccttccctgaccgcatgccccacgactgggccgaccgccacgccactgagaaccggatgcgcctccacgccctacgcgtgatccgcgagaggaagatggatggcgtagttgttttcaccgacgacagcaatgttcatagcatggagctgttcgatgaggtgcagaaggtccagtggatgggtgctgtatccgtcggaatccttgcgcatactggcacggcagaccaactacggctcagcgaggaggacaagcagaatatgcctcttccagtccagggccctgcttgcaactcctcagggcatctgattggatggcacacgttcaactcattgcccttctctgggaagacggccacagttgttggtgaagcagcccctgttctgcccaggggtttggagtgggctggttttgtgttgaactcaaggatgctgtggaaggaggctgacggcaagcctgactgggtgaaggatcttgatgctgtgggcgagaatggcgaggagattgagaacccacttactctgttgaatgatccgtcctctgttgagccactgggcaactgtgggaagaaggtcctactgtggtggcttcgtgttgaagcacgggctgatagcaagtttcctgaagggtgggtaattgagccacctttggaagtcgttgtccctgcaaagcgcactccatggcctgaaacaaccaccgagctgccagccgagttattggatgacaagcaagagcaggaggataggcgcttgtcaagagccaacaaatcatctcggccccgaggcaccacgaagcggaagggcgaccctcaaggacaagataactgatgcagaacgtactggccttgtgatgtatatcttacaccctgcaaaaacacagtagcaagcatatcctgttaatctggcggtgtctgtttaatttttcttttcttttctgatgtttttgctcctgtggcgatggtccacgcttgggtatgttatctgtagagggcacatttttaaagtagtggttgtatcttttgtgttgaaatgtacaatgcattgggagctaaaaaaatggtggatgaatactgg

SEQ ID NO: 117 - DNA, 4119 bp, Zea mays
agaaacccgaaacccttgtggtcgtctcggcacccctctccgcttcgaaacccccgacgcgaaggaagctagggaaccctcgcgagtcgcgttgcctcgcccccgtccccttcagctggcccgccgccgcctcgaatccgccctggctcggagggcctcgcgcccccacggatcggattctcgaggttggtggatttggggctagggtttggggattgactacaatcgtggggttgtttggcgtaatttgaggagcaatgtacaacatggttaggaagtggacctgaggaggacggagggatggtggcgatggagggtaagggggacgcgtcagtgacgccggtgaggactagtgaccggctgcggcagcgtccaaagtactatgctcgtggctatatgtactacaatccagccatgaggaagaaggttaagtctaagaagcgaactgctgcatcacagattgctaagaaactgcttcgcaagccagctgcacggccaccacctgccgattgtgttgcagcaaatttgcgccgttcaacgagaaagcgaaggatttctgtaaatctggagggctatgatacagatagttccagtatggaagatgacgatcttatgagacctagatatcgatcttcaaagagtaaggggggaaacaatgctgcacataatgaagtgtcagctagaccaaagcgccagaagttgtctaactccatacctcgtcgtgaaggtttacggcctagaagatctttgcgaggacaaagactgcatccataccatgaatctgaggatgaccaggaaagctctgatgaacaaggtgcagaagatcaaagagaaaatggcaatgagattgaagaggatgttggtgatgaggaggaggttgatggaggtgatgaagctgaaggagatggagatgacgaagatggtgaggaagagcaagaaggaaggaggagatatgatttaagggaacgttcagaggttcgtagaccatcccctcgtaaggaaggaaagcacagaccacaatctcctcgtagagtactagttcacggaattggtccaaagaacagcaagtatttaaaaaaaggtgggtcgcgcatgcataagcgccctcgtttctctttgccagatgattcagatgattcccttcttgtggatgagccggacgagggcccatccatgccatggatgcgcagtgggaggggaagtatgccatggttgatgggtgggttggacatgcatagtccagcagcatggggcctgagtgttggagcatctggttggggtcatcagggtgacacttctacttcactcatgcctggggtgcaaactgctggaccaagttctaagggaggagccgacattcaacctctgcaggttgacgagaatgtgagctttaaagatataggtggactttcggagtacattgatgctctaaaggaaatggttttctttccattattgtatccagatttttttgcaaactatcacatcactcctcccagaggtgttctgctttgtggcccaccaggcacaggaaaaacattgattgcccgtgccttagcctgtgctgcctctaaagctggccagaaggtcagtttttatatgcgcaaaggagctgatgttcttagtaaatgggtgggtgaggctgaaaggcagctaaagttactttttgaggaagctcaaaagaatcagccgtcaattatattttttgatgaaatagatggcctggcacctgtgaggtctagcaagcaagagcagattcacaattcaattgtttcgacattgcttgctttgatggatggccttgattcacgtgggcaagttgttttgattggagcaactaacagaattgatgccattgatggagcattgcgtagacctggccgatttgatcgtgagttttattttcctttacctggctatgaggctcgagcagaaatactggatattcatacaaggaaatggaaggatcctccaccgaaggaactaaagatggaacttgctgctagctgtgtgggctattgtggagctgatttgaaggcattatgtacagaagcagctattagagcatttagagagaagtatcctcaggtctacactagtgatgacaagtttgtcattgatgttgattcggtcagtgtcgagaagtaccactttttggaagctatgtctacaataactcctgctgctcacaggggatctattgtgcattcaaggccactttcaacagttatcgctccatgtctgaagagtcatcttgagaaaataatggaacatatttctgatattttccctttcctttcatccatagattttagcaagttctctgctctctcctatggatcttccatccctcttgtttatagacctcgccttttgatatgtggtggtgaaagtgtcggactggatcatgtgggaccagctgttttgcatgagcttgagaagttctctgttcactctttgggactgccgtctcttctctctgatccaagtgcgaagacacctgaagaagctcttgtgcatatctttggggaagccaagagaacaaccccgtccattctatacatacctcagttccatctttggtgggatacggcacacgaacaactaagggctgtgttgttgactctgttgaacgagttgccctccaaccttccagttttattgcttggaacatcatcagtggtttttactgaccttgaagaagagtgtgcttccatattctcttctcgcaatgtgtatcaagtggatcaaccaagttttgacgatagattgaggtacttcagtatattgtttgagtcattgctctctttccaaatggaagaatcaagaaacaagtcaaagaaacagaagtctgctattgaccttcccaaagccccgaaagaagtggagggccctaaggtttctgagctaaaggctagggcagaagctgagcagcatgctgttcgtcgaatgaggatgtgcctccgagatatctgtaatcgcattttgtacaacaaaaggttcaatgtatttcacttcccagtattagaagatgaggtgcctgactatcgatcaataatccacaagcctatggatatggctactgtcttgcagcgggtggactctggacagtaccttaccagggcagcatttataaaggatattgatcttattgtctcaaacgcaaagacttacaacggggatgactacaatggatctaggattgtcagtagagcatgtgaactcagagatgtggtccaaggcatgttgtcacaaatggacccatctttggtgtccttctgtgataaaattgcttcacaaggggggccactgcaggctgtggatgatgaagatagagctattcttcaagcagcacctgttgctcagctggtttctggtactagaataagtgcaaggcttcgaaatgtacagcctgaagtaaacctgtcacaaagttatgaagtgctaaggcggcaaaagaaaagtgcagaaaatgaacaaagcatgactagagatgaaaagtctcctgaagatgtagatttgtcgaagccaactgacgcagaagaagctgcaaaagaaccagagtcaaatggcactacgaaagaagccaacgattcaccagccaaagaaccagaagtatctacttcccctgaacccatggagagtgacaacggcaaaattgccgcggctactggcgacgacttgttagaacagctagaagccctgaagcaacgcttcatggaactcactgcaagctatggcgtgccgcagctcgagaggctgtattccaagataatgaaaggagcaatagagttgacaagtaaagaaagcaacgaggatcataggcggttagtagttaggtatttgtggacattcgttgagaacagcaacaatttttaacctggcgccaataagattcttgttttccttgtacatcctctttggaacgaaacaatagtagccgttcatcttgggagttgtccccgttccatgccttgtaacaaatcttccaaatgctctagtgtcagtgacacagttttgccatgaaatgatgtagcaagtgaacccttcctagatttgtacctcagtttgatgaatttatgaggtggaattccctcttaatgcataacatgtgttacc

SEQ ID NO: 118 - DNA, 4300 bp, Zea mays
ctggcctaatctgcaccgtagcagtccatccgtcacggcgccaccacctctacctccttccctcaccttccagagcccactgctcctcggcggcggcggagatgagcgtgtggaactacgtcgtcacggcgcacaagcccaccagcgtcagccactcctgcgtaggcaactttaccagccccaaccagctcaaccttattatcgcgaaatgtacccggatcgaaatccatttgcttacccctcagggcctccagccgatgcttgatgtgcctatatatggaagaattgcaacgattgagctcttccggcctcataatgagactcaggactttcttttcattgctacggagaggtacaaattctgtgttctgcaatgggatgcagaaaagtcagagctaatcaccagagccatgggtgatgtttctgatcgcattggccgccctactgacaatggacagattggaatcattgaccctgactgtagactcattggtcttcatctctatgatggcttatttaaggttataccatttgacaacaaagggcagctgaaggaagctttcaatatcagacttgaagaacttcaagtactggacatcaaatttctacatggttgtgctaaacctactattgttgtcctctaccaggataataaagatgtgaggcatgttaagacttatgaagttgcactgaaggacaaagattttgttgagggtccttggtcccagaataatgtagataatggtgctggtttattaataccagtaccagctccacttggcggtgtgataataattggcgaggaacaaatagtttactgcaatgccaattccacatttaaagcgataccaataaaacaatccatcatcagagcttatggacgggttgacccagatggttctcgatatttactcggtgataatactggaattttgcatttacttgtccttacccatgaacgagaaagggttactggtttgaaaattgaatacctgggagagacttcgattgcatcatctatttcgtatcttgataatggtgttgtttacgtcggttcacggtttggcgattcacagctggtgaagctgaacctccaagctgatgcaagcggttcatttgttgaaattcttgaacggtatgttaatcttggaccgattgtggacttctgcgtggttgaccttgataggcagggtcaaggtcaggtggtcacttgttctggggcgtttaaagatggttcccttcgggtggttcgtaatggtatagggattaatgagcaggcttcagtagaactccaaggcataaagggattatggtcattgaaatcttcgatcaatgatccatttgacatgtaccttgtcgtgagctttataagtgagacacgattcttggcaatgaacatggaagatgaactagaagagactgagatagaggggtttgatgcacaaactcaaactctgttttgtcagaatgcgatcaatgatcttcttatacaggttactgctaattctgttcggttagtcagttgcacctcccgggagttagtgaatcaatggaatgcaccagcaggattctcagtcaatgttgcttcagctaatgccagccaggttctgttggcaaccggtggtggccatcttgtttacctggaaattagggatgctaaacttgttgaagtgaagcatgctcagctagaacatgagatttcttgtcttgatttgaacccaattggggagaatccacaatatagttccctagctgctgttgggatgtggacagatataagtgttagaatattttcgcttccagatcttgaattgataaggaaggaaaatttgggtggagaaattgttcctcggtctgttctgctgtgcaccttggagggggtttcgtatttgctttgtgctcttggggatggtaatttgttcagttttctactgaatgcaagtacaggtgaactgactgatagaaagaaggttaccctcgggacccaacccatcagccttcgtaccttctcatcaaagggtaccacccacgtgttcgcttcgtcagataggccaactgtcatctatagcagcaataagaagcttctctacagcaatgtcaatttgaaagaggttaatcatatgtgccctttcaatacagccgcttttccagacagtcttgcaattgctaaagagggtgaactttcaattggaactatcgatgatatacagaagcttcatatccgcacaatcccccttaatgaacaagcacgtcgcatttgtcaccaggagcaatcaaggacactagcattttgcagtttcaagtacaaccagagtgtggaggaaagtgagactcatttaatacgtctgctagatcatcagacgtttgagtccctgtgtgtatatcctctagatcaatatgaatgtggctgctccatcattagctgttcgtttgcggatgatagtaatgtttattactgtgtgggaactgcatatgttatacctgaagaaaatgaaccgacgaagggccggattcttgtatttgcagttgaagatggaagcttgcaattgatcgtggagaaagaaaccaaaggagcagtttattcgctgaatgcattcaatgggaaattgttggctgctatcaaccagaagattcaattgtataagtggatgtcacgcgaggatggttcacatgagctgcagtctgagtgtggccaccatgggcacatacttgccttgtatactcaaacacgtggtgacttcattgtggttggcgatctgatgaaatcaatatccttgctggtgtataagcatgaggaaagcgcgattgaagagcgtgctagggattacaatgcaaactggatgactgcagttgagatgcttgatgatgaagtctacgttggggcggagaatagctataacctattcacggtgcgcaagaacagcgatgcggcgacagatgacgaaagggccaggcttgaggtggtgggagagtaccaccttggggagtttgtgaacagattccgccacggttcactggtgatgcgccttccagactcggatatagggcagatccctacggtcatctttggcacaataaacggggtgattggcattattgcctccctcccgcacgaccaatacatcttcctggagaagctccagtcgacccttgtgaagtacataaagggcgtcggaaacctgagccacgagcaatggcggtccttccataacgacaagaagacggcggaggctcggaacttcctcgacggtgacctgatcgagtctttccttgaccttagccggagcaagatggaggaggtgtccaaggcgatgggcgtccccgtggaggagctgtccaagagggtggaagagctgacgaggcttcactagtgtagatggaacatggaagcgttgcttgtaagcaagtagtaacttgttccctgagctgtagcctccgcggctcgcacgatcaaagtgttcggccgtggctgcagtctatcctatgctatatcctatcgtgatttgtttgtttgagctgtgccagtttcttttctttattattaatgcttaatgttaaaattagtggtgaatcctgtgatggtcctaactgataggtgggtcggcgtgagccagtaacaaagggatgtgctgaatgagacggccgtcttgtcttgtggtaggagagttgagatagtggcccaaccctgtccatgaggcatagtccatcccctgtccatttcatagtagcacctccagcaggcagcagcctgcagcccagcccctagtttgatcgatttgaacctgccgctgcgagtccacagcgctgcgcaggcggcactgcggcaggctcttcctccctctcctctctctctgtctgagccgagggctttggcgctcccccccccccccccccccccctctctctctctctctctctcgcacgggcccgcctgcctatcccactgcccggtccaccgccgcaaactctgcccgcccgcgcgcgccccaccccgccgatcgcggtgagcccggactccgccgccgccgcttcgctctaccctgaccagccctagatctgtgcgggatccgccgccatgttctggcgcatgaccggcctctccgcggcctcgcccgtggatacaattctggacaaggagaactttacattggaagagcttcttgatgaggatgaaatcattcaggagtgcaaagcgctgaatacccgactcataaatttcttgcgagataaggcccaagtgtcgcaattacttcgttacattgtggaagaagttcctgaggattcagagaagaaacaatct

SEQ ID NO: 119 - DNA, 2305 bp, Zea mays
actactggacgtcgccggcgccctacgccaggtcttcgccattccattctctggagacaagcacccaacagataccgatcaggcattcaagaagtaaattcttcttctattgtgctgaatatatctgattctacatggctatggtgccaagtgattcatcacatcatggagctgtggacaatagccctaatggattcacccagggtcggcgtgaggaagctaggaaacttgggccatcatggtatttcagtagaaaggaaatagaagaacattctccatccaggagggatgacattgatttgaagaaagagtgtagccttcgaaagtcgtattgcagttttctacaagatttgggcatgaagcttaaagtgccccaagtgacgattgctacagctacggtattctgtcaccgttttttccttcgtcaatcccatgcaaagaatgatagacgaataattgccacagtttgtatgttcttggctgggaaagttgaagaaacacctagacctttgaaggatgttatcctggtatcttacgagcttattcataagaaggattctacagctggccagagaatcaagcagcagaaggaaatatatgataaacaaaaagaacttattttactcggggagcgaattgtacttgtaacacttgggtttgacctgaatattgaccatgcttacaagcccttggttgaagcaataaggagattcaatgttggtagtaaaagttcgcttcctcaggttgcctggaattttgtaaatgatggactgcgtacttcgctttgcctgcaattcgagcctcatcatattgcagcaggtgctatctttttggctgctaaatttctcaaagtgaagcttccatctgatggtgataaggtttggtggcaggattttgatgtcacaccacggcagcttgaagaagttagcagtcaaatgatggagctgtatgttcagaaccgtacaccacaggcacaacaatcacagggaagcgaagctgaggggagctctgctggtgtgcgtaatcaacattcatctgtaaaatctgaaggaaactccaaggaaccatctgctcatggatatcatccggcattcaaaccgtcgaatttgcatcattcatccttggcaggtgctccaggtgaccatgacagtgggcattcaaattcagacaagcatgtttctggccacaaaatgcttcaaaatgataatggtaaccatgtcggtagcaaagaaaagaacaagagtggaggtaaatcggatgctggtatggatagattttgtcatgagaaatccccacctggacatcattattccaaggtcagccatgagtctcataatccagtggaagaacaaaaaccacatcaatcacatgataaccccaatgaaagaatagatggcattcttggtggcaacgaagttcctggtgtgtcgacctccaggatcgatgcaatgaataaaattgacaagggtaaggtaaaagcagctttggagaagcgaagaaaaacaaaaggtgatattaccacaaaggtagacgtgatggatgatgatgatctacttgagagagagcttgaacatggtgttgaattggctattgaggatgagaagattaagcaggataagatgcagaacttgtcccatattaaggacaagaagattacgcaggataatatgcagaacttgtcccatattaaggacgagcaggataacatgcagaacttgtccgacattaaggatgagaagattaagcaggatgagaggcagaacatgtcccatgctccagtggatcttcaaaccactgaccaagtaatggagaatggtcaccatgtcgagcctagtgtaccaacaactgtggaagacacggggtttccattggacaacaaagaacatcctccatttgataagcaaaatgatgttcctgagcacgagtcccagcagcttgaacacacattgaagcacgacctccctcagctggtaggggggcctgagcaggatgatggaacagactgtaaaaggcctaagctcgaagagtaggttctggatgatgctcactttattttggacagttttcctggagactggtgaactgcatacaacttggcacggagttggtgagcatggctttgccggtgccttgctgtgctgtgaaatatgccctacggctgattgcagtttacaattcgagggaggtcgtgctagcaaatatttttacgttcaaacgaacattggaatatatggaccaaaacatgctcacgcttctgataacggttgcattcgttccttaaatatgtgttccatgaaagtgaagc

SEQ ID NO: 120 - DNA, 4937 bp, Zea mays
gtcaaacatgttgctttttagccgacttttatgaaaaccatttatgtaaaaatcgcataaatccatgtaaagcaaaaaaccgatgagtcaccgtgatgggaagaactgaccgctttctaaaccctaaattatgtagatcctttgatcctctacacaccgcgatacgtgaaaatagattatatacaattcttgatttttagaaaattttctttagaaaaaggtgtatgcccgaaatggttcgattcaaaggctggtgcccacctccccacatgaggcgtgggcccttctcgccatacagagagactccctcacgaaaactcaccgtctcccgctctcgatttcgaaacactcgccactcttcgcctcccgaagccctgcgcctccccctccgccgctcgccgggcgagatgtccccgccgttcgtgttcccctcgaccctgcgggatctggagcgggacaccgacggagacagagacgaggagccctcgctccggccgcagaaccccgtcgccgtcgccacgctccgcgctgccgacctcgaggagttcgtcaagggtgcatcatttgatctttctgataaggagctcttctgcattgaggaacaggaggtgtttgatgccatctactctatcgtgcgtgatttcaattgcctacccccagcccttaagtttaacattgttgagaccttgcgctccaacctcagtgtccttctacccagcatagactcactttcccgggcatccatgtcatccccttctgatgctaccgaaatcactgaccgcattgcctcacaccgcaatgccctcaagatctactccttctttctcatttccattgttctcaccgcggaagctggcgctgaaagctgcacagcggctaaggcaacagcacatggtcgaaagaagaaccatatatattcttggaactgggaagcacaaagaggcaggatcatgagtctagtcgctaattctcttgaagctaacctttcgctactttttggtcctggaggaaccgatgaacgatatctctcttttgtttcgaagtgtacttttgttctctgtgaaaatcaaaatgtgttaaaagatgaggatacaagaaatggcctgtgccggataattggagcaattgccacgaagcatcagaggatttctcaaatcagtgcatctgtttcacatctaatacacaaatttgatttcactgttcctcatcttgcggaagcagttgcttctgcggagaaaaagtttggtgatggaagccttgcaatttccctgattagggaaataggtcgggctgatccaaaagaatacacgagagatagtgttggtgcggataatgttgggagattccttgtagaacttgcagaccgcttgccaaaacttatgtcaaccaacattggtgttctgatacctcactttggtggtgagtcatataagatcagaaatgctcttgttggagttttgggaaagctggctgcaaaggctttcaaggatgttgagggtgatagcaatgctcggcttcgaagtaagcaggctatgctggagattttgattgagcgctgtagggatgtgtcagcatacacaaggagtcgtgtgcttcaggtgtggtctgagctttgtgaagaaaattctatttcaattggcctgtggaatgaagtggcttccgttgcttcagggcgactggaggacaaaagtgctattgtgagaaaatcagcattacagcttcttataacaatgctgcaacacaacccttttgggcctcagttaaggactgcaacctttgaggcaactctagaaaagtacaaggaaaaattacaaggaatggagccttcaaattcagacaaagatgaggccgcaaatgatagttcgcctggtgaagtgatcatggggcaagatgaaagtgtcagtgatagctgtttagcatcaagtcaggatcaaaatgaccgtgatgctacgattgtggatataacaaacttggaacaaataagagctttagttgcttcacttgaagctggtctgcggttttcaaagtgtataacttcgttaatgccaattcttgttcagttgttggcgtcatcctcagctactgatgttgagaacaccatccttttactgatgagatgcagacagtttcagatcgaaggatcagaagcagcactcaggaaaatgttacctctggtgttttctcaggataagtcaatatatgaggcagtggagagtgcattcattactttatacacaaggaaaagtccaatagaaacagcaaaaagtttgttagaccttgccattgattgcagcattggtgaccttgctgctctcgagagcttaattagttccttagtttccaaagcagaaatttcatccagcatggtatcagcactgtgggactatttttgctttaacataaatggagtgagaccagtgcaaagccgtggagctctatctattctttgtatggctgcaaagtcgtctcccagcattttgggtaatcacttgcaagatattattgacattgggtttggacgctgggctaaggaagagcctctgcttgctagaactgcatgtcttgctttgcagagattatcagaggaagacaaggacaagctgataagtaataatagtagagtatttgctgcattgcaaggtttggtaacaagcttctcgattcctgagaaaatatggtatggagctgcagataaagctataagcaccatctataccctacaccctgcacctgaactttttgctactgagactgcaaagaagtctctcagttctgtattcagcgttttaggaacaaatgatgtgtcaaatggagatgaagctcagaatggtgcctctctgtcatcagtatcaccttcaaagctgggtagatttctttttgttattagccatatagcactaaatcatttggtgtacattgagaattctgttaggaaaattcagaaacagaaacggaagaatgaaaaatctcagcccaccactgaggatctccaacctgacgtgtctaaaagtttggaggcacaaggcataaatgccgaactgggacttagtgcaaccatagatattgcaatcgagtcccttgctgaaagagcagaaaaggaaattgtttgctgttcttctgaaaagaatctcataggacattgtgggccatttctctcaaaactctgcaggaatcttgcattgctgcaaaagttcccagaccttcaagcttctgcaatgcttgctctttgcaggctaatgatcattgatgcagagttctgcgaagcaaatcttcaaatcctgtttactgttgctgagagtgcgccttctgaaactgtccgatccaattgcactatagcccttggtgatttagcagttcgcttcccaaatctcttagatccttggacagagtatatatatgcccggttacgtgatccttcagtgtctgtgaggaagaatgctgtgctggtcatttctcatcttatattgaatgatatgatgaaggttaaagggtatataaatgaaatggctgtaagaatagaagataaagatgagaggatatcaagcctggcgaaactcttctttcacgagttgtcaaagaaaggaagcaacccaatttataatcttcttccggatatcttgggtagactatgcaatcaacacctcaaagaagaaacattttgcaatattatgcagttcttaatcaactcaattaagaaggacaaacaaatggaagctcttgtggataagctgtgcaataggtttgctggagtaaatgatgtcagacagtgggagtatatttcttattgcctttctcagctaaccttcactgaaaagggcctgaaaaaactcattgataattttaagatgtttgaacatgcattatctgaagattctgtgatgaaccacttcagaagcgtaatatcaaagtgcaagaagtttgcgaaacctgagctaaaaatttgcattgaggaatttgaggagaaacttagcaaggttcatcaggaaaagaaagagcaggaggaaacaacaaaaaatgctgaggcacacagacagagaattgattcgcttgatgaatttctggttactaaggaagttagtgagaacagtgggaattctgctgaagatgaaactagcgaggtagttgatccttctgtggatagcagcacggaacatatggagaacacgccagaatgcagtgtcaatactagtgctgagaattctcagacaacagccccacttacagaatcagaaggtggcggtgaagagattcaatccgcacaacctgttagcaaaggcatgtcacggttaagggcaaagaaaaccagagatcctgttgtagatccttcggtggaccgcagcaccgaatataaggggaacacgccagagcacagtgcggatactagtacggagaattctcagacatcagccccacttacaggaacagaaggtggcagcgaagagattcaatccacacaacctgttggcaaaggcgtgtcgcggtcaagggcaaggaaaaccagagaccccgttgtagaggactcagcagctccagtgagacgcgccacgcgttcaaccagaagacaaggaagctgatggtgcagcaaagcggcagctcaagccattccgtgccgatctcgcctcgaggtcccggagtactggaccacagcaaagcggtgcctggacgtctggatcggagagttggctggctctatcctttttgcgtgatgcgtgtcggtctagttttagctcgctgattcccggacaggccaataatgatctcccgtgaatctgtctaggggcagtacgtttaactgctccatacgaggagctcttgtgtttggttgttgcagtaggtcggctttcatatggattgtctactacagacattgctcccttggggagcgtatgtataatatctggcctgatctttttgaggcctgatgacgctatgatatt

SEQ ID NO: 121 - DNA, 1391 bp, Oryza sativa
cccctcctccccacacgccacccgcacgcgcgccatggacgccatgaggcagagcacgccgcgggccatgctgctcctgtgcgccgtgctgatgctggccgtggcgccgccgggcgcggcgacggcggcggcggtggccgggtgcgagtgcggtaatgcggcggcggcggcggtggcgggggaggacgcgcgcggggcgttgcggctcaagctcgtcgccatcgcgtccatcctggcggcgggcgcggcgggggtgctggtgcccgtgctggggaggtcgttcgccgcgctccggcccgacggcgacgtgttcttcgccgtcaaggcgttcgcggcgggcgtcatcctcgccaccggcatggtgcacatcctccccgccgcgttcgacgcgctcgcttcgccgtgcggcggaggcaggggcggcggaggcgggttcccgttcgccgggctcgtcgccatggccgcggccatggccaccatgatgatcgactccgtcgccgccgggtactaccgccggtcccacttcaagaagccgcgccccgtcgacgaccccgccgacgccgcgcgcgccgccggggtcgaggagggcggcgccgagcacgccggccacgtccacgtgcacacgcacgccacgcacggccacgcccatggccacgtgcactcgcacggccacggccacggccacagccacggcagcgcgccggcggccgccacctcgccggaggatgcctccgtcgccgaaacaatccggcacagggttgtctcccaggttctggagctgggaatcctggtgcactcggtgatcatcggggtttcgctaggcgcatcactgaggccgtcgtcaatcaggccactcgtcggagccctcagcttccaccagttctttgaaggcattggccttggtggctgcattgttcaggcaaattttaaggcgaaagcaacagtgatcatggcgactttcttctccctcactgctccggtgggcattgcactggggatcgcaatctcatccagctatagcaagcacagctcgaccgcacttgtcgtcgagggagtcttcaactctgctgcagcagggatactgatctacatgtccctggtcgatctcctcgctgcagatttcaacaatccgaagcttcaaacaaacacaaagcttcagctggcagtatacctcgccctcttcctcggcgctgggatgatgtctctgcttgccatatgggcatgagatcttcagagcaaccaagagctgcaaatttttgaatattgtctctgaaaaagacaccctgagcttagtttgtagctgacagggtttgatgttgtcatagcattactgcaaccagcttttgtagaatctccatcaaccagaattggagaaaaagatggcctgaata

SEQ ID NO: 122 - DNA, 2152 bp, Oryza sativa
aaagcccacgcgagcccatcccctgcagtagaagaggaggcggcgagcgagcgagacgccgagccgagcagcgccgcggaggcgtcgtcgtctccggtgggttgcaggaggcgaatgcgatggggtccaagacgaaggggtgctgcgggtggctgatcgtggcgctggtggcgtcgctggtggcgacggcggcggtggtggccatcatgaagaagaaggtcggcggggggagcgggcgcaagctcaagccgctgccggtgcccggcccgcccggggccatcgactccaagtacggcgacgcgctcggggtggcgctccagttcttccaggtccagaaggcggggaagctggagaacaaccagatcccgtggaggggggactcggcgctggatgatgggaaaccagcggggctggatctttccaagggaatgtatgatgctggtgatcatatcaagtttagtttcccgatggccttcacggcaacggtgctctcgtggtccatacttgagtatggagatcagatgagcgccgcgaagcagctggaccctgcgcttgatgctctccgatggatcactgatttcctcgtcaatgcgcatccatctgacaatgtgttctacattcaggttggtgatcctgatctagatcacaactgctgggaaaggccggagactatgtctgagaaaagaccactcacacagattaacacaaagtctcctggatcagatgttgctgctgaggcagcagcagctatggcatcagcatcaattgttttcaaatccagagacactacatattctgattcacttcttcaacatgctcagaagttgtttacttttgctgatacttataaaggcctcgccagtgacacctatccaaagctccaaaactactataattctactggttatcaagacgaactcctgtgggcagcgagttggctctatcatgctacaggagaccaaacatacctcagttatgtgactgtagagaatggaaaagcttttgctgattggggaaggccaacatggttcagttgggatgacaaacttgcagggacacaggtgctcttgtcaagattaaatttctttggatccaaacagacatctaatgctgaaaacatgggactcaaaatgtacagagacactgctgaagccgtcatttgtgggctcctaccagattctccatcagctactgccagtaggactggtgggggattggtgtggataagtggatggaattctctccagcatgccacaaatgcagcattccttgctgttgtttacagtgactacatgctcacatcacaaacagcagcagtgcaatgcagtggaaagtactacagtcctacagatatacgcaattttgctatatcacaggctaattacatcttgggagacaacccaatgaagcttagctacctggttggatatgggagcagctacccacagcaggtacaccacagaggggcgtcgatccccgctgatgcaaagacaggctgcaaaggattccagtatcttcattctacgagcccaaacccaaacgtcgccatgggagccctcgtgggcgggccgttccagaatgacactttcgtcgactctcgggacaatgctgttcagacagagtcaagcacttacaacagcggcaccctcgttggtcttctttctggtctggtcacaacttcctctgtggcgcagtcgttcacctagagctctctcagagtttgggcaatggctttgaccaaccgggaggatatacatgtagccatgtacaatgagagatttttggcgtgaccaaaggcaatgtgccatcagcgaaacgccttcacggtgttcttcgttgttcatcttttgggtgatgggtggttagcagtagtagttcttgtgccatagtgctattgtttatacaaatactgctgcgtagttgcatccggtttgctggtgtactatctgatactacgagtgttgtatttgtaggacggattccatttgttgattctaaaatgatctctggtagcttgtattgatgatctgtaaaatccctcccaagatgaacattgcactgaacatgtgagatcacatggggagagggaagtattaatccagtttgttcagtatgttcatacataaattggacatcttttcagtatggttca

SEQ ID NO: 123 - DNA, 2310 bp, Oryza sativa
ccacactacaacggcaacagtagtagtagtacctgattatccatccctaacaaatcccacttccccacacacgccaaaagcctctcctctcctttcctcctcctccagtcctcctcactgtccgtcccaagaaccactcggtgcagccgccgccgccgccgcagccagtgccattgcaagaatcgcgagggggtattgaggttgggcggcgagatgagcatgtacgggagggacccgtggggcgggccgctggagatatgccacgactcggcgacggacgacgaccggagccggaacctggacctggacaggggggcgctgtcgcggacgctggacgagacgcagcagagctggctgctggccgggccgggggaccagggccggaagaagaagaagtacgtcgacctcggctgcctcgtcgtcagccgcaagctcttcgtgtggacggtcggggtgctcctcgccgccgccgtcttcgccgggctcgtcgccggcatcgccaaggccatccccaggcaccaccgcccgccgccgccgccggacgacttcaccgtcgcgctgcgcaaggcgctcatgttcttcaatgcccagaaatctggaaagcttccgaagaacaacaatgtgcattggcgtggtaactcgtgcatgaaggacggactctcggatccggcagtcgggcgcagcctcgtcggagggtactacgacgccggcgacgccgtcaagttcaactttccagctgccttctccatgaccctcctcagctggagcgtcatcgagtacagtgctaaatacgaggcagttggggaacttggccatatccgtgataccatcaagtggggggccgattacttcttgaagaccttcaactcaacggcggataccattgatcgtgtcgttatgcaggtggggagcggtgcaacatcacccggttcgactcaaccgaacgatcactattgttggatgagaccagaggacattgactaccctcgcccagtagttgagtgccatgcttgttcagatcttgcggctgagatggctgcatcattggcagcagcatcaattgtgttcaaggacaataaggcgtactcgcagaagctggtacatggtgctaccaccctcttcaagtttgcaaggcaaaaccgtggaagatatagtgcaggtggttccgatgctgcaaaattctataactcaaccagctactgggatgagtttgtatggggtggttcatggatgtatctcgcaaccggcaattcatcgtacctgcagttggcaacacaccccaagcttgcaaagcatgctggtgcttactggggtggtccagactacggtgtattcagctgggacaataagcttactggtgcacaggttcttttgagccggttaaggctcttcttaagtcctggttatccatatgaagagatcctcaggacattccacaatcaaacaagcattattatgtgctcttatcttccaattttcaagtctttcaacaggacaaaaggtggtttgatccagttgaatcacgggaggccacaacctcttcagtatgtggtgaacgctgcattccttgcttctttgtacggtgactatcttgaggctgcagatacccctggctggtattgtgggccccatttctacccaattgaaactctgcgcaattttgcaagaactcaaatcgaatacatcttaggaaaaaatcctttgaagatgagctatgtggttggttacggaaaccgttaccctaaacgtgttcatcatcggggtgcctcgatcccaaagaatggtgtccactacggttgcaaaggaggttggaagtggagagaaaccaagaaaccaaaccctaacatcatcgtcggagcgatggtagctggccctgatcgccacgacggcttcaaggatgttcgcaagaattacaactacacggaagcaactctagctggcaatgccggtctagttgcagcattagtagcattgtcaggtgaaggccatggcgtggataagaacactatgttttctgccgtgccgccgatgttcccttcgcccccaccgcctccggcaccatggaaaccatgattggctgccactatctgattctgattcattttgtatacggcttatttagattagtgtttttctcccttgttctggaaatgctgggggaaacctaacagaaaagaaggcgtcaggtttttatctttgtttctcccattgttgtatacttgtataatccccatgttatgtaacactattgctgttctggtatgaacctagtaattaatactatctttcctcgtggatttgtgggagtta

SEQ ID NO: 124 - DNA, 1600 bp, Oryza sativa
gggcgtttttcctttcccttctcttcctctctttctcccccacacgcatccatcaccaaccgaacggccacatttaatcccaccaccaccgcctcctcctcctcctcgcgcggccgcacccgatcccaatccacgcctcgcctcgccgcgatccacgccgccggtggtggcggtggaaggaaggaaggaaggatgctggagacgaagccgccgtcgccggggacggcgggggcggcgggggtggcagggggtgggtaccatcggaggtgggcggcgccgctgctggcgtccgtgctgctctcgtcgctcctcatcgcggcgtccctcttcttctcttcgtcgcgggcgctcctcctctccttctccccgctcccctccgcggcatccgccgagccgctcttcgtcgaggccaagctgcgccagcagcagcagatgcgcggcgcggcggcgtcgggcgggcgcggccgcggcgccgtgccgaggatcgcctacctcgtgtccggctccgccggcgacggcgccgcgctgcgccgcacgctcagggcgctctaccacccgtcgaacatgtacgtcgtccacctcgacctcgaggcccccgccaccgagcgcgccgagctcgccgccgcggtgcgcgccgacccggtctactcgcggttccgcaacgtcaaggtggtcacccgcgccaacctcgtcacctaccggggcccaaccatggtggccaacacgctccacgccgccgccatcctcctccgcgagggcggcgagtgggactggttcatcaacctctccgcctccgactaccccctcgtcacgcaggacgatctgttgtatgttctatctgacttgccaaggcaacttaactttattgagcataccagtgacatcggatggaaggagtatcagagggcaaagccggtgataattgaccctgggctatacagcctgcagaaatctgatgttttctggattacagagaaaagaagtgttccaaccgcattcaagctcttcactggctcggcgtggatgatgcttactcatcaatttattgaatactgcatatggggttgggacaatcttcccaggacggtcctgatgtattatgccaattttctttcttcaccagagggttacttccacacagtcatttgcaatgtcccagagttccgcaacaccactgtgaatcatgatctacatttcatttcttgggacaacccaccaaagcaacaccctcactacctcaccctcaatgactttgacggtatggttaacagcaatgctccctttgcaagaaagtttggaagagaagatcctgtactagacaagatcgaccaggaattattgggccgccaacctgacgggttcgtgtcaggtgggtggatggatctgttgaacacgacaacagtgaaaggatcgttcactgttgagcgtgtacaagatctccgcccagggcctggtgcagacaggctaaagaaacttgtcacaggcttgctcacccaggaaggctttgatgacaagcattgcttgtgaaacttgcagtaatatgattctggggtaggttacactatcaaaattcgaggatgttgtgccattagctagtcat

SEQ ID NO: 125 - DNA, 1744 bp, Oryza sativa
tcctcctcctcctcctcctctcccttttctactccattccattccatctcctccacttccaccctcaggcctcagctcgccatcgccattgttgcaacaccaagtgtttgtggtcggaacgagatcgagcagcagccatccatggtgaggaaggagatgggcggcggcggcggcaggctcgcggcggagtaccagggcctggaggtgaaggtacccacgttcttccggtgccccatctccctcgacgtcatgcgctcgccggtgagcctctgcaccggcgtcacctacgaccgcgcctccatccagcgctggatcgactccggcaacaccacctgccccgccaccatgctcccgctcccctccaccgacctcgtccccaacctcaccctccgccgcctcatcgcgctctgggcctccacggccgcgccgtcgtcgccggcggcgccatcggctgttggccccaccccggctgctgcggcggcggagctcctccgccgggtcggggcgcccggggtggacccgtgcccggcgctgcgcaagctcgcggcgttcctgtctgacgacgacgtcgacgagttcgacaagaacgcgctcgcgagggccggtggcgcggcggagaccgtggcgtcggtgctcaggaggagggggaagggtgatgatgatgatggcggcgtggaggccgtcgaggcggccgtccgggtgctcgcggtgctcgccacgtcggactgcatcgaggaggagaacaggaggcgcgtcgccgccgtgctcgccgcggggggcgccgcgccgtcggtggcggcgtcgctggcgcgcgtgatgcggagcgggagcgggctcgaggcccgcgtcgacgcggcgaggctggtggagtcgctgctccgggacggcgcgcgcggcgccaccgcgccgggggtgagggcggcggtcgccgagtcggaggagctggtcgcggagctgatccggctcgtcggccccacggacgagaagggcagcctcgacgcgcaggccgtggacgccggcctctcctgcctcgccgccatcgtcgccgcgacgcggcgcgcgcgcgccgagatggtccgtctcggcgccgtcccggccgccgtgcgcgtcctggccacggaccaccacggcgggtcgcacgcccaggcgctgcgcgtgctggaggccgccgtggggtgcgcggaggggcgcgcggcggtgtgcgaggtggcggaggcggcgatcccggcggtggtgtcgaggatgatgaggtgcggcgggatgggcggcgcggaggcggcggtgtcggtgctgtgggcggtgtgccaccggtacagggaccggcgcgcggtggaggcggcggcggcgtccaagggcgggctgacgaagctcctcctgctgatgcagagcgggtgctcgccggcggcgaggcagatggcgtcggagctcctcaagatgttcaaggtgaacgccaagagctgcctcgccggctacgactccaagaccacccacatcatgcctttctaaaacccaaaaaaaaaaagagaaattcaaattctccattaatttgtcagcttcgttcgatagagaggaaaagaatcgagactggagaaagacaaacttgtacatggttagagaaatttttcctagaaagaaacagatcaaatttcttctttgttctttggccaaaattcagtactgccatgatgtgttcaaacaaattcagtgttgcaagggaagggcagaatgactttcatctttgcat

SEQ ID NO: 126 - DNA, 2200 bp, Sorghum bicolor
ctctgctgcgctaataagcgccaaccaacccaccacgggcggcactgccactgccacaaaccaactacctaccactccggcagtccggccggctagctccataaaagcaaagcgcagccggccggccgggagcagcagccagccatggagacggcctccttcctctcggtggcgctggccctggcggccctcgtccccgtctcgctgctcctcctgaaccggctcctctacggcaagctgcccccggggccgcggcggcggcccgtggtgggcaacctgttcgacgtgcggccggtgcggtgccggtgctaccaggagtgggcgcgccggtacgggcccatcatgacggtgtggctcggcaccacgcccacggtggtggtgtccacgtcggagctggcaaaggaggtgctcaagacccacgaccagcacctcgccgaccgctgccgggaccgctcgtcggagaggttcagccgcggcggccaggacctcatctgggccgactacggcccgcactacatcaaggtgcgcaagctctgcaacctcgagctcttcacgcagcgccgcctcgaggcgctcagacccatccgcgaggacgaggtcaccgccatggtcgagtccgtctacaaggccgccaccgcgccgggcaatgaagggaagcccttggtggtgaagaaccacctgtcgatggtggccttcaacaacatcacgcggctggccttcgggaagcggttcgtgaacgcggccggcgagctggacgagcaagggcgcgagttcaaggcgatcgttcacaacggcatcaaggtcggcgcgtccctctccatcgcgcagcacatcccgtggctgcggtggctggccccggtcgacgagcaggccttcaaagcccacggcgaccgccgcgaccgcctcaccgtgaagatcatggaggagcaagccaaggccctcaagcagcacggcgcccagcagcatttcgtcgacgcgctcttcactctcagggacaagtacgacctcagcgacgacaccgtcattggcctcctctgggacatgatcaccgccggcactgacacgacggtgatctcggtggagtgggcaatggcggagctgctgaggaaccccagggtgcaggagaagctgcaggaggagctggacgatgtcgtcggccgcgaccgtgtcctgtcggagacggacttcccgaacctgccgtacctgcaggccgtcgtcaaggagtccctccgcctgcacccgccgacgccgctgatgctgccccacagggccagcgccagcgtcaagatcgccggctacgacatccccaagggcgccaacgtcgtcgtcaacgtgtgggcggtggcgcgggaccccgcggtgtgggacgacccgctcgagttccggccagagcggttcctccgggagaacatcgacatcaagggcgccgacttccgcgtgctgccgttcggcgccggccggcgggtgtgccccggcgcgcagctcgggatcaacctcgtggcgtccatgatcggccacatggttcaccacttcaggtggacgctgccggaggggacacggcccgaggacgtgaggatggtggagtcccccgggctcgtcaccttcatggacacgccgctgcaggccgtcgccacgccgcgcctggacaaggaggagctgtaccggcgtgtcccttcggagatctgatgggccgtctgcgtcctggcatctgcattatgttccccgatgctgttgcaaatttgtgtgcacccaccatcatttctttttctggcacggtgctgtccgcctacgatttgttcatcttgtgtactgcagaacttgctcgctggacatacactttgccaggtactagtaatttataatttcggcattgcaaatttctaccagtacgtcgcagaaaacagtgtaagagcaactccagcccaagtcactaaattaagcttttaaatttttatttacatgttatgataaaaaaagtaggagctcaaacaagtaggataggaggttctagatgtgaggggctgaaactataatttaggagggcatggaaaatggcagcccaagtagaagtagaaggtgggttggagttgatttttttttaatcaagtccctagatttagaataaggacttgtttagaaggtgggttggagttgctctaaagcttcaaattgagaatttgagacctcgcaaatatgcacc

SEQ ID NO: 127 - DNA, 2573 bp, Sorghum bicolor
acaaaagcttgggccgcgctgccacctcgcccgctaaataaaacacactcccacgcacacccaccaccgtgccgagcagcgagcacctcctcctcttccttgtttctcgctcagtccctcctcacgctctagctgagtgaattgctagctcctctctcagctaagctcagctgtaaagctaaggctcggagtagtgttgtagcgcgccggccgccggagggtctgtagcgagcggcgttcagctcagctcaccaccagcggagctgcgcttggaaggaaggtgagagcttcaaggaggaggaggaggaagaagggccaagatgattaccgcgacggacttctaccacgtcatgacggccgtggtgccgctgtacgtggcgatgatcctggcctacgggtcggtgcggtggtggcgcatcttctcgccggaccagtgctccgggatcaaccgcttcgtcgcgctcttcgccgtgccgctgctgtccttccacttcatctccaccaacaacccctacactatgaacctgcgcttcatcgccgccgacacgctgcagaagctcatggtgctggccatgctcaccgcgtggagccacctcagccgccggggcagcctggagtggaccatcacgctcttctccctctccacgctgcccaacacactggtcatgggcatcccgctgctcaagggcatgtacggcgacttctccgggagcctcatggtgcagatcgtcgtgctccagtgcatcatctggtacacgctcatgctcttcatgttcgagtaccgcggcgcgcgcttgctcatcaccgagcagttcccggacaacgcgggcgccatcgcgtccatcgtcgtcgacccggacgtcgtctccctcgacggccggagggacgccatcgagacggaggccgaggtgaaggaggacggcaagatacacgtcaccgtgcgccgctccaacgcgtcgcgctccgacatctactcgcgccggtccatgggattctcaagcaccacgccgcggcccagcaacctgaccaacgccgagatctactcgctgcagtcgtcgcggaacccgacgccacggggctccagcttcaaccacaacgacttctactccatggtggggcgcagctccaacttcggcgcggccgacgcgttcggcatccgcacgggcgccacgccgcgcccgtccaactacgaggacgacgcggctaagcccgccaagtacccgctccccgtggtgaatgcggcggcgcccgttcccggggcggcggcgggacactaccccgcgcccaacccggcggtggccgcggcgcccaagaagaaggcggccggcaccaacgggcaggccaagggcgaggacctccacatgttcgtctggagctccagcgcgtcgcccgtgtcggacgtcttcggcggcggcgcgccggactacaacgacgccgcggcggccgtcaagtccccccgcaaaatggacggcggcggagccaaggacagggacgactacgtggagcgcgacgagttcagcttcgggaacaggggcgcgatggacagggacgcggaggcaggggacgagaaggccgcggcggcgaccgcggttgctggcggggaccccaacgcggtagccgcgccgacggcgatgccgccgacgagcgtgatgacccgtctcatcctgatcatggtgtggcgcaagctcatccgcaacccgaacacctactccagcctcatcggcgtcatctggtcactcgtctgcttcaggtggaacttccagatgccggccatcgtcctgcaatccatctccatcctgtcggacgcggggctcggaatggccatgttcagtctcgggctgttcatggcgctgcagccgcggatcatcgcgtgcgggaacaaggtggcgacgttcgccatggcggtgcgcttcctgaccggtccggccgttatggcggccgcgtccttcgccgtgggcctccgcgggacgcttctgcacgtcgccatcgtccaggcagctctgccccagggcattgtccccttcgtcttcgcaaaggagtacaacgtgcaccctgacattctcagcacggcagtcatttttggcatgctcatcgccctgccaatcacgctcgtctactacatcctgctcggcctgtgatcaccgacccgtcacctgtggatgatggcaccccccgcattgctgtaaagaccaccactgctgccatatcccgttcatggggggcagaggaggagatagagctgctacgacatcgcttggcgcttgcaaaatgagtggcgtgttttttttttctctcttctttttttttttttggtctagaagtaggtatggggattgggtggatggaaagggtgaggaggtggacaatacgcggtagctagggacgacaatggtgaggcaaaacggagcaaaagcaggtgcaagtacaaagcttgaagggaacaggagatccagttttagcaggtcacgggatgggttgggctatttcaacgggtttattagggaattttgttggttggccgcgctgaccgatgtaaaatcaacgccattctgacaggagatggatcttgcttg

SEQ ID NO: 128 - DNA, 2222 bp, Sorghum bicolor
ctcaccaaccaccctccattttcaccaccttcacttcgcaccgggccaccggccgtattcattcctcttccacctccctcctcctcgcccaccggctgcagcatcttcccctcacaccctccttcctcctcgtcgccccgcgtctctccctccctcaaagactactccttggccgctctcaccattccattccattcccccggccggccgtacgcgcatcgcattcccgggcggctacctcctcctcctctgatgtcggcacggccatgatctcaagttcttggcattgatgccgttctggtagccagccttctttaacccaccttaacaataactgcctgccgccctgcccccacctctcctctcgccctgcagctgaacctgagctgagctgattcgccgggctctgagcctctgctccacatccatccatccatccatccatccaccttcgcccaaccctgatccagaaccctgtcggtgtcggcgcgccgtgatccggcatcagcagcaggagcagcagcagcagcttccgcgcggggcaccggcggcgcggccatgggcacgggcgcgctcgcggtggcggcggcggcgccggcggaccgggccaacaagcagcgccgggccggcggcggcgcacacctgtggaagaaagcgctgctccacttctccctctgcttcgtcatgggcttcttcaccggcttcgcgccctcctcttcctcctcctggaaggccgccaccaccacccctcacccgccgcaccgtcccggggaccgcctcgccgcctcccgcgtcgccgtcgacgtcaacgcgcgcgccacccttccgccgcccgcgtccgccggcgatgcgctcggtgtcggcggcgccacggtggacgtgggcgacgagtacgaggagggcgacgccaacggccagcgccgacgcctcctgatcgtggtcaccaccacgcggtcgggccccggggagcgccggcggcggcggggcgagctgctgcgcctggcccacacgctccgcctcgtccgcccgcccgtcgtctgggtcgtcgtcgagcccgccgccgacgcgcccgccaccgccgtggtgctccgcggcaccggcgtcatgtacaggcacctcgccttcaagcccgaggaaaatttcaccaccgccgaagccgaggcgcacgcgcagcggaacgccgcgctcgcgcacgtcgagaagcaccggctcgctggcgtcctccacttcgccgacgccgccggtgtctacgacgttgggttcttcgaccagatccgacagatcgaggcgtttgggacatggcctgtggcaacaatgttggctggcgagaagaaagtggtagtagaaggtccgctatgcagtgcctcaaaggtcgtcggttggttctcaagggactttaacgatgggacaacccgttcagtgacgtataacacggaagttgacttgaatcctgctggtgctgctggtacacgagcccacacaattgacgtctcaggtttcgcgttcaacagttcaattttgtgggatcctgagcggtggggacggccaacctcattaccagatacttcacaggactccatcaagtttgtgcaagaagtggtacttgaagaccgagctaagctgaaggggatcccctctgattgctcccagatcatggtgtggcagtatagtgtgcccagctcacaatagagggcagtcgagatgttgcacaataggcgttgcagcctcgcaggaaggggaagaacagcgagtattggaccggagtcgatgtaaatgtggtgggtgataacaaaaggaaaggaagaaggttgattactaagttttttttttcctctcattctcctttggggttccctttttctttctctcagttttggttttcgagtttgggggccatgaatgatgaactgcctgtgggagaagttcgccccccaagcgggaaaatatgcgatagtatttattcagattcatttgtgattctttagcttggtcctgttgcgttcgcgaggcggtgccgcctcacgaatggccctcttgtgggttgcaataataccaatatgtgtagggaggaatgaacttgctgaagaaaatggcagtggcatgaggaatgaagaagtttactgtgttgtggcatgaattccagcaaggcagcaattaccatctgaagaacaaaaaatcatgtgcaaaaagaaaagaaaataataaagactctgaatttgctc

SEQ ID NO: 129 - DNA, 3978 bp, Sorghum bicolor
atcatcagccaccactgacggatccgtagctgctgcatccagttccgtcacccggaccggccgccatggcctccaacggcggcgggctccgccacagcaacagcaaccgcctctcccggatgtcctactccggcaccggcgacgacgcccgcgcgcaggccgccgtccccggcgaccgtcccatggtcaccttcgcccgccgcacccactcgggccgctacgtcagctactcccgcgacgacctcgacagcgacctcggcaacgccggcatcggcgacatgtccccggaccgcgacgaccagccgcagcagtacgcgagctaccacgtccacatcccggccacgcccgacaaccagcccatggacccggccatctcggcgcgcgtcgaggagcagtacgtctccaactcgctcttcacgggcggcttcaacagcgtcacgcgcgcgcacctcatggacaaggtcatcgactccgaggcctcacacccgcagatggccggcgccaagggatcctcctgcgccgtcaatgggtgcgacgccaaggtcatgagtgatgagcgcggcgacgacatactcccctgcgagtgcgacttcaagatctgcgccgagtgcttcgctgatgccgtcaagaacgccggcgccgtctgccctgggtgtaaggagccgtataagagcacggagctcgaggacatcgtcggcgctgccaacgccggggccggagctaggcctacgctctcgctgcccccgccgcctggcgccgccgcgtctaggatggagaggaggctatccattatgcgctcccagaaggccatgactaggagccagactggagactgggaccacaaccgctggctctttgagaccaaggggacgtatggctatggcaatgccatctggcccaaggagaatgaggtggacgccggaggcgttggtggaggcggaggtggagctgatggccagccggccgagttcaccaccaagccatggaggccgctcactcggaagctttccatccctgctgccatactcagcccatacaggcttctcattcttatccgcatggtcgtccttgctctgttccttatgtggagaattaagaacaagaatgaggatgcaatgtggctctggggcatgtctgttgtctgtgaactctggtttggcttttcatggctgcttgaccagctgccaaagctgtgccctgtgaaccgagccaccgaccttgctgtcctgaaagacaagtttgagactccaacaccgtcgaaccctactggacgatcagatttacccgggcttgacatatttgtgtctacagctgatccagagaaagaacctccattggtcacagcaaacactatcctgtccatccttgctgctgactaccctgtggagaagctttcttgctatgtttctgatgatggaggggctctcctgacttttgaagccatggctgaagctgctagctttgctaatatgtgggttcctttctgtcgcaagcacaacattgagcctcgcaatcctgacagctacttcaatcttaagaaggacccttacaagaacaaggttcgccaggattttgtcaaggacaggaggagggttaagagggagtatgatgagtttaaggtcaggatcaatgcgctgcctgactcgatacgccgacgctctgatgcgtaccatgccagggaggaaatcaaggctatgaagaggcagcgagagactgctcttgatgatgcagtagagcctgttaagatcgctaaagccacctggatggctgatggcactcattggcctggtacctggattcaaccttctgctgagcatacccgtggtgatcatgctggaataattcaggtgatgctgaaacctcccagtgatgatcccttgtatggcagcactggtgacgaaggcagacctcttgatttcactgaggtcgacatccgtttgccaatgttggtctatgtgtcccgagagaagcgccctggttatgaccacaacaagaaggctggtgcgatgaatgccctagtccgttcatctgctgtcatgtcaaatggccccttcatcctcaacctcgactgtgatcactatgtttacaactcacaagctttccgcgagggcatgtgcttcatgatggaccgtggtggtgaccgtattggttatgttcagttcccgcagcggtttgagggcattgatccatcagatcgctatgccaaccacaacactgtcttctttgatgtcaacatgcgcgcactggatggtatcatgggaccagtctatgttggcaccggctgtcttttccgccgcgttgccctctatggatttgaccctccccgctccaaggaacatggtggctgctgcagctgttgcttcccccagagacgcaagatcaaagcttcagctgctgcaccggaggagacccgggctctaaggatggcagactttgatgaggatgaaatgaacatgtcatcattccccaagaagtttggtaactcgaacttcctcatcaactccattccaattgcagaattccaagggcgtccgctagctgatcaccctggtgtcaagaatggccgtcctccgggtgctctcactgtcccccgtgaccttcttgatgcatccacagttgctgaggccatcagtgtcatctcatgctggtacgaagacaagaccgagtggggccaccgtgttggttggatctatggctcagtcacagaggatgtggtcactgggtaccggatgcacaaccgtggttggaagtctgtgtactgtgtcaccaagcgtgacgccttccgcggcaccgcacccatcaatctgactgaccgtctccaccaggtgctccgttgggctaccggttcagtggagatcttcttctcccgcaacaatgctctgctcgcaagccgcaggatgaagttcctccagaggatcgcctacctgaacgtcggcatctacccattcacgtccatcttcctgatcgtctactgcttcctgccggcactgtccctcttctcggggcagttcatcgtgaagactctcaatgtggcattcctaacctacctgctggtgatcacactgacgctgtgcctgctggcggtgctggagatcaagtggtcggggatcagcctggaagaatggtggcggaacgagcagttctggctgatcggcggcacgagcgcgcaccttgcggccgtgctgcagggcctgctgaaggtggtggcgggcatcgagatctccttcacgctgacgtccaagtccggaggcgacgacgtggacgacgagtttgcagacctgtacatcgtcaagtggacatcgctgatgatcccgcccatcgtgatcatgatggtgaacctgatcggcattgccgtgggcttcagccgcaccatctacagcgagatcccgcagtggagcaagctgctgggtggtgtcttcttcagcttctgggtgctggcgcacctgtacccgttcgccaagggcctgatggggcggagagggcgcacgcccaccatcgtcttcgtctgggcaggactcctctccatcaccatctccctgctgtgggtcgccatcaacccgccatctgggaaccagcagattggtggatccttcaccttcccctgaagctcttgccagtttcattgtcgcatggaatggaatggaatggaattcttgctttgtaccagctccagcagcgtttcatcctcagactcagagctgctgcgggaagtgggattctgactgtcgaaatggctagggcctttttgtcgaaagctgatactgttatgatgagctaaagtagttcttttgttcttttatttttgttattatatatatacatatgttcagatcccaggattggttctgttggactattaaacgagcacaaatttccagtcttttggatgttgcatgctggcctttgaaatgtctcgtgctggtgatgtctgatgtgctgggatgcatttgctttcattgtaaaagatagtagttgaag

SEQ ID NO: 130 - DNA, 1296 bp, Sorghum bicolor
ccccgcgcgcgcgcgcgctctccctccctccctcctcgcctcgccgccggcgacgagctcgagctcgagctggttcctcgtatagaagacggccaccgcggtatggagcccatgaacgtagacaacggcggctgcggcggcctggacgcgcagatcgagcagctgatgcagtgtcgcccgctcgccgagcaggaggttaaggcactgtgcgagaaggccaaggagatattgatggaggaaagcaacgttcagcctgtcaagagtccagtgacaatatgtggtgatatacatgggcaattccatgatcttgtagagcttttccgaattggcgggaagtgtccagacaccaattacttatttatgggggattatgtagatcgtggctactattctgttgagactgtcactctgctagtagcactaaaagtgaggtacccacatcgaattacgatccttcgtggaaaccacgagagtcggcagatcacacaggtgtatggattttacgatgaatgcctacgaaagtatggcaatgcaaatgtatggaagacatttacggatctttttgattattttcctctgacagctctggtggaatctgagattttctgccttcatggtggtttatctccatcaattgaaaatcttgatagtgtgcgcagcttagatcgagtccaagaggttcctcatgaggggcctatgtgcgatcttttatggtcagatccagatgatcgatgtggttggggcatatcccctcgtggtgctggctacacttttggccaggacatatcggagcagttcaatcacacgaacaatctcaaacttgtagctcgggctcatcaattagttatggagggatataactgggctcatgaacaaaaggttgtcaccatattcagtgctccaaactattgctatcgatgtggcaatatggcatccattttggaagtcgatgactgcaacagtcacacattcatccagtttgaaccagcccctaggagaggtgaaccagacgtgacgcgaagaacaccggattatttcctttgagctgtcgatgttgccatttcccagcttgtgccgtgataatctatgtcaacatctgctggatcaagggccacacagaaataacaggggaatacaaaagcactatgcaaaacttgagggccccattgccattggtcagtgcaagagatgctgcaatcctgagctgagaaagcaattgtgccaagccatgcccgagtttcagctttcaggtgatatataagggcggccatccacttacaactcttgccgccctcc

SEQ ID NO: 131 - DNA, 2200 bp, Sorghum bicolor
caaaaatcacagaaaaggtggagcaaaggtgattcgtttttctcatgctcgtttaccggatcggagtgtgccccggagttggtgctggtagctgagcgcgacctgcctgaaccgagagaccgagccgccgagccggcgccgccaccaaccccgccccgccccggcgaagagttcaaaggggcggcggcctcctcggtcttgtcgatcgacgacagcgagttcgcgctgggactgggatttggtatttctggccgcccaaccccacaaaacccccacgaaacgtcgaaacccccacccgcattcctcctcccctgggctcgccaacaaaaggcccccatcttcctcggtcagctggagcctggagccagccagcctgcctgtcccggttcagcttcagcttgctcgcatcggcctcgcttctgagttctgagtgagctgtgacgaggagggggttggcgggtgaggaagccatggtggggagctacgcgaacggtggcggggctgcggcgctggtggcggaggagaagctggacgcgctgcggcggttgctggggaagtcggacggcgacccgctgcgggtcgtcggggtgggcgccggggcgtgggggagcgtgttctgcgcgctgctgcaggacgcgtacggccggcaccgcgaccgggtgcaggtgcgcgtgtggcgccgcgctggccgcgccgtggaccgcgccgacgccgagcgcctcttcgaggtcatcaactcccgcgaggacgtgctgcggcggctcatccgacgctgcgcctacctcaagtacgtcgaggcgcggctcggggaccgcacgctgcacgccgacgagatcctccgcgacggcttctgcctcaacatgctcgacaccccgctctgcccgctcaaggtcgtcaccaacctgcaggaggccgtctgggacgccgacatagtcgtcaacggcctgccctccacggagaccagggaggtgttcggggagattgggaggtactggaaggagcgaatcacccagccgctcattatctcgctggcaaaggggatcgaggcgtcgctcgaccctgtgccccggatcattacgcccacgcagatgatcagcaatgcaactggagttccgttggagaacattctgtatcttggaggcccaaacattgcttctgagatttataacaaagaatatgcgaatgctcgcatatgtggagctgacaagtggaggaaacctcttgcaaatttcttgaggcaaccccatttcattgtatgggacaatagtgatctcattactcatgaagtcatgggcggcttaaaaaacgtatatgccattggggctggtatggtggcagcccttaccaatgagagtgcaaccagcaaatcagtatacttttcactttgcacatctgaaatgatatacatcacccatcttctagcacgagagcccgagaaacttgcagggcccttattagctgacacatacgtcaccctgctgaaaggtcgcaatgcatggtacgggcagaagttagctaagggagaactgactctagaaatgggggacagcatcaaaggcaaagggactatccagggtgtttctgcagtcaatgcattttatgaactgctgagccagggaagcctaagcgtgatgcatccagaaaccaagaaggctgttgctcctgttgagctatgcccaatactcaaaacactttacaaaattttgatcaagagggagcttacgaccaattccatcctccaggcaatacgtgatgaatcaatgtatgatccacgggaaagaattgaaatggcgcagaggcagtctcttttccggccatctcttcttggcctagctaaaggtgatgccaaggcctaagatatggtgtttgtttcttcctgaaatacgtatttccatgtgagtttgcaggaggcgcgtactggccttcaagatccttacttacgtgcctcagatgtgtgttgggtgcacgctatagagttcgatgatgtgcatgccaggataaactttatggcccgtgtctgtacataacgtgttgtgattcaaatttatttgtcatgagtaaagatgtgcattcctttttattttatgatggatttggagtctcataattggttgtaagttgtaactcagaagcaaaagctatgttctgatctccactgatatggtcatatgaatgaaacagaagttttcactaccccaaa

SEQ ID NO: 132 - DNA, 1550 bp, Sorghum bicolor
caagcacacacatcctagtacactactgtactcatcagctacttacccgcctagctatatatagcgtacatgtcctcagactaataacccgcctagctatctatctatccaccgatatataaacctctctagtctagactagaaaccaacatctatctatccattctttgaagagatcgatcgaaggaccgatcgagatagctaggatgccaacagcagagacgacgacgcccgtgccgccagcgctctccgggcaaggccggacagtttgcgtcaccggagctggagggttcatcgcctcctggcttgtcaagcgcctcctcgagaagggttacacagtccgtggcacggtcaggaaccctgtcgatccaaagaacgaccacctgagggcccttgacggcgccgccgatcgcctcgtcctcctgcgtgccgatctgctggatccagaaagccttgtcgaggccttctccggctgcgacggcgtcttccacgccgcctccccggtcaccgatgaccctgagatgatgatcgagccagcaatccggggcacacaatatgtgatgacggcggcggcagacaccggcgtcaagcgcgtcgtgttcacgtcctccatcggcacagtgtacatgaacccctaccgtgaacccaacaagcctgtcgacgacacctgctggagcgatcttgagtattgcaagaatacacagaactggtattgctacgccaagacagtggcggagcagggcgcatgggaggtggcgcggaagcgaggcctggacctgatcgtggtgaacccggtgctggtgctgggtccgttgctgcagccaacagtgaacgccagcacggaccacgtgatgaagtacctgacggggtcggccaagacgtacgtgaacgccgcgcaggcgtacgtgcacgtccaggacgtcgcggaggcgcacgtccgggtgtacgaggcaccctacgcgcatgggcgctacatctgcgccgagagcaccctccaccgcggcgagctctgccgcatcctcgctaagctcttcccagagtaccccatacccacaaagtgcaaggacgacgtgaaccctccggtgacaggatacaagttcacgaaccagcggctcaaggatcttgggatggactttgtgccggtgctgcagtgcctctacgagacagtgaagagcctccaggagaaaggcatgctgcccgtgcttccgccaaaagacgaccaggaccaacaactccacaaatcatgattatttccaacgctgatactgctacaacatatcatatatatttatatttatatataagctatagcggattgatataatgaacccagctttttatccacgatatatataaatgatgtacacgtggtgactttaactggtgcatgctttcctgatgagtgccaccgacccatatatatataccagtgcaggatgacgcacaaatgcaatatatttctttggacaatttatctataaaataacactccgtctgttgtaaaaaagatcacctatattatgaacaatagttaagtgggcacctttagc

SEQ ID NO: 133 - DNA, 2779 bp, Sorghum bicolor
ctggttgctgcgcttgttactaaaaaaaggcgcctgcttttttttggagctccccggtgctctcatctcggaagacgttcagtgaaaggtgtgggtattgtactttgacttgcctgcccaggatgcccctgccggcgacggactgagttggcgtactccttgtctgccagtgttgaatcagtctaattgggccatggggtcgtctggctgtagctctgagatagttgagtccaccgaggaattcgacagtacaccctttggtggatccagcttgctgcatattaaactcaaagatgaagagaagcgcggcaaatgtcatgattatcctgtggaagatgacctcgaccagcttcttaaagctattgatagcaggaccttccgaagggcgcttagtcctggcagcacaggtggaaatgcgctggggaatagtgttctcaagaaaccagctaggtctgggttgtctcaaagtgcaggcatcgggatatcctctaagactgttaatatgaagcaagcgctgagaaggctatgcatttcccaggcatcggaaatggctgcaatgaagaggttgtcgatgtcacctggatcttcaagttcatccgaagctgggactatccacaggctttatgcctctttgatggtccaaagtagttctgagggtcttctgcatgatgatgagaagatgaacctgattgaaatatcgctcactccagagaagattggttcatctagaggtacgagtgagttcagcgaagactgtgaatttgagacagctgatggaagtgcagtcacctctacctctatctgttctgcttcgtcaacctccgctgagattaggaagatcagaatccaagatgtaatcagtggtgaccctatggataatgagagttccttggtggaaaatggtaaactaggaagtaaattttctgtagctactgatgatggctctcccagagtcccaatcttgagcaaacctatcactacatcccgacttgtgaagccagtctttcgatgcaagccttctggtaagaagaaagtgaaagaagaaccatcttcgttgggtgattcctccaatagtactaaattctgctcttcaaaggagtcaatctccctcgcatcaaccagctgctcttcaacatctagtgttacaaatcccaccagctgtgcagaagaagagaaatcaactccaggaccagaaaaatctgatggaacatcttctgagtggttggcagaggaaaagggcgagtgttcccagaattcaaagagcagtattagtgagtatggttgtagcacaagtatcagcggcgagagccaatttggattgtgtggctatagtaacaggccacacatggcaaaggatctgcggtggctaaccattcgtcagttggcattgcaacagggttccttaggactcgacaatttcaagcttctgaagaggcttggttgtggggacattgggactgtatatcttgctgagttggttgattcagattgcttatttgctttgaaggttatggacattgagtaccttattaatagaaagaagatgctacgagcacaagctgagagggagatattagaaatgctagatcatccatttctcccgactctttatgcccattttaccacggacaatctctcatgtttggtcatggagtactgtccaggcggtgatttgcatgttcttcgtcaaagacaacctggaaaaagctttccagagccagcagcaaggttttatgttgcagaagttctccttgctttggaatatcttcacatgctaggggtcatataccgtgatctaaagccggagaacattctagtccgtgaagatgggcatataatgttatcagactttgacctttcactgaggtgctcagtgaatccagtgctccttcggtcatcttctattacagcaaatcaccaaccaaggaaacttacaggaccttgtgcagagaactactgcatcaattcgtcttgcctccagcaaccctcttgtgcccaaacatcttgcttcacaccacgactaccatcaattccaaagcctcggaagcccaagtcctcccagaaaaggcttcctcagcttgttgtagagcctactgatgcacgctctaattcctttgttggcacacatgagtaccttgcaccagaaatcatcaaaggggatggccatggaagtgctgttgactggtggacctttggcgtcttcctttatgaacttttatatggcaagacacccttcagaggacctgggaatgatgaaacattggcaaatgtggtctcacagaatctccggttcccagacaatccatctgtgagcagcaacgccaaagatctgatcagaggtttactggtgaaggagcctgagaacagatttggatcgttgagaggagctgctgaaatcaagcagcaccctttctttgaaggattgaattgggctctgattcgttctgctgctcctccagagacacaaccttgcaacgtcgtgactcttgccaaagagcggaagaaagaaggcaaatgcctggagttcagaagcaactccgaggaccttgaatttgaagttttttagtgtggttctggtacagtttagcaccatttccgctgatatagcctacatttttttctttgagtagccaaaggctgggggtgtacatgtagattcctgtatttcagtaactgctatgtccctgtcaatagcatcaccaaattgaaaagaataagcacagcttatgctattattatcattgctgctgcatatgaattggttcctattggaggctaa

SEQ ID NO: 134 - DNA, 2094 bp, Sorghum bicolor
cgtggcgcgacacgacgccccacgtcgcgactcgcgaccgcggacgtacacctttgtgaccacaccgcggcggaagcgcggggggagaagtgaagaaccctacatacggcttcggctggggcgccacgccgcatggacatggacatcaaggagcggatccgccgctcgccgccgccgacgccgaaggcggtaggggaggcggcgtccgcgcccgggcacccgcgcgggaggaagggccgggtcgcgctgctgcccctgtcgatcgcggcgctcgtggcgtgcggggtcacgctgctgctgctcgcgggcggctccgcggcgaggaggggcggccaattctccggcgcggatcgtaccactctctccggcgccggcaacaacgaccgtggcggccttgaccaggccggaccgcgcgatggagagcatgaaactatggtgtcttccaaagttcaaagggacagactaattggtggcttgttagctcctggttttgatgaacagtcatgtctaagtagataccaatcagcattgtaccgtaaagaatcgccccatttgatatcatcataccttctggaaagactgagagaacatgaggttctccagaagaaatgtggcccgtatacagagtcatacaagaaagctattgagcaactaaaatctggtcaggatgttatggttggagattgcaactttttggtatgggtatcttatagtggtcttgggaacaggatcttgactattgcctcagcatttctctatgccatccttacaaacagagttttacttgtagatggagataaaggcactgcagatcttttctgtgaaccattccctgaaacttcatggttattaccaccggatttccctattattcaatttaagaacttcagtattggctcccccgagagtcacggaaacatggtgaaaactgaagctattcattctgatggttcttttaagggtcctaaacctgcctttctatatcttcacctggctcatgactatgatgattatgataaactttttttctgtgagcatagtcagcaacatcttcagaagatcccatggctgatcttaagatccgataattactttgtaccttcactttttctgatcccatcataccaagaggaactcacgaggctgtttccgcagaaagatgtcgttttccatcacttgggacgttacttgttccaccctaccaatgttgtctggggcttgattacaaggtactacgattcttatcttgccagagctgatgagaagttaggtatccagatcagagtcttcgatactgaaaccggtccatttcagcatgtcttggatcaggtccttgattgcacactgaaggaaaaattactaccagagattaacgcacaacagccgattatctcgacagggaacatcaggtccaaagttgttctgattacttctttgaactcaggatactatgaaagaatcaggaacatgtattgggaacatccaacagagagtggtgagataattagcttccaccagccaagtcacgaggagcatcaggattcagacaagaaaatgcataacatgaaagcattggcagagatttatctgttgagcttatctgatgttatggtaacaagtgcatggtcaacttttgggtatgtagctcaaggtctgagtggttcgaagacgtggctaatgttcaagccggaaaaccgcactgcgcctaatccaccttgccgtcaagttatgtctatagagccgtgctttcatgctccacctttctacgattgcaaaactaggaagggaactgatacaggaaagcttgttccacatgtaagacactgtgaagatatgagctgggggctcaagctagttgatacgggtgagctgtagatgacaagatgtggtgtttttcctttgtttaattcatatatgtacagtacaaccgagtgctttgtgctatgaagttttcaggtgtatagcaggttcgagtttgtatttatattgaaggcgagatttgagtgatgtagttaattattacgaaatggcaagtatgctgattgcggtcaggtataaatttcctgtatctcttatatatagcatctgttcatg

SEQ ID NO: 135 - DNA, 2127 bp, Sorghum bicolor
tcgcgtcgcgtcgcgtcgcgtgattcgatcgatcggactccaattcctccgccccgttccgttccgtccaggccgctgccgctgcgcccaggccccagcgagcccccgacccccaaaggctgcggccgtcgcagtcccatcgattcctcccgcttcgctttcccacccctcgaagccgaatccgatggttccacccgttgactgcctccgccatcggaggccgcgccgcctcctccccgccttcttcctcggtccccgcgcccgcctcctcctatagatacaccgcccgcgcatcgcccccatggcggtcggcggcgacgacgacagcatggagcgggacttcgctgccaggctgcgcctcgcgcattcgccctccccggcctcgcctgctgccgccgcttcctcctcccccaccgcagccggggggatcgccttccgcgcgccgcaggagcagttcaccgccgatgacttcgtactcggcaagatctacggcgtcggctcgtactccaaggtggtgcgggccacgaagaaggacacgggccgcgtctacgcgctcaagatcatggacaagaagttcatcaccaaggagaacaagatctcctacgtcaagatggagcgcatcgtgctcgaccagctcgaccacccgggcgtcatcaggctcttcttcactttccaggacacatactccctctacatggcgctggagtcgtgcgaaggtggggagttgttcgaccaaattgtccggaaaggtcggctctctgaggacgatgcacggttttatgctgctgaaatcgttgatatattggagtatttgcatggggtcggcctaattcatcgggacgtcaagccagaaaatctactgcttacttctgatggacacatcaagatcgctgactttggtagtgtcaagcctacaagggatactccaatcaaagttctcccaaattcaactactgaaagggcatgtacatttgttggaaccgctgcatatgtaccacctgaggtcctgaactctgccccagcaacctttggaaatgatttatgggcattgggatgcacactgtaccaaatgctttctggctcgtcgccgtttaaagatgccagtgaatggttaattttccagagaatcattgcaagggacctcaaatttccagagtacttttcagctgaagcaagagatcttattgacaaattgctggatgttgatccaagcaaaaggccaggtgcaggacctgatggttattcttccttgaaggcgcatcctttcttcagaggcatagactggaagaacctgaggaagacacgaccacctaagcttgcatttgatgcaaatgcaaatgaagatgaggatggccaggattcaaattggttggcacacatgggaactgtggcagtcaaccaacagtcaaatactgttggtaataatggtgccccatcatcatctgaagtgcgctcccatatatctaaattatcttccatcgactcctttgactcaaaatggcaagaattcctggaccctggtgagtctgtagtcttgatatcaaagctgaagaagattaataagctagcaaacaagaaggtccagttgatcctcactgacaaacctcaattgatatgtgttgacccttcaaaaatggtggccaagggaaacattatttggtctgatgacccaagtgaacttagtgtgcaagtatcagattcttcacattttagaatatgcacgccaaagaaggtgtcaacgtttgaggatgcgaaacagcgtgcctggcaatggaagaaggcaattgaagacctccaacgcggccaaaggaattgattttcaattcaaatcaaaaccctaaaacctcaaattaggcattacagcaacagcacatccttttcacttggaggaacatgtgagggggtttatttctcctgccgtcctgatcccgtgcctggatgcaaggaatttgctactcgctaattcacacaactgaatggtggctcccaaaattttcccctttccatctatgttttcatatagcacacaattttgtttcacttttgcgacgttgcagcagatagcgtcaaaacaggctgcggtctggaaatattgacacaggaaactattttgtctaaacgactcta

SEQ ID NO: 136 - DNA, 1200 bp, Sorghum bicolor
cactcgcggtcgcggggagagagagagagacaagggggccggtcacacacacgccgaccgcgcgagctagcgagatccccctctcccgctgccggatccgatctcacctgacctcgtcgccgcctgccgtgggagggagaagaggaagaggaagaggaggcggcggagatggcaccggtgtcggcgctcgccaagtacaagctcgtcttcctgggggaccagtccgtcggcaagaccagcatcatcacccgcttcatgtacgacaagttcgacaacacctaccaggctacaattggtattgattttctgtcgaagacaatgtaccttgaagatagaactgtgagactccaactctgggatacagctggtcaggaaaggttcaggagtttaattccaagctatatcagagattcttcagttgctgtcatagtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcgatagaggaaggggaaggtaaggcgaaggaccttggcgtcatgtttattgaaaccagtgctaaagctgggtttaacattaaggcgcttttccgtaaaattgctgctgcacttcctggaatggagacactctcatcagcgaagcaggaagacatggttgatgtgaacttgaggtccggcaatgcaaactcgtcccagtctcaggctcaggctgggggatgcagttgttagttgcagtctctgacacttgctgctcatgatctctgagaccctgagcatcagaaagcgttatcactgatgcttccctcgggaaggagagttgattgcctctcagccagtgaacacaccataggctttacccggtgaatggaccatttgcattggaacgatacgttttatgagttctctagtgttatttcctcagtggcctaagctagcaacagtgtatagttgggttggcactgcaaacttctaccattcgagttgggtattagagctagttattggttcatgttgaacttatatattttccatcttgttgcagttagcttgagtcatgtttgctatgtgtaccaaacatgtattggaatttggaatttttgtaagctaaaataaggccagcactgcaatagcccc

SEQ ID NO: 137 - DNA, 2033 bp, Sorghum bicolor
atagctcatagcaaaacaatacaagtagaacaagcacagaactgtcaagctccgcaggctgcagctcgtccccaatggcgtctgcttctcttgcgtcttctctcttgtgcagcagcagtgcttctaccagtagaagcgcagccatgccaagagtaatcaggatcccaattttctccaagaaccagtacagaccgcctcttcggcctcttaggagagtagttaggcgatcattgcagcaggagcaagagcagagggcgtcccccgtctccgtggcctccggcgagcaacaggaggaggcgacggcgtcgcatcatgtcggaggggtggacgaggccaaggcgtcgggtcatgttggagaggcagacaagggaggccaaggagaaggcgacggtgaggagaagaggagcaccgacgagcagcaggaggtggactggaagtcagacgaggagttcaagaagttcatgggcaatccctccatcgaggccgccatcaagttggagaagaagcgcgccgacaggaagctccgcgagctggaccgcgagcccgacgccaaccccgtcgccggcctgttccggggcttggcaaaggaccagctggcccgggagaagcagaggctggagctggcggagcagaccttcaaggcactcgacctcaacaagctaaagagctgtttcgggtacgacacgttcttcacggtggacgtccggaggttcggcgacggcgggatcttcatcgggaacctgcgtaagcccgtggaggaggtgcggccgaagctggagaagaagatctccgaggcggccggaacagaggtcaccctgtggttcatggaggagaagaaggacgacatcacaaagcaggtctgtatggttcagcccaaggcagagatcgacctccagctcgagatcaccaagctgagcacgccgtggggatacctcagcgccgtggcgttggcggtcacgaccttcgggacgatcgcgctcatgagcggcttcttcctcaagcccggcgcaacgttcgacgactacgtctctgacgtgcttcctctgttcggcggcttcctcaccatactcggcgtctctgagatcgcgacgaggctgacggcggcgaagtacggtgtgaagctgagcccgtcgttcctcgtgccgtccaactggacggggtgcctcggcgtgatgaacaactacgagtcgttgctgcccaacaagaaggccctgttcgacataccggtcgcgcgcgcggccagcgcgtacatcacgtcagtggtgctggccgtctcggcgttcatcgccgacggcagcttcaacggcggcgagaacgccctgttcgtgcggccggagttcttctacaacaacccgctgctgtcgttcgtgcagctggtgatcggcccctacgccgacgagctcgggaacgtgctcccgaacgcggtggagggcgtgggcgtgcccgtggacccgctggcgttcgcggggctcctgggcatcgtggtgacgtcgctgaacctgctcccgatcgggcggctggagggcgggcggatcgcgcaggcgctgttcgggcgcggcacggcggcgctgctgtcgttcggcacctccgtcctgctgggcgcgggcgccatcagcggcagcgtgctgtgcctggcgtggggcctcttcgccaccttcatccgcggcggggaggagatcccggcgcaggacgagatcacgccgctcggcaacgaccgcttcgcgtgggggttcgtgctcgccctggtctgcctcctcacgctcttccccaacggcggcggcacctactctgcctccttcctcggcgacccgttcttcagaggcggcatctgaattcatctccttccgtgcagtctgcagtgtgcgtgtatttataaatttattagtacgcgctccactaggctaatagccactctactaaccactcaccactccgcagtttccacggttaaaatctttcttgcgaggtaggagtagatctcttcacgtattgtgtaataaggagcattatataaataaatagttagctggttt

SEQ ID NO: 138 - DNA, 1289 bp, Sorghum bicolor
atcacaaatctctctctctctcctcctcctctctctctctctctctctcgctcgctctccaagctccagctagactgtcctgctctgcttcggtgcttgctactgtgcacagccagccagctgcaggcctgcagcagagaagctctgcagtgcaatggagaggcctgcgcaggcgcccacgcagctgccgccggggttccggtttcaccccaccgacgtggagctggtagtgctgtacctccgccggcaggccctggctcgcccgctgccggccgccgtcatccccgtcgtccacgacgtcgccaggctcgatccatgggacctccctggggcaagcgaaggggagggctacttcttcagcctgctgcggcgagcgccggcgaccggccgtggcagccgcaggaggagagctggaagcgggtactggaaggccacggggaaggagaagccggtgttcctgcagtgcggcggcggcgttggcggcaaggggcagctgctcgtgggcgtcaagacggcgctcgccttccaccgcagtgagccgccggcgccgtcgtcgcggaccggctggatcatgcacgagtacaggctcgccgtgtcccgcggcgtggccgagcagagagagaagaatgcgagccagggttgcgttgctgcgccgggagagtgggtcgtgtgccgggtcttcctgaagaacggagcaagaagcaggccgaaccgggatgccaacagcaaagctctgggacaccgcgcctccgctgcgccgccgcagccgccaccgcagcaccgggaagatgtgggaggacgacggcagcagccgttgctactctcgtcgtcgcagtcgtcgtcctcgagctgtgtcaccggcgctaccgacttggcagaccaagacgacgaagtcagcggcggcggcggcggcataagcagagataccccagctgaccctcaaagagaggcctactagggatttttaagtgttctccccccccctctctctctcttgccccgttaagcatcagataatcaggtttaaggcaagcccagcgcaagaatggtccagatcccgaaataccatgtcaaacagatttagcaacctgagttttgaatcaggagcgatagttgctacggtagatctgtggtgtggcatgcacttggatttgatgctagaaaatgggcgctgcggcggcccagtagtgtgtaaaagctaaaatggcggttaatttgaggtggaatcctggttgtattgtatatatagaatcgtggtcactacggctgccgtaccatgaatatatttc

SEQ ID NO: 139 - DNA, 1831 bp, Sorghum bicolor
gtaatggttgctacagttcggtgtgatgaaattgcaaacgagaagtttggatgcataaccacggacacagaatggttagatgtggagagtgctgtccaatctggtccagtacctggttttggaaaaaaacttggcaatatcgtggacgttcacttgcaagagtatgacaaagaagctatctattttgatgaagctgttaggaaaggaaaacgagagcatttggagtccagaatactgaatcttgtccaacctgcattccagaaaatgttgactcatctgcgcatgaaggctctagaaaaatttaaaactggtcttaattcatctttggagagtggaaaaggattcgcggtatctgctcgagacaatactgaatgctctctcaaagactttgaacaaggctgtgcagatgctataatcaaacaggcgaactgggactgctctaaaatgctagagaaagttcggcgtgatattgaagaccatgcactttcaattcgtgaaagcaagctatcagaattgacaacccatgctaaggagaaactaagaaaagcacttgctgaacctgtggagtctctatttgacgctgcagaccaaacaacctggcaatcaataagaaatgtttacaaacgcgagacagaggccatcctaccggagtttctgaaaaccctttgtgggtttgaaatggaatatggtccagcagaagaaatggtatccaaattaagggattatgcccggagtgttgtggaaagtaaagctaaagatgaatctagcaaagtattgatccatatgaaggagaggttcacaacagtgtttagccatgacaaggattcaattccaagggtctggacaggaaaggaagatgttcgtgcaatagcaaaggaagctcgatctgcggctctcaaacttttgtctgtaatggcggccattcgctgggatgacgagccagatagtattgaaagcatcctcacttcaacacttctggaaggctctgttgtatcaaaaattgcacatgctgcttctgctgatccacttgcttctaccacttgggaagagattcctccaaagtatacaatgattactccttctcagtgcaagtcactgtggaagcaatttaaatcagaaactgagttcacgattacacaagcagtatctacacagcaagctcacaggcgtggtaatagtaaactgcctcctccttgggcaattgtggccatcgctattcttggtttcaatgagatcatggtgcttcttaggaatcccatttatctgttcttgctatttgtgggctacttgatgttcaaagctttggcggtgcagctagatgtcagcagagaattccaaaatggggtggttcctgggataatctctgtgtcagcgaagctcctaccgacgatacagaacctggtgaacaatgtggcagccgagcagcaagccgagcaccagcacccgcaccctcaccctcacccacaggccgcagaccccccacagccacagatgcagccgccgccgctgctcctgagcccgagaagccccatgagcgagcttcggaggctgcacatgccgtcaagcccgcggaaggtggcatccccggtgccatcctcgtcgtcgtcgtcatctgccgtatcgtcccctaggcacactggcgaggatcagaagccaagaccaggggtagggggagctgagaacccgtctaccgtcgctgactcgatagtgtgatgactgatgagccatggtggcgtttgactggtatgtagactgtgtggcattagaagtacaagcagaggtatggagtatggagtatggaccttgtgttgtcccctatttcaatgcatat

SEQ ID NO: 140 - DNA, 1403 bp, Triticum aestivum
cgtcgatacatctctctcccctcggcggccattaattggacgggatatcgattcctccctccctccgcggacgatctagctccagcgagagacaagtgttgtgtctgcgctgagagggagaggcagagagaagggggcggccatgaccaccggcgggaacggggaggagcagcaggggcggaggctgttcggcgtgtcgctcacggacaggcccgtctggcagcagttcctcatctgctcctccggcttcttcttcggctacctcgtcaatggcatctgcgaggaatacgtctacaaccggctccagttcagctatgggtggtacttcacgttcgtgcagggattcgtgtacctggggctgatcaggctgcaggggttcacgatgaagcacatggtgaacccgtggcggacctacgtgcgcctctccgccgtgctcatgggatccaacggcctcaccaagggctccctcgccttcctcaactaccccgcacagatcatgttcaagtccaccaaggtgttgccggtgatgataatgggagcatttatcccaggattaagacgcaagtacccgttccatgagtacgtatcggcggtgatgctcgtcatcggcctcatacttttcacgctcgcggacgcgcaaacgtctcctaatttcagcatgatcggcgtggccatggtgtccagtgcactcatcatggatgccttccttggtaacctgcaggaagccatcttcaagatgaacccagacaccacacagatggagatgctgttctgctcaactgttgttggcctgcctttcctcgctgtgccaatggtgttaacaggggagcttacgacagcgtggagcgcgtgctctcagcacttgtacgtgtatgccgtgttggttttcgaggcgatggcgacgttcgtcgggcaggtgtcggtgctgtccctcatcgcgctcttcggggccgccacgacggccatggtgacgacggcgaggaaggcggtgaccctgctcctgtcgtacctgatattcaccaagcccatgacggagcagcacgtcacggggctcctgctgatcaccatggggatcgtgctgaggctcctgccagaggacaaggagaagaagggcacggccgagcgccagcaggcgaaggcgcagcgcggcgaggagaagcggcggggagacggagtagaggaggagacatcgccgttggtatgatcggtgacttggatgagctgaacgaataacaaatcagagtgcaggatttggccaagtctgcttttgtgaacctttgtccagtttgtgttgtttgatgtcgtggaactgttttggggattgtaacttgtaagttaaaggaacaaatcagagtgcaggatggcgatgatcagagatggattagatgttgttaatccttttc

SEQ ID NO: 141 - DNA, 1542 bp, Triticum aestivum
caagggcagcacagcccctggacccgcccgcctcacgatctttctcaccccacccttccctttccccctccctgtacataaagcagccgtcgcgtcgaggctctcgaggctctcctcctcagcaccagcagtattccattccattctccatcctcagatcagcgcagcggagaatcgaaccaatctaggtttggcgagagccgagccgaggaggatggtgaaggccatggcggggtgcccggcgaagatggggttccggatgcccgccgagtgggagccgcacgagcagtgctggatgggctggccggagcgtccagacaactggcgggagcatgctgaaccagctcgaaaaacatttgagagaactgcaatggccatttcaaagtttgagcctgtcaccatttgtgcaagtgccaaacagtatcctcgtgtccacgagctgatggaacaccaaccgaacatcagggtggtcgagatgagcatgaatgattcctggtttcgtgacaccggtcccacttttattacccgtgaaggcggatcagatataggacttgcagagcaaacaatagcggggattgactgggaatttaacgcatggggagggctcggtggtggttgctttgatgattggagtcttgacagaagcattgccaagaagatagttgagattgagaggatccctaggtttgcacacacaatggttcttgagggtggaagcattcatgtagatggagaaggtacatgcattacaacagaagaatgcttgttgaatcctaacaggaaccctcacatgactaaactagagatagagaatgagctgaaggatttccttggagtcacaaagatcatttggatacctctggggctacacggtgatgaggatacaaatggccatgtggacaatctatgctgtttcatcaaacctggtgtgattctcttgtcgtggaccgatgacgagaacgacccgcagtacgagatatcggtgaaggcactatcagctctcactcaggcagtcgatgcgaaggggcggcagatagaggtggtgaagatccacgtgccagggcctctgtacatcacgaaggaagagggggaaggtgttcttgcaacggggcatgctgtaccgagggtaccaggcaagagattggccgcctcatacgtgaacttctacccggcgaacggcggggtcatagcgccagccttcggcgataagaagagggacgaggaagcgcgcgaggtcctccagaaggtgtttcctgatcatgaggttgtgatggtggaaggcgcaagggagatcgtgctgggaggtgggaacatacactgcatcacgcagcagcagccggtgcgcccgtcatagatgagcggccagaaaaggcagccaagccctgcattggggtgatgattcaaccatatttgttacgcccgcagcatattggttgcactttgaaacagcgtcgcgggccaatagatgcatctcatttggagattactgaataatattgtaggtgtgttctgactgtatctttcccatttgcattcgcattc

SEQ ID NO: 142 - DNA, 921 bp, Triticum aestivum
ccccacccgaaggcacgagaaacagagagagctccggagatgtcggcggacgagttgcggctggacctggaggagctgcggcggctggagggcctcgccaagcgcccccgcgtcgtctccctcctctccaacgagatccgcagcgtcgacgccaagttggcctcgcgggctgcgcctgtgcagacgcaggcgccgcaggcggtggcggtcgcggcggcggcccctgccggtctgagctatgtcacgctggggtccttcagctgggaccaggacaatgagaagatcagggtctacgtattccttgagaatgtcgaccaagagaaggtggagactactttcaagccaatgtcagtggacatcaagtttcatgatgttaaaggcaagaactataggtgtgccatcccaaaactaaacaaagaaatagttcccgagaaatgcaagattgtggtcaagcctacgaagatcgttatcaccttgtggaaagcttcttccggcaattggttggacctacactacaaggaagacaagtttaagccaagcatggacaaagagaaggatcccatgtcaggaattatggatttaatgaagggcatgtatgaggaaggtgatgaagatatgaagcgcacaatagccaaagcgtggtctgacgccagatctgggaagacggctgatccaatgaggggactgccttgagctggttgtagttttggttccggagagctgctatatgtgctgagctagtccgtacattcagtgtggtttactagagtagtgtcatgagtatccgcatcgcatgtgtggaatcgatacctgtctgatgatgatgggaatgctcgtttcctccggtgtttgattgaccaaatttgcacattttcgcatttgaactgagaaagatgaaagcatatgcttatgcgatgagaa

SEQ ID NO: 143 - DNA, 1927 bp, Triticum aestivum
gcggccgcctgcaggaaagtgttccccgtcttggtcttcttcttcttcttcttcttcctccctcccccttggctggattggaattggatgggaggcaaatcaaatcgaatcgaatccaacgggacgggacgggactaagatctacctagggaacggaaggaaggaaggaaggaaggaaggaaggaaggaagtggccgccggcgagcggtacctcgaaagacggacaagagatggcgtggcggctggcgctgccgctgctgctcttctactcccccatcctcctctgctcctcccaagtccaagacaatgatccctccaaactgttcaagagcgcctccgagatgatgagcctaaggaaatacgacggggcgctcggtctgctcaacgctatcctcgagctcgaccccaaccattccgaagcttacaggcagcgcgcaacagtgcttcgtcacagatgcagacacaaggaagctgagagtgactataacaaattcctggagctcaagcccgggactgcttcagtggagaaggaactagctcagctgctgcaggctcaaaacgcattggaatccgcttatacccagtctgatgctggagaattctcaaaagtcctggagtacgtcaacaaaatcgtgctcgtcttttctccaggttgcttaaaggcaaagcttctcaaggctaaagcgttgctagcactgaaagactattcgaatgttatttcggagacaggatttattctcaaggaagatgaagataacttggatgcgctgttacttcgtggtcgagcatactattaccttgctgatcatgatgttgccaacaggcactatcagaaaggcctacgtctagaccccgagcattcagaattgaagaaggcatattttgggttgaaaaaacttctaaagaagaccaaaagcgctgaagaaaatgctgctaagagcaagtttcgcgtggctgttgaggactacaaggcagcactagcaatggatccagaccatactttgtacaacgtacaacttcatcttgggctctgtaagactctggttaaacttggaagaggcaaggaggcaatcagcacctgtacggaagcactcagcatagatgaagaacttgttgaagctttgtcacagagaggtgaggctaaacttctaacggaagattgggaaggtgcagttgaggatctaaaagaggctgcccaaaaatccccacaggacatggcaatccgagaagcgctcatgaaagccgaaaggcagctgaagctgagcaaaaggaaagactggtacaagatcctgggcatctcgaagacagcgtcggccgcggacatcaagcgcgcgtacaagaggctggcgctgcagtggcacccggacaagaacgtggagaaccgcgaggaggcggagaacatgttccgagagatcgcctctgcatacgaggtgcttagcgacgaggacaagcgtgtgaggtacgaccggggagaggacctggaggagatgggcatggggggaggcggcggcggtggcttcgacccgttcggcggaggcggcgggcagcagtacacgttccaccacggcggtgggttccccggcggggcttccagttcaacttcggttaattaaaagcaggccaggcttactcttttgttgatgatggtgatgtcctagttttctagtagtgtgtcctggtctttgctttaggagggagagcttaacggcaacatgtgttaattatactatatctctagctaagagcttttactaccgtcgtcttggctcttgttactctggttaaagaaagttttgcttaagcaccaacgatacaacaaattttccctgagattaattaattgtaccactgtattatgatttatagctggttatttgtgatgcatcgaccagttcattggaaataaggtacgtactacgaaaaacgg

SEQ ID NO: 144 - DNA, 2271 bp, Arabidopsis thaliana
aacacttcaaaattttcattaccagaagaaagaaatcaaataccttcagatctctatcttcctcattcacacaccctctctctcttctccttttctctcttctccttttctctatctccctctttgttccgttcgcatcctctaatcatcgtcaacaagccgacgaagagagaaacgaatccaaagttcgttacttgaaagctacccagaagaattcaaatctcaggtacttttcctgtggatttgatctgggcactgcttattagggatttgattggatctacaaaattctgccttctgggtgattcaatttcacggaaatggtgaggattaagaaagtagaatcgttctacgcgaagcttcgtgagtcagctacttcattatcttcacagaatccacttttgatatttccttcaacatctgatgttgattcactttgtgcgcttaaggttattactcatatccttgaatcagattcgattcagtattcttgtttccctgtatcgtcttttttggagattcacaagtatgctggtcctgctggtttgtgttctacttcgttggagagtcctcctgttactatactgttgattaattggggttgtcaccgtgatttgaagcttgtgttgaagttaggtccttcggctcgtgttttcgttgttgatagtcataggcctattcatttgcataatcttagtgattataatgagcaagttgttgttcttcatactgatgatgatgagaggcaaggtgatttggcttatgatttcgatgtgttgaaattggcgaatgagagctttcagttacgtgtagaagatgctggtgaagaatctgatgaggaggaggaagatgaggaagaggatgaggaggatgatgatgatgatgatggtgataggccaagtaagaggaggaaaatgggagatggtgtgaaggttttcaagaagctaaagagggattattacaagatggggacttttcatgggaagccatcggggtgtttgttgtttgagctatctcatatgttgaggaagaacactaacgagttgttgtggctggcttgtgtttctttgactgatcagtttgttcatgagaggttgactgatgaaagatatcaagctgcggttatggagcttgaacaacacatcaatagctcagggaatatagataagatcactagtgttactctgaaagatggaaccaaggttcgagcaccagactgttcaagaatctcttatgaagaagagcctaggcttatgcttcttagagagtggacgttgtttgactccatgctttgttcttcatacattgcgactaagttgaagacatggagtgataacggtatcaagaaacttaagcttcttctagcgcgtatgggatttgcacttatcgagtgtcagcaaaagtttccgtacatgagccttgaggtgaagaggaagatgaagcaagagtttgatcggtttttgccagaatatgggcttaatgatttctactaccggagtttcttgcggcttcatggttatagctcaagggtctctgctgcagatgttgtctatggtattacagcacttcttgaatcatttcttgggtcaggtggctcctctgcttcaaaacagtttggtgaagcttatgatgctctgtctttgaacaatttggataaacttcgatctgggatgcaacaagcaatcaaggttcaacgagcaattcttagacaaggaagtgcagcaatcactaaaagtggatgcattcgaagtggtaggaaattcagatgggtaaagattgaagattcaatggatgcgaagtatttgggatatcctcaggccttaacaaaattctgttactttctgatggatgctttgagagagaaaggagctaggatgaaaccaatgctatgtgcctgcgcatctcaacaacctgggaagatactcgtggttggggtttgtgggaaaccgaggctcggggcagtcagagggaatgcttttggcaatgctttcagaaaggcagctcaagaaagtagagctgattactttcacgagctattcgagtcttcttggattgtcttggatgcttctgcagttaactctttcatgattagattaaccgagaagctctgacatagtctcattgttcttcgattcagtgtgttttcttttatagttttcagttttatctcactgtttgcattttttacgagcctgtgtaataggcacaatctgttatcaatcatgtaacttgtttaatcaaataaccatagagttttatgtgaaaaggtcc

SEQ ID NO: 145 - DNA, 2297 bp, Hordeum vulgare
caccaccaccgccccgccaaaccctccccacctccctcgcgcgacgcacgcacggactcttcccctctcttctctcccccccagagcagccgccgacccatccatccatctccgcgcgcggcgtcgtctccgtctccgtctccgtctccgtctccatctccgtcgccgtcgcccagcccggccgtacgcccggttaccgcgcgcgcgcgctcgcagggtaccctgcaatggatgcgccaaaggacgcatctccggcaccgaagctgcacacgaggctgagggtgtgggagtttgcagaccgctatgtatttgagccggtcgatggccttgccgacctgtacctctcagtaagccggaccaatggatctatgaacctagtgcaagagctgccaccgcgtggcccctcggcaaatccaaaagttaggatagtttttggtgtgataggagtgctcaaacttgcagtcggatcatgctgcctggtcatcactgaccgtgattgtgtcggatcctacatgggacatgctgttttcaaagttacaggactaaaggttctgccctgcactaccgcatcttcggccgagcagaaaaagatggagaccgagttttcagacctcctggatgctgcagagaggagtataggcctgtacttctcctatgaggccaacttgacacttactttacagaggctatatgatcttggcgacacgttcaaggcacttccactttggagacaggcagaacgtagatttatgtggaatggttacttgttggagcctctcattgagaacagactggaccagtacctattaccggtcgttcaaggaagttttcagaatatacatgcagaagttggatcagataaagtactagtaaccatgattgcacgcaggtgcacaagaaggataggtacacggtgttggagacgaggtgctgatccagagggctatgcagcaaattttgttgaatcagagcagataatgcaaacaaaaggatatacagcatcctatgtacaagtccgaggctctatgccttttctgtgggagcagatagttgatttgacatataaacccagttttgacgttgttagagtagaggaggcggctcgtgtgcttgagcgacactttcatgatttacaaaagaaatatggagctgtcgtggctattgatcttgtcaatacaactggtggtgaaggccgcctctatgaaagatatgcaaaatcgattgagcctattctcagtgaagatataagattcatacattttgacttccataaaatctgtggtcatattcattttgagcgcctttcacagttgtatgatcaaattgaagattatcttaagaagcataagtacttccttttggatgatcaaggcaagaaaattgtggggcaaactggcactgtcagaacaaattgtgtcgattgcttagatcgtactaatgtaacacagagcatggttggaagaaaaactcttgaaagccagctccagcaactaggtgttcttggtggtaacgatacaatcagcaattacccagcttttgatgcagattacaaagttttgtgggcaaatcatggagatgcaataagcactcagtactctggtactcctgctctgaagggagactttgtccggtatgggaaacggactactcagggaatttttaatgatctgtggaatgcacttgctagatactactttaacaattttgcagatggtactaagcaggatgccatggaccttcttcaaggacattatgtatcatcagttagtcgggacatcgcggttccaagcaaacccggagttatgcagtcctttcgtgttgcttttgcattgatattgtgcgctgctgtgttcatgattctgtcactacgacaagcccggaatgatcttcgccatttggtggtagcacttgtgtgggccggtctgtgcattggcattgcactatatgtcaaaaagaacggtaggaagttctgcaaccgacctcgtttttacctgtcacgcaattgaccgatgcacgaaggtacctttacatgtatgccgagtgatcacggtagcttgtcgcaagcttctcacagcatcttctgttatgtgaagatttattcctagaattttttttcttttcttttctgtagggcacttgccctccccaattttgtatcaaggtctattctggcacaccctcccccttcccatttttggatcgggtttaaccccgccttcctgcaattttgtatttaaattctgtccctgtctcactacggcacagtttgtttagtttggcataattgtaaatcccca

SEQ ID NO: 146 - DNA, 1685 bp, Brachypodium distachyon
cgtcatcgagcccccggcacctccaaagccaaatccaacccaccgagcaagaaccaagtagtaggggagaggaatcggtggaggaggagaggagatctcgcttctctgcttcttcgcgttctgcaagcaagagttcgccggagcagctagcggaggtggtggagaaagtccctgaggcggtaccatggcgaccaggcatcagaacgcggctgccgctccgcagccggccaacagaggtgctgcagttccagcggcaaagcagaaggccgccgccgccggccgccctgaagcaaggaaccggcgcgcgcttggagatattggcaatttggttcatccccaggccctggactgcctgaaggagggaatcaaccgccccatcactaggagctttggcgcgcagctcttgaagaatgcccaggccaatggcgccgtagcaaacaaggttgccatagctcctgctcgtcaagcagcggcgcctaagccggccaagaaggcccctgccaaggccaagatcaccaccatccccgatcaggccaagaagccgtcagaggcagtggccagcagctctgcccaaaaggcttccaggaaaaaggtcgtggacacgctcaccaaagtgcttacagctcgttcaaaggtcgcctgtggccttactgggagacccaaagaacccgtggaggacatcgacgagcttgacaagaacaatgagcttgctgtggtggactacattgaagacatttacaaattctacatgaccgcccagcacgagagccgtcctgtcgagtacatggggaatcagcccgagatcaacccgaagatgagggcgatcctcgcggactggatcgtagaagtcacccacaaatttgagctgatgcccgagactctgtacctgacaatttacatcgtagacatgttcctctcggtgcagcaggtgcctcgacgggagctgcagctcgtcggggtggcagcgatgctgatcgcctgcaaatatgaagaaatctgggctcctgaggttaacgatttcatctctatctcggacaacgcgtactcaaggccgcaaatacttgggatggagaagagcatcctgaacaagatggcctggaacctcactgttcccacgccttacgtcttcctagtccggttcgtcaaggccgccggaaacgacaaggagcttgagcacatggtgttcttcttcgcggagatggcgctgaaggagtacaacatggtctccctgtgtccgtcgttggtggccgcctccgctgtctacgcggctcgctgcaccctgaagaagagccccatctggacagggacgctcgagcaccatactaccttcaacgagacacagctattggagcctgcaaaggtgcttgtgaacgcgcacgccgctgctcctgagagcaagctgagggcaatctacaagaaatacgccactgagcaatttgggcgtgtggctctgcacccaccagcagttgctgctcagggcgtttaggatctacagcttgtgccttttgtttgagattcaagacagcttgatttcagggcgttatatgttttctttttcgtcttttggtttactcctggtgtcatgagtaaaatgctattctgctacattgatacacttatggtgtattatagctattcatgagtatcgattgaaatgaaattattcttttaaatatgtttgtcac

SEQ ID NO: 147 - DNA, 1261 bp, Setaria italica
cgtcgcgacgcggcggcggcgcaacgcgaaatggcgatggcctccacctacgcgccgggcggcggcgcgggggcgctcgcgccgggaagggccagggtccgcggccccgtggggctcgttagcctcggccccaccaggctcggcggcctcccccgccccctcgccctcgccaggcggagccccgtcgcggccggcgccaggctgcggtgcgcggcgtcttcctcgtcggcggcgcgccccgtgacggcgccgcggttcatccagcacaagaaggaggccttctggttctaccgcttcctctccatcgtctacgaccacgtcatcaacccggggcactggaccgaggacatgcgcgacgacgcgctcgagcccgccgacctctacagccgctacctcaaggtcgtcgacgtcggcggcggcacgggcttcaccacgctcgggatcgtcaagcacgtcaacccggagaacgtcacgctgctcgaccagtccccgcaccagctcgagaaggccaggcagaaggaggcgctcaagggggtcaccatcatggagggcgacgccgaggacctgcccttccccaccgacaccttcgaccgatacatctccgccggcagcattgagtactggcctgatccgcagagaggaatcaaggaagcgtacagggtcctgaggatgggtgggacagcttgcgtgattggccccgtgtacccaaccttctggctgtcccgcttcttcgccgacatgtggatgctcttccccaaggaagaagagtacatcgagtggttcaagaaggctgggttcaaggatgtcaagctgaagagaattggaccaaagtggtatcgtggtgtccggaggcatggcctgatcatgggatgctctgtcacaggtgtgaagagagaacgcggggactctcctttggagcttggtccgaaggctgaggatgtcagcaagccggtgaatcccatcaccttcctctttcgcttcctcatgggaacgatatgtgctgcatactatgttctggtgcccatttacatgtggataaaggaccagattgtacccaaaggcatgccaatctgagtgaaggggactgagctgcaaggaagagaggatagccatcatctgaattagtcttctctatattaggcacttcatgtctgttttgtatttaccttttatctatctggtgttatgcacttcttttactgtttttcatatttgtgggaagtaataatatcaagacatgggttaatctcaaaatctccac

SEQ ID NO: 148 - DNA, 1171 bp, Zea mays
accggcgcaatccgttcaccccaccactcatccactccccctccgcgaatctcatttctttactgcggctaggaggaggcggcggcggcgatgaagttcggcaagagcctgagcggacagatcgtggagacgctcccggagtggcgcgacaagttcctgtcctacaaggatctcaagaagcgcctcaagctcatcggcgccgggaacggggctgagcggcagccgaagcgggcccgccgcgacgactccggggaggctgacgcggccgcggccgcggcggcaatgacgccagaggaggcggagttcatgcagctcctggaggctgagctcgacaaattcaactcttttttcgtcgagaaagaggaggagtacatcatccgtcagaaggagctgcaggaccgggtggccagggcggccgggcgggagtccaaggaggagctcatgcgggtgcgcaaggagattgtcgacttccacggcgagatggtgctgctggagaactacagcgccctcaactacacaggattggttaagattctcaagaaatatgacaagagaactggagccctgatccggctgcccttcattcagaaagttcttcagcagcctttcttcaccactgatctcctgtataagcttgtgaagcagtgtgaagccatgctggagcagctccttccggttagtgaggcatctgtctcaagtgaagatggaaaaggagactctaatgatgaagagaagctggcgaagccaagttcttccttggtaaatggtggtggcatgccagagttagatgagatcgagtacatggagagtatgtacatgaagagcaccgtcgcggcccttaggtcactgaaggagatccggggcaagagctctactgtcagtatgttctcgttgccacctcttcagggcaacaatgcacaggacagctaccagatccgggcagagcaactagatgaggagccggagaggtggagcaaagtaacagtgatagagcaggcggccaaatgacagaccgaatgggcaaaacatctgatggctgaacttaaaaattttagacttggacatttgctggagatgggactgggatcccaatctcccattcagaaatttgtatgaattcaggattcctaacagctgcgaaatggtggacatgttaaatcatagaattccc

SEQ ID NO: 149 - DNA, 834 bp, Zea mays
gtcgcaggacccgcacgtggtccgcctgctcgacctcaagcagggcgtcaacaaggaggggcagaccatcctgtacctcgtcttcgagtacatggacaccgacctgaagaagttcatccggggctatcgcgccaaccacgagaagatccccgcacaaaccgtcaagatcctgatgtaccagctgtgcaagggcgtgggttttgttcacggccgcggggtgctccaccgtgatctgaaaccgcacaacctgctcatggaccgcaagaccatggcgctcaagatcgctgacctcggactcagccgtgccatcaccgtccctgtaaagaagtacacgcacgagattctgacgctgtggtacagggcgcccgaggttcttcttggcgccacacactactccacgccggttgacatttggtccgtggggtgcatatttgctgagttggttactaatcagccacttttccctggcgactccgagttgcagcagctcctccacatcttcaagttgctgggcaccccaaatgaggagatgtggccaggagtaggcaagctgccgaactggcacgtgtacccccagtggaagcccactaagctgtccactcttgtccctggtcttgactccgatggctatgatttacttgagaaaatgcttgcatatgagccagggaagcgggtctcggcgaagaaggccctggagcacccgtacttcaatgatgttaacaaggaggtgtactgaagcgacccgagtagtagggttcatcgagagaggatcattgtcaccttattcttcgcttagtgtgttaatatggctaccctgaagcagtacttggggtt

SEQ ID NO: 150 - DNA, 1760 bp, Oryza sativa
ccccagattcccccaaaaatccaaaatccaaaaccccaaaaaaaagcgaaacacgattccacgaaaccctcgtccccctcctcgtgagatcggattcgattcatctcgtaggcgcgtctcccctcctttcgaattctccatttcgcgctcttctctcccattcccccaatctacttaacctcctcctcctcctcgagctccgaatcccaaaaccctagccccacccgccgccgcacgccggaggaggaggagatggctgacaaggagaactccaccccggcctccgcggcgcggctcacccgctcgtctgcggcggctggggcgcaggccaagcgttcggccgccgcgggcgtcgccgacggtggcgcgccgccggcgaagaggaagcgcgtcgcgctcagcgacctcccgaccctctccaacgccgtcgtcgtcgccccccgccagccgcaccaccccgtcgtcatcaagccgtcgtccaagcagcccgagcccgccgcggaggcggcggcgcccagcggcggcggcggcggctcccccgtgtcatccgcgtcgacgtcgacggcgtcgccctcctccggttgggacccgcagtacgcctccgacatctacacctacctccgatccatggaggtggaggcgcggaggcagtcggcggcggactacatcgagtcggtgcaggtggacgtgacggcgaacatgcgggccatcctcgtggactggctggtggaggtcgccgacgagtacaagctcgtcgccgacactctctacctcgccgtctcctacctcgaccgctacctctccgcccacccgctcaggcgcaacaggctgcagctcctcggcgtcggcgccatgctcatcgctgcgaagtacgaggagattagccctcctcatgtggaggatttctgctacatcactgataatacgtacactaggcaggaggttgtcaagatggagagcgacatactcaagcttctcgagttcgagatgggcaatcctaccatcaagacattcctcaggcggttcacgagatcttgccaggaagacaaaaagcgctccagcttgttattggagttcatggggagttatcttgctgagcttagtctacttgactacagctgtctccggttcttgccatcggtggttgctgcctcagtggtgtttgttgctaaactgaacattgatccgtacaccaatccttggagcaagaagatgcagaagttgacaggatacaaggtgtctgaactgaaggattgcatcttggccattcatgacttgcagctcagaaaaaaatgttcaaacttaactgcaattcgcgacaagtacaagcaacacaagttcaagtgtgtctcaacattgcttccccctgttgatatccctgcgtcgtacctccaagatttaacagagtagctgtttttggtctgcaactttgcgatgttaacagtctgagcttgtctcgagctcccggagataaaggaagaattacagttgcagggcagcttctcagctaagttagagtgctctaagcatttagatgctgaatggttttaaagcctgatccttagggggagatttcagagtctatttaggagccactgaatcgctagcaggctaacaggcattctcctgtttttgtaaaattgtagttctgtattataacttacaacatggtgtctcggtttgttgggagaaaaacttgtaatgtttgatatgctggtccattccctttgttaatctttttttatgaaattgtcggttac

SEQ ID NO: 151 - DNA, 1516 bp, Oryza sativa
ttcccccatctcacccccaagctcggcgcaacctctctcgacgtgctaatggcggcggcggcggcggacttcgcggcgagcaagcgggccatggcctacgcgctctgcaagcacctcagcctcgatccgaatacaatatccagtacaagtattgaagagagtgatattgccaccctgttctcacatattgtgaaatcgagtgaagatgaggtactgaaatgggttgaattttccagcaattttgttggaaaatgtggagaacagcatgcattgcttggtaatctgaatcaagacttgtcccagaaatcagttctgttgggtaatggttttaaaccatcagttgctgatattgttgtgtttgcaaccatacaagtttttgtgagtcatcttggtgaaaacgagttgcagaaatatccacatgtattgcggtggatggactatatccagaacatcgttgattttggcacaacagtacaaaaggttaacttgaccaaatctgtcttcgatccaccttctcatccaaagaaggcagataaaggtgacactgatccaagttcaaagaaagttgtttcaggacagaagaatgtgggcaaatcggatgcaaatgttgattccaagaaagctgcaccagagaataaagctcctgagaataaggcaaatcctactccagcaaaaaataacaaaccttctggggataaaaagaaagcccaggagaaatctgcaggaaaaccaaatgagggagttgcggataaagctccacagaaaactgcagaaaaggactcagaatgcaatgtcagtatcctgaatatacaggttggccttattcgcaaagcatggaagcacccatctgctgacagcctcttggttgaggagatagatttgggagatggcaatgtgcatcaagttgttagtgggcttgccaagttcttcagcccagaggaacttgttaatcggcatgttgtattaatcacgaatgtgaagcctgggaagctgcgagacgtaatgtctgccggattggtcttgtgtgcttcaaatcaagatcatacagttgtagagccattgattcctccagaaggagctaagcctggagagcgtatttcatttgcagggtttgatgggaagccagaagatgttcttaatccgaagaagaaacagctcgacaagatcacaccggatcttcacactgatggaaatggaattgcaacataccgaggggtacccttcactacatctgctggtccatgtagatcttctgttcctaatgcgagcattaagtgagcagttattttaacagattccaaacattgttgtgctataacacatgctaggtggatgtactatttcatcttgcatcttattacatgccctatcaactgttgtcagcgtagcgtccatctactgtgatatctaatagaaaattttgactagccaatgtgaagaacatttgtattaccttgcaccaaatgcaaaatccttcatgaacacggttgttttcaggcaggatttctgatgagtc

SEQ ID NO: 152 - DNA, 2330 bp, Oryza sativa
gtgtgggaggttgatacgttccaaagaaggatggccgtcaagatgcggatcggacggcgaagagcaatccagcagggtattgctgaggggggattcgagtggcggcgcgtttggggttgtcgcgaggcggattcgaggggggcgctgtgggagttggtctggggggagagatctgtaagggagcggaatgcagcaggagcagcggaagaagagctctgcggaggagttttttacagagtatggtgatgcgaaccggtacaggatccaagaagtcattggtaagggaagctatggggttgtgtgctctgccattgatttgcacactagacagaaggtggcgatcaagaaggtgcacaatatttttgagcatgtctcggatgctgcgcgtattctccgtgagatcaagcttctgagactcctaaggcatccggacattgttgagatcaagcacattatgctacctccgtcaagaagggacttcaaagatatttatgttgtttttgagcttatggaatctgatctccaccaagttataaaggctaatgatgacttaacaaaagagcactaccaatttttcctttatcaattactccgggccctcaaatacattcatactgctagtgtttatcaccgtgatctgaagcccaagaacattttagcaaattctaactgcaaactgaaaatatgtgatttcggactagcacgagttgcattcaatgataccccaacaactgtcttctggacggattatgtagcaacaagatggtacagggctccagagctctgtggatccttcttctcaaagtatacaccagctattgacatttggagcattgggtgcatctttgctgaggtgttgacagggaagcctttgtttcctggtaaaaatgttgtccatcagttagacttgatgactgatcttctaggaacaccttccatggatacaatttcccgggttcggaatgagaaagcaagacggtacttgagcagcatgagaaagaaagatccagtccccttctctcaaaagtttcctaatgcagatcctttggcactaaaactcttgcaacggttattagcctttgatccaaaggaccgtccaactgctgaagaggcattgactgatccatactttaaaggcctttccaagattgatagagaaccatcatgccagccaatcagaaaactggagtttgaatttgagcagaaaaaattgtctaaggaagatataagggagctgatattccaggagatattggaatatcatccacaattgcagaagaactacagaaatggaagagagagagcaacctttctctacccaagtgcggttgatcagtttaagaagcagttctctaatcttgaagaaagcaatggaagtggctcagcaattccaatggaaagaaaacatgcatcgcttcctaggtctactactgttcactctactccaattcctcccaaggaacaacctcttgcggcctcattgaagagcagcaggcctgtctctgatgaaccttgtaaaaacccctgggtcatgggaggattttctggaaatattcccacttcttctcaggtttcacaagtggcaaaaccagtggcaccagggagacctgttgggtcagtatttccttatgagactggaagcaccaatgatccttatggtccaaggggaccagtgatgagttcagggtatcctccccagcaacaaatctcacaagcatatggttatcatcaagtgcctgcaaggatgaactgtgttgaacaatcacaagccatggatgcttataaaatgcattcacagtcacagacgcaggcctatgcttatccgaacagcaaagtcacggctgatgttgctctggacatgagaggatccacgttccatcattcagcaggatcaaagaacggctcgttagatagaatggtaacacagactgacatatacacaagatctcttaacggtattgttgctgccgcgacttcggcaggcgttggtactaacagaaaggttggtgctgtacccatcagcacctcaaggatgtattagtagtggctaacagcctaaattgattggcatatattggatttcgttgctggattggctcctaattatttaccagccaccagtaataaacggagaagtttgcctggaagatggtcagatggatgaggacgactattagaggtgattcagtttgacctcttccacttgttgtttcacctgatcagctaggtacaattgtctttcttctctgtgcaccagacaaacaacagagatgtacccagcgacatactctttcttgctaaattacaaatactacatcacacaggtcagc

SEQ ID NO: 153 - DNA, 3281 bp, Oryza sativa
cgattagcttggtggatacttggattggatccaatggcgggtggtggtggtggtgccgccgcgtgctgctagatctcgggctgtggaggcaatggcgacgcggccggcttcgcggcagcggagggcgtcttcggcggcggcggcggtggcggtggtgaggagttcgccgcagccgcagcagcagcagcagcagcaactgccgataccgcagtcggggtcgccgacgtcgacgacgaccaccaccacgtcctcgtcgcggctcacgccggagctctcgctcgacgggcccgcgtcgccgctgttcgccgggcttgacgaggacgcggcgcccaaggagaatgtcaccgtcaccgtccgtttccggccgctgagcccccgcgagattcggcaaggggaggaggtggcatggtatgcggacggcgacacggtcgtgaggagcgagcagaatcccagcgttgcttatgcttacgatcgggtttttgcaccaactactacaacccgtcaggtatatgatgttgctgctcaacatgttgtcagcggtgccatggagggagtaaatggtacaatatttgcatatggtgttacaagcagcgggaagacccacacaatgcatggagatcaaagatccccagggatcatacctttggctgtcaaagacgcatttagcattatacaagagacaccaaatcgcgagtttcttctccgtgtatcatacttggaaatttacaatgaggttgtcaatgatctgctcaatccagctggacagaacttacgaattagagaggatcctcagggaacatttgttgagggtatcaaagaagaagtagtattatctcctgcacatgccctatccctcattgctgctggagaagagcatagacatgttggatccactaacttcaatctacttagtagcagaagtcatacaattttcacactgactgtagagagcagcccttgtggtgagtctaatgaaggcgaggcagttaccttctcacaactgaacctcatcgatctggcaggttccgagagctcaagggcagaaactactggagtacgccggaaagaaggatcttatatcaataaaagcttgctaacacttggaactgtgatatcgaaacttactgacggaaaagctacacatattccatttcgtgattcaaaactaacacgtctacttcagtcatccttgagtggtcaaggacgtgtttcactgatctgtacagtgactccagcatcgagcaactcagaagagactcataatacactgaaatttgcccaccgtgcaaaacgcattgaggtccaagcatcacaaaacaaaattatagatgaaaaatctttaataaagaaataccagaatgagattcgcagattaaaggaagaactagaacagctgaaaatgggtattattactggcactccagtgaaggatgccggagaagataatatcatcctttggaaacaaaagctagaagatggtaacgtcaagctgcagtctaggctcgaacaagaggaggaagctaaagctgctttgcttgcaaggatacagcgtctcacaaagcttatcttggtctccactaaggcgacacaaacttctagattttctcctcatcctggaccaagaagaagacattcttttggggaagaggagcttgcgtacctaccttacaaaagacgtgatatcgtgttggataatgaaagcaatgaattactttctcctgttgaaggacttggcatgacacttgaagattcgaaggaggagaaaaagaatcggaaaggaattcttaattggtttaaacttcggaaacgtgaaggtggagcttctattctgacaagttcagaaggtgacaagtccagtttgactaaatcaactgctccttcaacacctattggggagagtgttaattttccttccgaaccaagaatatcaaattctttggttggtgagagtgcatcggttgatctctttagcattggccatggggagttcgctactgacagccttcatggagaagaaacacctctggccagcagaaaaacaatagatcacgttgacttactgagagagcaattgaagattttgtcaggggaggttgcacttcatacaagtgtcctaaagcgccttaccgaggaagctggaaggagcccaaataatgagaagattcagatggaaatgaagaaggttaatgatgaaattaagggaaagaagcatcagatagcgtctttagaaaggcagatacctcattccatctcaaataatcaagggatggctgacaagttagaacttactccgtcttatgctgaactgcttgagcaactcaacgagaaatcctttgatctcgaggtgaaggcagcagataacagagtaatacaagaccaacttaatgaaaagacaactgaatgcatggaattacaagaggaggttgctcacctgaaagagcaactttaccaagctcttcaagctaaggattcactgtcaaatagcattatgatgcagaagaatgcaggaattaaccatgaaactgataatcatgctgatcaagaactatcagttcctagagaggtccctggtgaaacgtcgccaaaagaaccacagtcagttgagattgatgagctgaagcagaaggtgtgtgagctgattgaagtaaaagctcaactagagactcgcaaccagaagctactagaggaaagcacatacgcgaaaggcttggcttcggctgcgggagttgaattgaaagcgttgtcagaagaagtcaccaagctcatgaaccaaaacgagaagcttgcttctgagttggcatcggtgagaagtccaaccccgcgtagagccaacagtggactgagaggtactcggagggatagcatcagtagacgacatgagccagctccaagaagagacaacaacgcaggctacgagagagaaaaggcattagaagctgtgcttatggagaaggaacaaaaggaagcagaactccaaaggagaattgaggagtcgaagcaaaaggaagccttcttggaaagtgaacttgcaaacatgtgggttctagtggcaaaactgaaaaagtctcaaggccatgatcttgaggattttgacaccaaatatattggctcgtaacatcataactctaggctaattaattattagtagtgcgactggcttgggtacgtctgtatgtaagataagagatttataccaggtttcctgttgcagtgtgaattagttcccatcttgtatattcgccggttgatcaaagttgtgaggtcttgttgggctgatgtgc

SEQ ID NO: 154 - DNA, 2251 bp, Sorghum bicolor
aaatttttcatctccaatctaaacaggccctaaaaccagtcagcggcacacttatcgccaagcgaggcagcggcggctgtcccaagctgtcgaaagcgaagcgcggcggcagtcctcgcaggcaggggccgaccggtcaaaagcactgctgctccacaccaccccaccatccccattccccaacccccaaagccgagccagcgagcgaaccaccccgcccgcagccgcaagcaagcaggcaggagccgccgcctcctcggcctctcggcggcgtgtgaccggctgaccgaccgttccgtccagcccaccatggaggcgccgccgggaccggagcccatggagctcgacgcgccccctcccgccgccgccgaggccgcggcggcggttccccccgccgggagcgacaagaagaaggaaggggaagggggagacgctgttacgggtcatatcatctccaccaccatcggtgggaagaacggcgaaccgaagcggaccatcagttacatggcagagcgtgtcgtgggtacaggctcatttgggatcgtcttccaggctaagtgtttggagaccggagagaccttcgccatcaagaaggtgctgcaagatcggcgatacaagaaccgggagctgcaacttatgcgtgccatggagcaccccaacgtcatctgcctgaagcactgcttcttctcgacaacaagcagggatgaactgtttttaaacctggtcatggaatttgtcccagagaccctataccgagtcctgaagcactacagcaacgcgaaccagaggatgcctcttatctatgttaagctgtacatgtatcagctttttagaggcctagcttatattcataatgtaccaggtgtctgccatagggatgtaaagccccaaaatgttttggttgatcctctcactcaccaggtcaagctctgtgactttggtagcgcaaaagtcctggttcctggtgaaccgaacatatcttatatatgttctcgttattatcgtgccccggagctcatatttggcgcaacggagtatactacttcaatagacatatggtcagctggttgtgttctagctgagttgcttcttggtcagccactgtttccgggagagagcgcagttgatcagctggtagagattatcaaggttcttggtactccaacccgggaggagataagatgcatgaatcccaactatactgagttcaggtttcctcagataaaggctcatccgtggcacaagattttccacaagagaatgcctcctgaagctatagaccttgcttcccgtctccttcagtattcaccaagtcttcgctgctctgctcttgatgcatgtgctcatcccttctttgatgagctgcgggcgccgaatgcgcgcctaccaaatggccgtccattccctctgctctttaacttcaaacatgaactagcaaatgcatctccggacctcatcaacaggcttgtaccggagcacattagacggcagaacggtgtcaacttcgggcatgttgggagctaggagggcaggcgttgcgatggtcgagtttttggtcttggttccccatgtgcagggccgatgcaagcgaaggtgatattgcaccatctggagaggagagaggggctcagcagtaccagagagaagtgagtatgtaaattatctgaccgttaaggagtaccgccagtgttaagccagtaactggcacatgttggtccagtagttaagggtaagaatgtaggtggagactggttaatgcttagggttgtttttggttattaccattttgtaatgttcgttggtacttccccagcagtagtgtagctgctcctgttttgttcgtccgccatgatgtaaatgatcatcacccaactgcaatgtctgttctctctgatcgtttcttagtcctgatgctgttgtgatggagctctgactcggaggcaggaaagtgtgaagtacttcacgctctcgaaatggagttgctgctggtgaaactatagcgaggttgtattgaaattttgcgttccaacatacagccaagtacaaatgcatcttgcctattctattggttggaacttggaagtagtctgatcagtagttcaatcgcaaatgttcattcccagctcccaaggccacaaatactttcggattgtagtgtacatgaacaattccttcaaatcgtagtttgattttgtttttacacagagatgatcgaaatttacaagcagacagctgcagtttatagacgcgg

SEQ ID NO: 155 - DNA, 2117 bp, Sorghum bicolor
gcttttggctccatcgccccctccacttcggagcctctctttcggcggcggcgcaagaagagatggcggagcggctgacccgtatcgccatcgtcagcgaggacaagtgcaagcccaagaagtgccgccaggagtgcaagaagagctgccccgtcgtcaagactgggaagctatgcattgaagtgacttcggcgtcgaaactcgctttcatttctgaggagctgtgcatcggttgtggtatctgtgtaaagaaatgcccatttgatgccattgaaatcatcaaccttccaaaggacttggaaaaggataccactcaccgatatgggcctaataccttcaagctgcacaggttgcctgtcccgaggcctggtcaggttttgggccttgttggaacaaacggaattggaaagtcgacagctcttaaagtgttggctggcaagctgaaacctaacttggggcgcttcaaaaacccgcccgattggcaggaaattctcacatatttccgtgggtctgaacttcagaactacttcacacgcatattggaagataacctgaaggcaatcatcaaacctcagtatgttgaccacatcccaaaagctgtccaagggaatgtaggacaagtacttgaacagaaggatgagagggatatgaaagctgaactgtgtgttgaccttgaattaaaccaagttattgaccgaaatgtaggagatctttctggtggtgagctacagagatttgcaatagcagttgttgctgtgcaaaatgcggaaatctacatgttcgatgagccatcaagttaccttgatgtgaagcagaggctgaaagctgcacaagtcattaggtccttgcttaggcccaacagctatgtcatcgttgtggaacatgacttgagtgtcttggattacttgtccgacttcatttgctgtttatatggcaagccaggtgcttatggtgtggttaccttgccattctcagtccgagagggtatcaatattttcttggctggatttgttccaacagaaaatcttcggttccgagacgaatctcttacatttaagattgcagagactcaagaaagtgctgaggagattgagacgtatcagcggtacaagtaccctactatgagcaaaacacagggaaatttcaagcttactgttgttgagggtgaatttactgattcccagattgttgttatgcttggtgaaaacgggacagggaaaactacattcattagaatgctggctgggttgttgaagccagacacagtcgaaggcactgatattgaaattcctgaattcaatgtgtcttacaagccccaaaagattagcccaaaattccagaataccgtgaggcatttgctgcatcagaaaattcgggattcctatatgcaccctcagtttgtgtctgatgtaatgaaaccactgcaaattgaacaactcatggaccaggaggttgttaatttatcaggtggagagctccaaagagttgctatatgcctgtgccttggaaagcctgcagatatctatctgattgatgaaccaagtgcttatcttgattcggagcagcgtattgttgcctcaaaggttatcaagagattcattcttcatgcgaagaaaactgcatttattgttgagcatgatttcatcatggcaacatacttggctgacaaggtcattgtttatgaggggcgaccttctattgactgtactgccaatgcaccacagtctttagtatctgggatgaataaattcttatcgcatcttgacattacttttagaagagacccgaccaactataggccacgtataaacaagttggactctaccaaggacagggaacagaagtcagctgggtcttactactacctcgatgactaatgaggaagtacagaatctttttggagagctatacgacgcataatctttccagggcgtggaagtgagaagctacttcgaagctacaaactacatcatggcatgagacttgtttaataattggttgcaggagtagagtgcaccggttacaacttataaagcagagcatgctgtgttgatactgagtttttgtttggcttgacctatatgaagagaaggatcggtgttaaaatgggctttggg

SEQ ID NO: 156 - DNA, 1075 bp, Sorghum bicolor
gacgggggatggtcccacatggcgggattgcgagtaccagtgccatgccgtggatggatgattgatgcaatggaatagaatggggaaatggacgtccggtcctgagcgttcataagttggtcccatcccatcctctctatccccttatcctgaattccttatcaatgcaatcctttcgctgcttgccatgccagtcagtagctagctagctagctccaagaacgaaggaaaggaagcagcaggaggagtatatagcgagtgtgtcgcacgtgtgtgtctctgactctgtatatataggcgtcgtcgcttgcccttgcgtgcagtgaggggaagatcgaagcagcatcagtacgtaagaactgaatcgaatcgaaagatgatggatgaggagcacgagcagcagcagccggtgccggtgccggtggcggcggaagcagcggtggagaaagacaataagaagacggcgaagaggaataataaggtgtgcgtgttctgcgggagcagccccggggtggagcggggcatggacctagtgtacggcggcggctgtgcagctctgatgggtctggtgtcccgcgccgtccacgacggcggagggcacgtgctcggcgtggtgcccaaggcggtgctgccgctggagctcatcggggagacgccaggggagctcaagccggtggccgggatgcaccagcgcaaggccgacgcgctcccaggtggttacggcatccacaccaagcccgtgggcctcctcaacgtcgatggctactacgacccgctgctcgccttcgtcgacaaggccgtccaagaagaattcgtcacccccctcgaacgcacaatcatcgtccacgccaacaccaactcctcgacaagctccagctccagctccacgaccaacatcaacgccgacgccgacgccgacgcctagctatattcatccatccatcaccaacccaacaactccaacatcctcatacatactcacgtgtatacacccaaaaaactattgtgtaccagcagcatacacacgtttagttattgcttgcttaatattggctacttcatcgctccagcagca

SEQ ID NO: 157 - DNA, 2591 bp, Sorghum bicolor
gaccggtgggaccggttggctggcccgcatagcagagcgaagctatactaggcgaggcaggagcaggagtctactttcggccgcctctctcgcccatagttctgcacttctgctccaaatcccctcccctccccctccatccccccgcggcggtctccggccaccgtgctgcgcgcaggacgagccccgagcctgagcgcttggtctactgccatggacgacgaggcggccaagtctgttcctacatcagacatgaataccgacgctgccgcggaagccgaggcggccgccgctccgctgcggccctcgagctctgaagcggcggagagggaggcaaaggttgagggcgcggatgaggagggccaggtggttgagcgattggtcgagctggtgagcgagatcgcgaccatctcggacttcaggaactcgtacaggcggcagttctgcaacctgtcccggcggatccggctcctcgtgcctatgctggaggaggccaaggaagcgcccgcgccgcttccggcggcgtcggaggccgcgctacggcggctcagggacgcgctccacgccgccagggagctgctccggctcggcagcagcggcagcaagatcttcctggttcttgatagagagaaaataatgaagactttccaggatgttactgcaagacttgaacaagccttagctggtatttcgtttgatgaacttgatatatctgatgaagtaagagagcaggttgaattggtgcatactcagttcaaaagagctaaggaacgatcagattcatctgatgatgatctttttaatgagctgatgtctctctataattcaagcagcagtgctagtgttgacccagatattcttcgaaggttatctgagaagttgcagcttgtcacaatatatgacctcaatcatgagtctctgaccttgcatgagatggctagaggcggtgatcctggtgcagttgttgaaaagatgtcaatgctcctcaaaaggattaaggattttgtgcagacagaagaccctgagatgggcgctcgagcaagtacagcaaacattttcccaaaagacaactcagcacgtcctgttattcctgatgatttccgttgcccaatatcactggatttaatgagcgacccagttattgttgccactgggcagacttatgagcgggggtacatagagatgtggctggaggctggccatgatacctgtccgaagacacagcagaagcttgctaataaatccctgactccaaattatgtcctacgtagcctcataactcaatggtgtgaggcaaatggtattgaacctccaaaacgccctgctcaacttaaggatgcaccattgccatgtagtgctgctgaacatagcaatgttcttgagcttcttcagaaactgtcatcccaaaaccttgaagatcaacgtggcgctgctggtatgcttcgtcagcttgccaagcgcagtgctgaaaatcgtgcttgtattggagatgctggtgctattcctattcttgttagtatgctatcaaccactgatgttagcacccaggaacacgtggttactgctctcttgaatctttccatctatgaagagaacaaggcaaggataatctcttctggagctgttcctggaattgtgcacgtattaaagaggggcagcatggaggctcgggagaattcagccgccacactgttcagcctatctattgtagatgagaacaaggtgactattgggtgctcaggggcaattcctgcgcttgtgcagctattgagtgacggaagccaacggggtaaaaaggatgcagcaacagcactatttaacttgtgtatttaccagggcaacaagcggaaagctgttagagctggattggtacctatactactagaactactcatggagtctgaaagtgggatggtagatgaggcccttgcaatattggcaatcctctcaggccaccctgaggggaaagcagctattggtgctgcttctgcaatacctgtacttgttggagttatcagaactggatctccaaggagcaaggaaaatgctgctgctgttatggtgcatctatgcaatggcgaaggagaacagcagcaacagcatcttgctgaagcacaagagcagggcatcgtgtctttgctggaggaactagcagaaagtggcacggacagaggaaagaggaaagctgtgcatctgctcgaacgaatgaatcggttcctaaagcggcagagtcaagcccaagccgaagcagaggccatggcacaggctcacgcgcaagcacaagcacaagcacaagcacaggcacaagcacaggcacaggcacaggcacaggcacaggcacaggcacaggcacaggcacaggcacagcctcagatcctggttcaagctgaagcacacgcagatatgcaagctgagcgatcactacttcccacttcaccagatatttctgatagatgaggtttttgatcagcagcttgttttgtctagttattggcttgtttttttttagctcaggctggcaggtggaagattgcctgcaattgttattgtggaggtttctggtttctgttgaacactgcaaattaggaggt

SEQ ID NO: 158 - DNA, 2913 bp, Sorghum bicolor
gatgccagcccatgaacgctggtgggcctacccaagtacccagcctttcctccacagcctacccgggaacgaagaagcccacgcctaacggccgtgccaccgccctcacagttccaggcttccagttccagctcacccctgcttcctcgggcggcggcgccgccgccgtttggcgcacgcgcgatgccggcgacggcggaggactccccggcgatacggaagctggggcagctcttccggctgaccgaagtatacctctgggacgattcgtatggcgctggacctcacgatggacggaagaactggcgctcggcggaggctgctctcgtggactctcatacagataaaacatgcaatgaagcatccaatggcactgacaaaggccatttgtttgttgaagatttggaattggccaacctcatgggttctttggggcttcctgtttcattcagcacaagtaaagtgaacaagaacacaggcaacaagggaaagaaaaaaggaagacaagcactgctcaaagcagcaaagactcaaatcaatgatgctgtgaggatatgtgccaatactgaagatagagaaagtgctgttgaatcattggatgttatggcgcacatgcactcatgcaatttatctgggactccgctgggtcacaatgaaccctgccatgatgacactgacaagatgcttagggaagacagtccttgtgttgaagaacaagaagagtctggctgtagcaccatctattctgctgacaaagcccctagctgtgatgctaaaaatctgctcactgaacttgggacttttgagctttctgataacttgggcaacccagcaaaagaagattattcaattcaagaaaatcaagcctctgacagcgtgttgctagattctgaagagatgccaaggcatgactgtgttgatggtgaatctacacattcctgtgtcgacatttatcaggaagaaagagtgtccacaagggaagatcaaacatctgaagaaactctgtcagtatcccatgatcataatgatgttggccaagaagctagtctaagtttggcagagccatcttctattgatgagcatgcacaaagttctgccaacaacttttactatgactatggtgaatggagggttgtctgggatccgttctatagtcggtattatttttacaacatccagacacaagagtccacatggtgtcctcctgaaggattggaggattttgcatcatattgtagcccagataccactaaagagctagttgaactgggatctcagtgtacaagcatagcaccgcaagagaacaatctggctactgatgacaatcatttagaagcacaggaacaagatcactgcattcatgatttatctgacattcctgtcgaaaaagcaatatatcaaagtatgataactacctctgacaaagcacagcacactgaaaataagtacagcgattcaacaactattgtgttagagatgaaccaggaagttactaccaccaaaaagaaaaagagagtaaggagatctcaatcgtatcattcatgccaagacatggcagggaacatctccaatgacatcatcaagtactggactcagcggtactcacttttctcactttttgatagaggtataaagatggatgaagaagggtggttttcagttacgccagagcctattgcaaagcatcatgcatctcgtgttggtgcgggagtaatcattgattgtttcacaggagttggtggaaatgccatccagtttgccacaaagtgcaagcatgtaattgcagttgatattgatccacaaaagattgattgtgcacatcataatgcatccatttatggagtaaataatcacatagatttcattgtaggtgattttatacatatagctcctcatctgaagggagaaactgctttcatgtcgcctccttggggtggacctgactatgccaaagttgatgtttatgatatgaaaagcatgcttttgccttgtgatgggtactctcttttcaaacttggtactatgatagcttcaagagtagtgatgtttcttcctcgcaacattgatctaaaccaattggctgacatgtccttgtctgtggaccccccatggtcggttgaggtcgagaagaacttcctcaacggaaagctgaaagccataacagcatactttgaagaacaggattgttgagtcgcgcatcggcactggtgatacaaatcatcttgtgaacttaggactcacgaccaattttggagggaccttgagtataggacttaggacatgtccctctccaatggatacaatgaaggggtcttggatgttttcaccaaaggacatgccccttcgcctttggtgaagacagtatttgctaattgatcaataactgttgtctaattctaacaatttgccctgagcccatgatgaaacagaaatttgttggcagaggcgagtcaagagaatgcctaaccttcattggtatcatacaaaagtagctcagcttatctcaattctcagcaagtgaaactgtgaaacgaaagctacaggcagacagtcgaaagcgtgggagttagtttaattttgccctatgataaacaagcaaagcttcctggtttggatgtgattgtaattgtgaaatatctggtcctgcgggtacgtgagcggtgcaaatgtatgtatgtgtcgtccatgtaaatgtaataattggggagagaaacgagacggcatcatggttccaacttgaaaagtttctgtacggattttctgccttgtttggatgttattggattcaccttaatctacatgtgttagggtggattgaggtagacatgtggattgatgctaatttgacatccaaacaaggtctaactctaagaacatatccctgtaataattatactaacatatttgaagaca

SEQ ID NO: 159 - DNA, 1819 bp, Sorghum bicolor
cctggctctcccgcacttcagctccgcaacaaaccccgcctcccgcccgcgcctgtctccgacgacgccagcgcaccgtccgcagaagccgaccccggccgggcgaggatcctgctccccgctccagacccgctgacccgggcagccaccgacgccgcatggagatcgtgcgctcacaccggcaggtcgccgccgcagctgccgcagccggcggcgacggcggcggcgcgggggcgctgccgacctacaaggcggcgccgcagctcgaggtgcggctggaggagttcgagctcttcgccatcgaccgcctccgagttctcaaggggatttcggatggactctcgcgggggaagaggcccgaggagatggagaaactggtcagtgaattgtggaagacatacatgaggcaccaggatcctgcagagactttgaacaaggatataatatcacactttgtgctccgcctagtctactgcagaacggaagaattgcgaaagtggtttctctccatggagactgcactttttcggtatcgctttcggcttgagagtcctgaatcacagaggatgcttatgactgagtttcaactgccatacaaagcactgccacactcagagtttgaggctgtgaaagacaagttgagccaagttgcgcgttccatcggtcaatctgcaaatgtggagcatgtgttcttcaaggtaccttttgaagaagttcctgatcttgttgccagccgccgggtatttctttcaaaaggctatgcttatgtggcgatgagccaggtggtttcgctagtggttactcaattccgctgcaatatctcaaaggcacttgctttaacaaacagaaaatggacagcaaccattaaagaacaagaaaaaggcaggttgactcctattgtcgaagcattaagtaatgcatattttggtcctgattactctcagccaaaggatactgttgacatatctctaaaggatattgaccaactggctaaaagttctttccctctttgtatgcggcatatgctagataagttgagagaaaatcaccatctgaagcatgggggtagaatgcagtttggtctttttcttaagggtgctggactaaagttggaagatgctcttgcattttggagggcggaattttctcagaaggttggttctgagcggtttgacaaggaatatgcctataccatcagacataattatggaaaagaaggaaaacggacagattacacaccatattcatgtcaaaagatcatttctgcaacacctggtgttggagatcaccatggatgcccgtttcgacatttcggcgaagaaaatttgcgggcagcactcaacaaaatgggcgttggtgggcatgcattggaagagataatggataaagtgaagaacaggcattaccagctagcttgcacattaacctttgagaccacacacggtgtctcctgtgattctggaatcaaccatccaaatcaatatttcagtgaaagccagaaaattctgcgagccaaaaaccaaacaatggagagccaatcacaatcagcaacctaaattgaatcgcagctggagaaactatccgttttcaaaaaaacttaccagctgctggcttggcctagaaagaaaacctccaggctccagctgcgagctgtcataccctacaagtgatggcaccacactctacactagaatagaagtgttacctagtgctgcgaacagcagcaggtcaaggctgtacatgtaattctcgaaagtaccataagtgaatattctgaatttaatgtaggatcagctgtgctgtgctgttatgttattgt

SEQ ID NO: 160 - DNA, 6193 bp, Sorghum bicolor
cggcctcattcattttacctgcccggcggcgactctgctctaagttgctgacggcgagcggcgcggacgacgagcaggcagcccgcggcgtgtcacgggagcgctaggagagtctgttagggcatatagccgcagcggaccagcgtggcagcggcgcgcgaccgaggaggttagagcgttcgccgctatggcgccgccgcgcggcgacaggaagaaggggaagggcgccggcgggaagaccgatctgcgccccgaccggaagcagttcaaagggcatcgcaaggaggttgcagccgctgagcagggggatggcgacggagagcggcagcagttggcagcgccgggttccgctgcgctcctcgccgcagcttctgacgaagctgacttcccgagagggggacgcagcctcctgagcaaggatgagatggcggaggctcgcgcggaggcggagcaggatttcgagagggaggggaagaagggtaaggggaaaaggaagaggaggggcggcgagtcgtctggttttggcccggacgacgacttggggacactctttggtggcgccaccactgggaagctcccacgctatgctaatcgcatcacagtaaagaatatttcaccaaatatgaagctctggggtgttgtaattgaggttaaccagaaagatattgtgttaagtctacctggtggaattagagggtttgttcgctcagaggatgtgtgcgacattgctttgcaggaaaatcgcaaggatagtgagaacagtttatgtgcaaaagttgttcatgttggtcagcttgttccttgtatagtcctacgagttgacgatgataagaaagaaggaaaagtaaacagacgggtttggctatcattgcgattaagtctactgtacaggggactttccttggatggcttgcaggaaggaatggtacttgctgcccaagtcaaaagcattgaggaccatggttacattcttcattttggagtatcctcctttagcggatttatgcaaaaggatgacaaagaaaatgtgaagattgagcgccgacaactgatgcattgtgttgtgaaggcgattgacaaaactcgggctattgttcacttgagctctgatgaagacttgctttgtaaatctattattaaggatctgaaaggcctttctattgatcatttgattcctgggatgatggttaatgcacgcgtccattcagttcttgaaaatggagtcatgttatcatttcttacttatttcagtggaacagttgatatttttaatttgttgaattcctttccctctggtaattggaaagatgattacagtaagaataagaaggtaaatgctcgcatcctgttcgttgatccatcaacaagagcagttgggcttacattgaacaaacatttacttcatcttgaagtaccccctattaatctaaaagctggagatatctacgataaatcaaaggtgctgagggtagataaaaaggctggtctttttctggaaataccttctccaactccatcacctggatttattagtatacatgatgtgtcagacaaggatgcaaaaaacttggagaagtttaaggaaggcagtagcttacgtgtccgtatacttggagtacggaatcttgaaggagttgcaataggcactgtaaaagacagtgcttttgaagggtctgttttcactcatgatgatgttaaacctggaatgttagtgagagctaaggttgctactgtggagccattcggtgctattgtacagttttcaagtggtgtgaaagcactttgcccgcttcctcacatgtcagagttggaacatgttgtgaaaccaccaaagaaatttaaggttggagctgagcttcttttccgtgtattgggctgcaaatccaagagagttacagtgacatacaagaagtctctggtgaaatcaaaacttgatgtgctagcatcatatgctgatgcaaaaattggtttagtgactcatggatggattactaaaattgaaaagcacggttgctttgtaaaattctacaatggagttcagggttttgttagcagatctgaccttggattagaggctggaactgaagcagaaaatgtttatcatgttggtcaagtggtcaaatgtagaattatcaatgtgatacctgcttcaaggaaactaaatgttagttttgtcatatcccataatagggttattccaatagacactccaaagttgggtagtattgtctctggtgttgtggaacggcttactcctgcagctgttgttgtcagtgtaaatggcttctccaaggggacaatactgaatgaacatttggcagaccatcatggtcaagctgctcagttgaagaatttgctgaaacctgggcacgagttcaaccaacttctagttctcgatattgaaggtcacaatttagttctttcggcaaagcactcacttatcaattgcgcaaatgacattccttctgagatatcgcagatgcatcctggagttgtagttcatggttacatctgcaacattatcgaatctggatgttttgtccgttttctcggacatttgactggtttctctcccaaggacaaagcagttgataggcggatagaaaggctttctgatgcgttctatgttggccagtcagttcggagtcatatactcagtgtaactgcagaaactgctagagtaaaactctcacttcaacagtcaatgtgctcctcaacggattcttcgtttattcaaggatactttcttctggatcagaagattgcagcattgaagtactcaagcaatgattgggctcacacttttggcattggtagcttagttgagggggaggtgggagcaatagaagaatatggtattatccttaacttcaaagaccatctggatgttgttggcttaatcgagcaccatcagcttggtggcagtagtgtggaagtggggtcttctgtgaagggccttgttttggatttatctgatggagttgttaatttgtcccttaaaccagagctaattggcagtgttagaaatgttggaaaaaagaagaaacgccaaagggctgcagttgcagacttggagcttcatgaggaagtgaatgcagttgtggaaataatcaaagggagctatttggtcctttccatccctgagtacaattacgcaattggttttgcaccactgatggattacaactcacaactgcttccccaccaccactatgataatggacaacgcattactgtggttgttggaaatatcccaagttctgactcttctggaagacttatcctactaccaaaggcttcagctcagtattctgccctctctgaatctaaaagggctaagaaaaaatcaggctacaaaattgggtcacttgttgaagcagagattattgatatcaagccgcttgaacttctactgcaatttggtggcaatcttcatggaagaatccatattactgaggttcctgaaaaggattctgatgagcatccctttagtaaactcagaatagggcaaaagcttactgccagaattgttgcagaggctgaaccttctggaaagagtggcaaaaacttcaaatgggaattgtctattaggccatgtatagtcaacggagagtttgacgaattaactgctcaaaaagaacaaaagcacaccacaaatgagattgtacgtgcttatgtcgtcaaggtggataaggaatgggtctggttaactgtatcaagaaatgttatggctcatttatttgtacttgatagttcttccgagcccagcgaactgaaagaattccagcagcgctttagtgaaggccaagcagttaaaggccgtgttatcaatgtgaatcgggagaaaagattacttcggttgaaggcacttgataaccaatgcacacagctgaatatagatgaaatacaacaatcaaagtcctctgtgtttgaacaaacaaaacaaggagatatcatcggtggacgtgttcaaaaaattctacctggcgttggtgggcttgtcgttcagattggacctcatctccgtgggagggttcattatactgaaattgttgactcatgggtgaccgaacccttgtctggattccatgagggccagtttgtgaagtgcaaggtcctgtctgtgagccgctcatcagaaggatcacttcgagttgatctatcactccgttcatcaaacctgatcagagactctaacaactcaggactagttgatgatctggcaacctgtacctcccggatcgaaaagatcaaggatctgcttcccggaactgagattaagggctatgtgaagaatgttaattccaaaggatgttttattatgatttctcgaatggttgaggctaggattactctatcaaatttgtcagatgagtatgttgaaaatccgcagaaggatttccctgttggaatgcttgtacacggaagggtcctgtctacggacccatcatcagggagagtggaggcatcacttaggaagaccactggttccaaattggaaaagctggatgatattagttatagtgatttgcatgttggggatatcattgatggccaagttaagcgggttgaatcctttggattattcgttacaattcggagaagtgaactggttggtctgtgccatgtatcagaactttctgatgaacctgtcgttgatattaactcttgctataaagctggtgatatggttaaagccaaaattctgaagattgatgagaagcggcatcgagtatcacttggaatgaagaagtcgtactttgattctgatctgactgctgacacaaatgatgatgaagatgatgaaagtgctcttatggacatcagtgttgcccctcagatggttgaatatcataatagaagtttagttaatcgcaaagcagaaccaatggcttctgtgccgcctcttcaggtttccttggatgaatctgaatgttctgacctagaggataataataataataaaggccctgaaattgcaaatggaactgaagcaaatgctaaaaagaatgataaacaattaaagaaggaagcaagaaaacaaagggaactagaaatcagtgctatggaggaaagggctttgcagggagatgtaccacaaactccagatgattttgagaagttggtcaggagctccccaaatagtagttttgtctggataaaatatatggccactttgttagatcttgcagatgttgagaaagcacgtgcagtagctgagagggctttaaaaacaataatcccaagagaagaagaggagaaacttaatgtttgggtagcatatttcaatctggaaaatgaatatggtagtccacgggaggatgctgtgaaaaaggtattccaaagagccttgcaatattgtgatcccaaaaagttgcacttggctcttcttgcgatgtacgagaggaccgaacagtatgaacttgcagatgaacttcttgacagaatgaccaaaaggttcaaaacatcctgcaagatatggttatgccgcattcagttcgccctcaagcaaggcaaggatgttgcgtgcatcaaatccattgtaaaccgtgcgcttctaagtttgccacataggaagcgcataaagttcctctcgcagacagctattctagaattcaaatgtggggtgcctgaagaaggaagatccagatttgaactaatattgcgggagtacccaaaaagaacagacctttggagtgtttatcttgaccaagaaatccgccttggtgacatagaagttatacgggcattgtttgagagggtgacttgtcttaccctacctccaaaaaagatgcagttcttgttcaagaagtaccttaattttgagaagtcacttggtgaagacaacgaaagaattcagtttgtgcagcagaaggcaattgaatatgttcagagttcactgccgtcacaagacaacccttgaacttatgatacttgatctttacctgagacggagattgataatcccatggacaatcacgtttttgaggaagacaagcttaggaaatcggagattgataagcccaaggacaatcacatttttgctcgttacaggaagacaagattaggaaatgccagtcgtacagtagatgtgatctctttgatgaccccttgaacattattgttaaaaggtcaatgtaaaatgtgggctattcaaaattttgtttgaaactgttatataagttatgaagca

SEQ ID NO: 161 - DNA, 1268 bp, Sorghum bicolor
ccaagacgagggagccccgccgcttgtttctgcccagggcactccactcccctcccctccacgctccctgctctgttcggtgcctctgcctcggctatatatacgcgggcgcaccagtccagcaagcaacaataaaggcgggtgtcgaagaggccgggtaggaggaggagagctttggaccgagcgagagagcgagaggaattaatgggtgaggaggccagctgcaacgccgtcagcgcgatggaggccgccaccaacgccaagccggcggccaaggagaacggctgcgcggccgccgtggcccaggaggcggcggcccccgtggccgcggccgacccccggctgcagggcatctccgacgccatccgcgtcgtgccgcacttccccaagcaaggcatcatgttcaacgacatcaccacgctgctgctgcgccccggggtgttcaaggacgccgtcgacctgttcgtcgagcgctaccgtgggatgcgcatcgacgccgtcgccgggattgaggccaggggcttcatatttggcccagcaattgcgttggctattggcgccaagttcataccgctgcgcaagcctaggaagctcccaggtgaggtgatctctgagaagtatgttctcgagtacgggactgattgcttagagatgcatgttggagctatcgaacggcctggtgagcgtgtgctgatcatcgatgacttggttgcaaccggagggacactttgtgctgcaattaggcttcttgaacgtgctgaagctgatgttgtcgagtgtgcatgtctcattgggctcccaaaattcaaggatttctacaagttgaatggaaagcctgtatacgtgctggttgagtcccgtgaatcagataaataagagcttatggtcagaggaaaactggtgcctggtgggttaattcgttgctactgcggttgaacagtggagggtcatcgacaagacaactaaggctagctgctaaaagtcttggtgggcggggagagattagagtgttgagagtgtagtcttgtaggctgagtagtttttcagagtactgaagagcgtgtagttctgtccggaacatggttaattagttgagtgttgctgttccgttgcttgttgaattttgtggtttttgtttgatgggcgcagacagggatgcatgggagctcgagggaagaacttcgacagcaatacccgtgcttttaacgttatctaggaagtaggaacctgccttcttatctctgagctcgaaagtttggtggcaaaat

SEQ ID NO: 162 - DNA, 1658 bp, Sorghum bicolor
aacattcctcccccaaattgtctcccatccccaaagtaaaaaccgccaattcccctcccggcgagccacaatgccgactctccgcagcgcgacggcgaacgcgtcgtccgtggccgtgggcacgccatcccctgcggcggcgagcacgccgcgcagcgtcaagcgccggctgacgccaggccgcgccggcgagttgcccgccgcgtcgcggcacacctcccctcacagatccccgcacgccggcaccggaaccgtatgcatgccgaagctgctctccgcgtcgccgaagtcctccaggaagcgtctctacggcgaccttgtcgcagccgagaagcccaagtggaatccccgagatgccgcgcagatgagggctgtcaaggaggcgctgcacgtggcaacagtgccgtcgtctgaattggtttgccgggacaacgagctcaggcgcgtccttgagttctgtaaggctagtgttgagcaggagaaggctggtagcctctatgtctgtgggtgccctggcacagggaagacattgtctattaacaagatcaaggatagcttggtgtgttgggcggatgagatgggaatggagacacctgattccttagcaatcaattgtacaaacctagccaacacctcagagatttttggcaagatactaggaaaatttcagaaccgaaagaaaggaagcagcaaattgtcgccacttcagcaacttcagagcatgttttccagcaaggattcagctccaagaagaatgatgctggtcattgtggatgagatggactacttaataacaagagaccgtgctgtgctacatgatcttttcatgcttacgacttgtgcattctctagatgcatactaataggaattgcaaatgccatagacttagcagatcggtttcttccaaagcttgaatccttaaactgcaagcctcttgttgtgacttttcgagcatattccaaggatcaaatatctgacattgttaagcataggctaaagggtcttgagtatgatgtttttgaaccactagctctggagttttgtgctagaaaagttgcagcagcctctggtgacatgagaaaagctctaggcgtttgcaggagtgctgtggaggttcttgaagcaaggctacaagattcccctgatcaagaactaggaatagtgacatttgaccatatggatatagctttgtcaaaagcattcaagtcagcagtcatagatagcatactatgtcttccccagcaccaacagatggtgctgtgtgcgttggcaaatacttttcagcattgcaagaaaaaggctactactctaggcgagctcaacaaatcgtacattgagatttgtagatcaacccaagttccagcagttggaatgcttgaattttctaacatgtgtatggttttgagcgatcaggggttcatgaagctagggcaatccaaggaagataagcttaggagagtaacacttcagattgacagttcagatatcacttttgcctttaagggaaatcgtttctttcaaaaatgcctggagcagccaagatgctaactagactcacagtagatcaatgcatgtagccaattgttgttatacactacagtatttagtttattgacattgtcaagtaccagcagtttcaaccctggatgtgctactc

SEQ ID NO: 163 - DNA, 1560 bp, Sorghum bicolor
ggctgctgtcccgaagcgggaaacagccttcgcggcggcgcattggttcgcccttcgccgtccttgccagcgccgccgattccgaccgccatgggaatcaaggggttgacgaaggtgctggcggagcacgcgccgagagccgcggtgcagcggcgggtggaggactaccgcggccgtgtcatcgccgtagacgccagcctcagcatctaccagttcctcattgttgttggaaggaaaggatcagagcttctgaccaatgaggctggtgaagtcacaagtcatctgcagggtatgttgaaccggacagtaagaatgctagaagcagggataaagcccgtatttgtttttgatggtgagccacctgaaatgaagaaaaaggagcttgcaaaaaggtccttgaagagggatgatgctaccaaagatcttaatagagctatagagattggagatgaggatgcagttgaaaagtttagtaaaagaactgtcaaggttacaagaaagcacaatgatgactgcaagaggttgttaagattgatgggtgtccctgtagttgaggcaccaggtgaggctgaagcacagtgtgcagcactttgtgaaaatcaccaggtttatgctgtagcttcagaggacatggactcactgacttttggtgcccgaaggtttcttcgtcacttaactgaccttggttataagaaatctcctgtgacagaatttgatgtgtcaaaggttttggaagaacttggactcacgatggatcaattcattgacttgtgtatccttagtggatgtgattactgtgagaatattaaaggtatcgggggacaaagagccttgaaactcattcgtcagcatggttgcatagaagaagttctgcaaaatctgaaccagacgagattcagtgttccagaagactggccttaccaggaagttcggactttgtttaaggaacctaatgtttctgcaggaatttcagatttcacgtggacctcaccagacacagagggccttatgggtttcttgtcaacagaaaacagtttcagtcctgatagggtaacaaaggcattagaaaagataaaggctgcaagggataggtattccccaggcagattgaagcatttaacaccagttgctagcttaccaggaactcacactggcaaggaacccaaatgcatactaggttctccaggacaaagtctgaaggtcaggtcatctccacaagtatgcaagagttcaagctctggtttcagatatggtagctcaaagccatttatgctgggcagacaatctggatatcatggaatgccctatggtctctcttttatctaaatctgtagctgctctggtttatgagaagattgatcgaagctgtagctgcagctacatgaaaggatgatcacttataatatgttaatctcatgctactattgtaatatttccatttctattgtaatgtagttaatcaactactgcagttcatcgtcgacatctaatgctggttaccgctacactgttgacctttccttgctggccttcaagggtttgatatcctgagttttcagg

SEQ ID NO: 164 - DNA, 4841 bp, Glycine max
caatttacgaaagcccccccaaaaccctacatcgccatctgttctcacacttctcagttccattctacaccacgagactcctttctcccctctcttccgcctatttcaatttgcattatttagcgttttgtttatcgggaaagccacgaaagaacgagaaagagggcttcttcaatttcattccggaatgtcgtgggaagacgagattgtgatgcgtgatgtcacgaatgcggggcttgttgtcagcgatcgcattggtcgcgaagtttcgtctcagctcgacctcgaagaagctctagaagcttccagatacgctagccacccttattccactcacccccgagagtggccccctttagttgaggtggtgaatacctgggagttgcctcccgtgctcattgaaagatacaatgcagctggtggggaaggaactgctttttgtggaatatttcctgaaatacgaagggcatgggcatctgtggacaattcattgtttctttggcgttttgataagtgggatggccaatgtcctgaatttagtggggaagaacaagctatttgtgcagttggtcttgcaaaatcaaaacctggagtttttgttgaagctatccaatatcttttagttttagcgacacctgttgagttaattttagtaggagtatgctgctctggaggagcagatggttcagatccatttgcagaagttacattgcagccattgccagagcatacaataccttctgatggggttacaatgacttgtgtagcatgtactgataagggccgcattttcctcgctggtcgggatggccacatatatgagattctgtattcaactggttctggatggcaaaaacggtgcagaaaaatctgcatcactgctggtttaggaagtgtaatttcaagatgggttataccaaatgtattcaattttggagctgttgaccccattgttgaaatggttttcgacaacgagagacaaatattgtatgcacgaactgaagagatgaagctacaagtttatgttctaggaccaaatggtgatggcccattaaagaaagtagctgaagaaagaaatcttgtcaatcagagggatgcacattatggtgctagacaatccacagggtcaagagtctcaagtcgatctccaaagccatctattgtttgcatctcacctttatctacacttgaatccaagtggctacatcttgttgctgttttatctgatggcagaaggatgtacctatctacctctccttctagtggaagcttgactgggttcaacaccaaccaccacaagcctagctgtttaaaggttgtcactacaaggcctgctcctccttggggtgttagtggtggtctcacctttggagccatggctcttgctggtagacctcagaatgaggatctctccctgaaagttgaggcagcttattattctgctggaacccttatactttctgatgcatcaccttctaccatgccttcactccttgttttgaacagggattcaagcacgcaatcatcgccgtcaggtaatctaggaacaagtacgaggagttcccgggcattaagggagtccgtatcttccttaccagttgaaggacgaatgctttctgtggcagatgttttacctttgccagataccgcagctactgtgcaatctctatattcggaaattgagtttggtggttatgagagctctatggaatcatgtgaaagggtgtctggcaaactatgggccagaggagatcttgcaacccaacatatactaccaagaagaaggattgttgtcttcagcaccatgggcatgatggaaattgtttttaacaggccactggacattataaggcggctattggaatccaactctccacgatcagttttagaagatttcttcaatcgttttggtgcaggtgaggcagctgcaatgtgtctaatgctagctgcaagaatagtgcattctgaaaaccttatcagcaatgttattgctgagaaggcagctgaagcttttgaggacccaagagttgttggcatgccacaacttgaaggcagtaatgcattatcaaacacaagaagtgctgctggtggatttagcatgggccaggttgttcaggaggctgagcctgttttttcaggtgcacatgaagggctctgtctgtgttcgtctagattactttttcctctgtgggaacttcctgtaatggttgtaaagggaagtttaggcccttcaggcactctatctgaaaatggagtagttgtgtgcagactctctgttggggctatgcaagtccttgaacagaaactccgatctttggagaaattcttaagatctagaaggaaccagaggaggggactttatggctgtgtagcaggtttaggagatctgagtggttcgattctgtatggtaatggttcggcattaggagttggggatcgaaatatggtaaggaacttatttggtgcatattccagaaatatggagtccaatggtggcataacaactaataaacggcaaaggttgccatatagtcctgctgaattagctgccatggaggtgagggcaatggagtgcattaggcagttgctccttagatctggtgaagccctatttttgcttcaacttctttcacagcatcatgtgactcgattgattcagggatttgattctaaccttcaacaagcattagttcagttgacatttcatcaactagtttgttctgaggagggagaccatcttgctacaagacttatatctgctctcatggagtattatactggtcctgatggcaggggcactgtagatgacattagtaggagattgagagatggttgtccaagctactataaggagtctgattacaaattcttcctagccgtggaagccctggagagatctgctatgaccatagatgccgaggacaaggagaatcttgcaagggaagcatttaattccttaagtaaagttccagagtctgtggacctacgaactgtttgcaaacgttttgaggatttaaggttttatgaagctgtagtgcgcttacctctacaaaaggcacaggctcttgaccctgcaggcgatgcttataatgatgatattgatgcaactgtcagagagcaagcacttgctcagcgggagctgtgttatgaaataattatcagtgctttgcggtctctgaaaggtgacaacttacagagggaatttgggactcctattaaatcaactgcttcacaatctgctcttgatccagcctctcggaaaaaatatatatgtcaaattgttcagctgggtgtccaatcacctgacagaattttccatgagtatctttaccaggctatgattgatttaggtcttgagaatgaattgctagagtatggaggtcctgatctgttgccatttttgcaaagtgctggtcgtaattctatacacgaggttcgtgctgtgacggccacaacttctccagtggggcaatcaggagcacctatgtcatctaatcaagtcaagtactatgaacttttggcacggtattatgtcttgaaacgccaacatatgcttgcagctcatgcattgcttagactagctgaaaggcgttctactgatggagttcctactcttgaacagaggtgtcaatacctaagtaatgcagttctacaggcaaaaaatgcaactaatagtgatgggttagtaggttctggtcgaatttccattgacagtgggttcctagatttgcttgaagggaagctcgctgttctttggttccagataaaaatcaaagaagaactagagtctatggcttccaggtctgatgttttacctggcacatcagagtctgccgaaaatggtgtagtccctgagggaagttctactgctgatgctaattttgcaaatgcaacacgagagaaggctaaagagctagcttcagatgtaaagagcataacccagttatataatgaatatgctgttccctttgggctctgggagatatgcctggagatgctgtactttgccaattattctggtgatactgacagcagcattgtcagagagacatgggctagacttatggatcaagctatatcaagagggggtattgctgaagcttgctcggtactgaagagggtcgggccccgcatttatcctggtgatggagctgttttaccacttgatattatttgtcttcacctagagaaggctggactggagaggttaaattcaggggttgaagctgttggagatgaagatgttgcaagagcccttgtttctgcttgtaagggtgccgctgaacctgtattaaatgcatacgaccaattgttatcaaatggggctattctgccatccccaagtgttagattacgtatgctgagatcggttctagtggtacttcgagagtgggcaatgtctgtatattcacaaagaatgggtagcagtagtgccactgggcattccttaatactaggtggaggattctcaacggaacgtactattgctagccaaggaatccgggacaagatcacaagtgcagcaaacaggtatatgactgaagtgcggaggttagcccttccacagaaccaaacagaacatgtctaccgaggttttagagaacttgaagaatcgtttataagccaacattcatttgatcgattttgatgtttgttgcaatatatatagtgttgtataaattgttcttgtcatataattattctcaaataagaagtttttaattttccatattggatgtgataatgtgattcttttactatgatctcatgtatcaattagaaatatagagcctaattttgtgaataagtctcgcgggctgctcatttaaatgtataggcca

SEQ ID NO: 165 - DNA, 1749 bp, Glycine max
gggaatgaaataggagagcgggaaaggcatttggagagtggagagagcaattggaagcgaagaaggcaatgggttccaaagacagttgcagaaccgaacttcgcattgccatccgccaactcagcgatcgatgcctctactctgcttctaaatgggcagcagaacagttggtgggtattgaggaagaccctgccaagttcactccttcgaatacgaggttccagcgtgggagttcgagaatttgccgcaagtctaggactcatgagactgctgcggtgatcaccccggtcgtgggtgttttgtatgacgccacacctgtgaatgtgatggagaaggatgaacttgtagatggtgatttttacctctggcaatcctatttcggttgccgtgagtataagacagctgctcatgctggagaaaagcaaaaagaggaagagacgatagaacttggggggcctctgggtaagagtgatgctatcaatcacgaactagtttctttggagagagagttgtcaacaattcgcaagaatggcaaagttgatcctttttgtttgtatttatatggtcttgtgctcaaacagaaaggcaacgagaacctcgcatgtacagttcttgtagaatctgtgaattactacccttggaactggaatgcctggaccaagctgcaatccttgtgcaaaaaggttgatatcttgaatagtctgaatctcaatagtcattggatgaaggactttttccttgccagtgtttaccaagaattaaggatgcataatgactctctgtcaaagtatgaatatctactaggaaccttcggttatagtaattacttacaggcacaaattgcaaaagtccaaaggggtgagagaggtggcaaagggaaattacctgaaagggttatggaaaatgaaccgacaacagttagtaaccattaggatgcaacttcatggtatactatttggtactaacattgatcccacattgtacataatctgggattcaactttccatccaattatttgtgtaggatatatacatacgtacatatatatatatatatatatatatatatattcatttatttatttattcttccaaaaacaaaaacttatgtttttctatgactgactccacttgtctgtttttattgtcttcaattcctttatgtcagcatgataattttaaacctacatatgtaatcaacaagattgggcttggattggaatagaagagcagtttttatcttgagatgatggggcaagtcaataaaaagagactggcaagaatacctaggagagatacagcggacggaggatacctatgaccagttgactactattgctgcttaagaggagagactttaaccagaaaaccttatgtgagaattccagagcaaatcgacaccagggttcacaagaagcaaaggaaatggataatttgcacatctccaattattgtgaaaatatgttttcttttaagttcactatgaagtatgaactggatgctgttttgtccgtgtttgatcccgttttatcaacttggtcatgttattgattcaaccaaattcttcatagaggagatctagttttgtttttgaaatgtaacattttctttctagacttgtagatgcttttggcctaaactatttgtattcgattatcaagccctttgtctcgtgtgatatggaattaagagagtatatctgttgcccttgcatcgaccagagatagaaaatgcatataattatttcgc

SEQ ID NO: 166 - DNA, 3492 bp, Glycine max
aaaaaacccctgcaacaggcaggcagcaaacacagagagaaagtgatagaagctaacaaaaaccctacccatatttatgttattaggttcttactccattgatccgagaagctaagcctcttcagttgcctagccctataaagtaaaaacttttccttacaaatcccatccatccacaccgcacaactctgttcttcagaatattatggatgatctggagagagcgattcttgttatatttgatgaatccggaacccttgacgatgacttgaagaaacaggcagaactttactgtaatgatgttaaggagaagcctttaatttgtagattgtgcattgaaaaattatgcttttcaaatcttgttcaagtccagttttggtgcctacagaccttgcatgaagtcattcgaacacgatacttgacaatgaccccagatgagaggcacatgatcaggggctccgtcttttcaattgtgtgcctcgaagacaagaacctcacaagggttttggaaggccctgcatttataaagaacaagcttgcacaggttttgataactttgatttacttcgagtaccctttggtttggtcctccgtctttgttgatttttttccacatttgagcaaaggcaacgtggtcatagacatgttctgtagagttttgaatgccctggatgatgaactcattaatttggactaccctagaacccctgaggagttgacagttgcgggccgggttaaggacgcaatgagacagcagtgtgtgtgtcagatagttagagtttggtatgacattgtttctatgtaccggaattctgatcaggagctatgcactagtgtgttagattccatgaggagatatatttcttggatagacattgggttgatagtcaatgatgctttcatccctttgttgtttgatttgattttggttggtcctctgtctgttcagcttcgtggtgctgcagtcagatgcttgttagcagttgtttctaagcgaatggagccccaatcaaaactgtcattgttgcgaagccttcaaattagtcgggtacttaggttagtgaccgaggatggtgatgccgagctggtctctgatatagctgcattgctttctgggtatgctgtggaggctttggattgctttaaacacttaaattctgaggatgctaaaggaatttctatggagcttttgagtgaagtttttccctccattttctatgtaatgaagaattttgaggtagatgtcaatatcattcagtttctttcaggttatgttgccattttgaagagctttgctcctttgccggagaagcaactacttcacctgggacaaatattggaagttatccttgtgctaatccgttatgacccagcataccgcactaatcttgatttcatggacaaaattggtaaagaggaggaagataggatggtagagttcagaaaggatttatttgttctgcttcgcactgtgggtcgtgtagcgcctgatgtaactcagttgtttatcagaaattcgttggcaagtgctgtttcaagatcttcagatagcaatgtggaggaggtggaaggtgcactttctcttttatatgcacttggagaatccataagcgaggaaactataagaactgggagtgggttgttgagtgagctgttgcttatgcttctatcgacaaagtttccttgtcactctaataggcttgtcgcccttgtttatttggagacagtgacaagatatgttaagtttattcaggataatactcaatatattcccatggttctggctgcctttcttgatgaaagaggcatacatcattcaaacatcaatgtaagtcgtagagccagttatttgtttatgagggttgtaaaattgctgaagatgaagttggtgccttttatagagactattttgcagagcctgcaagatacagttgctcaattcactattacgaattatacgacagaagagctatcaggatcagaagatggtagccacatttttgaggcaattggtttattgattggaacagaagatgtcctgcctgaaaagcaatctgattatctatcttctttgctcagtcctctttgtcagcaggttgaggcactgctaaaaaatgccaagttattgaatgctgaggagactaatgctaaaattgctgtaacccagcaaattattatggcaattaattctctcagtaagggctttagcgagcgtcttgtaactgctagtcgccctgcaattggtctcatgtttaagcagacattggatgtacttcttcaagttcttgttatatttccaaaagtagaacctctgcgaaacaaggtcacatcttttatacaccggatggtggatacactaggagcatctgtttttccttaccttccaaaggcattggagcagttgcttgaagaaatagaaccaaagcagatggttggttttcttttgttactcaatcaacttatctgcaagttcaatactttggtgcatgacattttggaagaaatatttccatctgtcgccgagcggatattcagtgttattcctagaaatggattaccttctggtcctgatgcaatcactgaggaaattcgtgaattgcaagaacttcagcgaacactgtatacatttcttcatgtgattactacacatgacctgtctcctgtatttctttccccaaaatgtaaagcatacctggatccagtgatgcagttgcttttgtactcttcttgtaatcataaggatattcttgtaagaaaggcatgtgtacagatttttattagattaattaaagattggtgtgcccagccttatgaagaaaaggttcctggttttcgaagttttgtgattgaagcatttgctacaaactgctgtttgtacagtgtgctggacagatcttttgagctccatgatgcaaatacttttgttttgtttggagaaattgtgctggcacagaaggtaatgtatgaaaaatttggggatgattttctagttcattttgtatcgaaaggattttcttctgcacattgcccaccagatctggcagagcaatatcgtcaaaaattgcagggtggtgatttcaaggcactaaaatctttctatcagtcactagtggaaaatttgagactgcagcagaatggaagccttatattcagatagcatacttgtaatggaaaattaagagtcctcttcctatatatggctatgttttttggccgtctcctagtttggtgcttcatttctgtctactgaagggtggtgtatatagcttttgcggatgagagatggatattctccttgccctgattttgatgagttcctcatgcaacctgaccaatcagctaattgtctcgggtctttctgtattctttttgtccctcagttgtaaattttttgtattctcttaacagtggagttacatccatcggaagcttgtcaatatgagatcaaaattttggtgtttatttctcaactctctttctccgtgtaatata

SEQ ID NO: 167 - DNA, 2830 bp, Helianthus annuus
aaccatttcacttccattttccatagaaaacctttcgcatctgatacctcaccacacatggattcgttcggcggcgcatacttcaccgacgagaaagcagcgaaggtggagaacatcttcctcgagttcctcaagagctttaggttggatcagaactcacgagaactgttctatgaatcggagattgaagcgatgaggccgaatgagtcgaataccatgtttattgatttctcgcatgttatgcggttcaatgatgtgttgcagaaagctatttctgatgagtatttgaggtttgaaccgtatttgaagaacgcgtgtaagcgatttgtgatgggacagaaaccgacattcataactgatgacaatcctaataaggatataaatattgcttttcacaatctgcctatcataaaaagactgagagaactgagcacatctgagataggtagactagtgtcggtaacgggagtggtgactcgaacaagcgaggttaggcctgaactgatccagggcacttttaagtgcttggagtgtggaaccattgttaacaatgttgagcaacagtataaatacactgagccgatgatatgcatgaatgctacatgttcaaagaaaggaagatggacacttctcagacaagaaagtatgtttgcggattggcagagggttcggatgcatgaaacatcaaaagaaatacctgcagggtcactgccgcgatcgttagatgtcattctacgccatgacattgttgagcaggctagggctggtgacacggtgatctttacgggcactgtagttgtgatacctgacatattggcattggcagctcctggagaaagagcggaggttcgtagagaatgtggtcaaagtcgacgcactggcggtggtagtgtccaagaaggtgtcagaggtcttcgtgcattgggagttagagatctttcgtataagcttgcgtttattgccaattcagtgcagatttgtgatggtacaagggatgctgacatacgatataggcagagggacgccgaggatgatgacactctacggttcacgtcggaggaggtagatgaggttacacaaatgagacgtactcctgactttttcaacaagcttgtcgatagtatggcccctactgtttatggtcatcaagacatcaagcgagcaatcctgcttatgcttttgggtggtgtccacaagtttactcatgaaggaatcaatcttcgaggagacatcaacgtttgtattgttggggatcccagttgtgccaagtctcagtttctcaagtacacaacaactttagttccgagatctgtatatacatctgggaaatcatcgtctgctgctggattgactgctactgtcgcaaaagagccagaaaccggagagttttgtatagaggctggtgcactaatgcttgctgacaatggtgtttgttgtatcgatgagtttgacaagatggatgtaagagatcaggttgccatacatgaggctatggaacaacaaacaattagtattacaaaagcaggaatacaagcaacgttgaacgcaaggacgtctattttggctgctgcaaatcccactggaggccgctacgataagtctaaaccgttgaagtacaatgttgctcttcctccagccatcctttcaaggtttgacttggtatacgtcatgattgatgatcctgatgatacaacagattatcatattgcaaaccacatagtgcgtgtgcatcaaaagcgtgaagcagctgttgatccaacattcaccactgcacaactgaagcgttatattgcatacgccaagtctaaaaagccgaagctaaatgcagaagccagacaacttttggtggattcttacgttcatctccgtaagagtgatacggctccaggaagtagagtcgcataccgtatgacagtcagacagttggaggcactaatcagactgtcagaggcaattgccagatgtcacctggacgatgaggttctcccacgtcatgttagtttagcaaccaaactcctaaaaacttcagtaatcagtgtggagtcacaagaaattgatttgaccgagtttcaagatgagaatatagaacatggtgataacgaagaaaatggtgatattggagaaaacggcgaagctcagccaggtggcgcagatgctgacgcaaacaatatgaacccagaaaatgcagatggggccggagggaagaaacttgttataacagatgaatactttcaaagggttactcaagctcttgtgatgcgtcttagacagcatgaggaaacggttcagcgagaagggagtgggttagctggaatgaggcaaagggatctgatccagtggtatgtgaaacagcggaatgaaagtgaggcctacgaaaacgaagaagaggcaaaggctgaagtcaccaaggttaaagctataatagagagtttggtaagaagggaagggcatttaattgtggtgaacgaagaggaagtgccgccacaaggggaggatgatggaaatgccagacggccttctcggaacaacaggattcttgcagtggcacccaactatgttcttgatcaactcgactaatttatcggctttgtgatactagttatttggtagtttcagaaactagacaccaaatttcattgtaaagcttgtgatgctgctacagcaatagtatgagtctaggtatgtgctctatgtagttctgtttcatcctttgttttggaacataaaaacttttttattatttaaaaaccggatattggtgtttggcttgtacttgtcacggttcacactatggtcgttttcactaggaaaaagtaatttgttctataac

SEQ ID NO: 168 - DNA, 2455 bp, Solanum lycopersicum
gtaccaaacttggtagttgaaacattaactagattcgttacttctctctctcatgcaaggtctattttgtgccatttcttcattgctggaagtgaaagtggctacactataagccctgtttggaccatctcaggtgctgtttgctataaaatttgagttttgagtaagagaaagaattggagaaaatgagcatgaacaaatttggtttgaaggttgaggaaggaaaagaaggaaaaaatggagagccatctattggtcctgtttatagaaatccaatagctaaaaatggttttccatcagctgatcctgatttgtctacagcttggcaactctttagatcagctgttgaaaaatatccaggaaacaaaatgctgggatggcgtgattttaaggatggaaagtggggtcattataattggaaaacctacaaagaagcttatgaagagactttgcagactggttctgcattacgggctcacggaattgaacctggtgctcgaattggaatttatggagccaattgtcctcagtggatagtagcaatggaggcttgcagtgctcacagtttgatatgtgttcctctctatgacacactcggatccggcgctgtagattttattattgaacatgctgagattgatatcgtttttgttcaagataagaaagtgaaagaacttctaaatgcagagtgcacacatgctaaacgcctgaaattgatcgtgtgtttcacttcgctacagcaggaagaaaaggataaggcagtttcaatgaatattaagccatactcttggattgaatttctcaacatgggtaaagagaatccatcagagccttcaccaccacagccattagacatatgtacaatcatgtatactagtggaactagtggagaacctaaaggtgtaatattgactcatgaaaatatgacagcatctgtaacaggagttgatcattttatggaagaattcgaagacaagatgacagtggatgatgtatacatatctttcctaccacttgctcatatacttgatcggatgattgaagaattcttctttcacaggggtgcttctgttggctacttccatgggaatatcaatgagatacaagaagacatgatggagttgaagccaacctttttggctggagtacctcgagtttatgaaaaagtgcatgaaggtgtactaaaagcacttgaagaactcaatcctttcaggaggcacatgttccatgtgctatataacttcaagcttaaatggatgaatcttgggtacaaacagaagtatgcttcgcgactggctgatctactagcttttagaaaggttaagaataggctaggtggcaggattcgcctcatagtttccggtggtgctcctttaagcactgaggtggaagagttcttgcgggttacctcttgtggatttgtcctacaaggctatggtttgacagagacttgtggtttggccaccattgggcatccagatgaaatgtgcatgcttggaactgttggtccaccatttgtcttcacagaagttcgtctcgaggaagttcctgaaatgggatatgatcccctagcagaccctccccggggagagatatgcgtgagagggaggaccactttcactggatactacaaaaatccagagttgacaagagaagctatcaaagatggatggtttcatacaggtgacatcggagaaatgatgcctaatggagttgtaaaagtcattgatcgaaagaaaaatgttataaagctatcacaaggagaatatgttgcattggaatatctggaaaaggtttatgctattgcgcccatcgttgaagatatatgggtatatggggacagcttcaagtccatgttgatagcagtcgtggcgccacatgaagggaacacgaagaaatgggctgataaaaatggtcacaaaggttcaattactgagctttgttccctacaagacctaaaccaatatgttctccttgagctgaaatctgctgcagaaaggaacaagctaagaggtttcgagaacatcaaaggagtgattctggaacctcaaccttttgagtttgacaaggagttggtaactgcaacaatgaaaaagagaagggagagattgcttaagcgttacaagttggagattgatgacctttacaaaaggcttaatgcagcagctaaacgctgataagtttttgaatactgcgcaatgcaactcttcatcaatctactgagtgatcgtctggcgttgtaacgtttgaactatacaaattatattgttttaatgtctgatatggtagtgatttgtacgaataatcatcagtattattgtcttacatttctaatttaagcacccttctagagagattagtagtattggttttatgaatgggctaataattctaagcactcaatattatgtagacttaaatggtaatattatactattaagtattgttcacaatg

SEQ ID NO: 169 - DNA, 2502 bp, Solanum lycopersicum
accccaaattcaacttctcttttcttcccaaaccctcctctcctctctctgtttctactacaaatacaaagtagaaagaaaacaaaggaaagaagaaaatctatggcggatgttgtacagtacaagctggagcgtatgctccctgagctcgacgaccttgaaaaacgctgtctttttagccgccaggaaatagcggaaatagtgaaacagcgccggaaatttgagtacaggctgaagagacctagtccattgaaacaggattttgtagcatacattgactatgagaaaagtctcgattctctaagacttctacgtaaaaaagctcagatgaaaacaacaggcgatagaaagctgaaaaagtctgtttcagattatgctggagtttccaggattattgagatttataggctcgccaccaccaggtttaagggagatatagagctttggtttcagtatttggagttctgtagggagcgaaggaacggtcgaatgaagaaggcccttgcgcaggtaatcaggtttcatcctaaggtgcctggagtatggatatatgctgcagcttgggaatttgataacaacctaaatgctgctgctgctcgtgccctaatgcatagcggcttgagagcatgtccaacttctgaggatctttgggtagaatatctccgaatggagctaacttacctaaataaattaaaggcccgcaaagttgtgttaggagaggatgagggaacactagctcgttctggcaatagtgctaaagaggaacagtggagagatgagaacaaggaattatttattgtccttgatgataaaagagaggaagacaaattatccaaccttcacgacggagactctaaggaaaaattagatttgtttaggaaacaaggtttaagtgttctccagacagtttatggtggttctattaaagccctcccttccagtttcagtttaagaacaaagtttcttgacatactagaagcaacagatttaggtcattcagaagatatgcgaaatgaaatacttgctgatatgaaacgggacttctcaaaagaaccaaagtattgggattggcttgcaagacaggaagtgattgatcttaataatccagagactactgaagcaatgacagttgatcaattaagcagcgctattcaggtttatgaggagggtttaaaaattgttccttcagcttcaatgtttgattgttatgcaaagttcctgacggatgtcatccattttaaaaacaagggaagtcaatcttctgagcttttcagtacagctagtcatgctatggatcctatttcacatctcttggtagtatatgaaaaggctgaaaccatggggtgcatcacagaagatcttgcttgccagcatgtttcttttctactgcaacttgggaaagtagatgaagctaagactttggcggagaaattgtgttctggaaaattttcagaagcagtgcagctatggactttacgattctcaatagaaatgagatttatccagaagaactgtactccaaataaggcagctctgtcttctatctttgaacccatgagaaatgctttgttgaaacttcccatatcagaagcagaaactatatggcttatggcgctcaaatatttttccactcataagaaattctttgacaagttggttgagacttctatatctttactggccaaagatggtggaagtgatgatggtttttccctctctgctaccatcgtcaattttgttctgcaaagggatggacttgggagtgctagagagttgtataagagatttcttgctttaccgcatccaggactttctttgtacaggaattgcattgagctggaattgaaccttgcgtctagtggagataagattagtcttggaaatgtgcgaaaactatttgaaacttcacttacaacttatgatcaagatgtcagattgtggcaagactattataatatggaagtcaagttgggaacatcagaaactgcagcagccattcactggcgagcacggaaaaccctgaagaagagtatttcccttctaccctcactgaatatgtgatcaatctcatgtgtgaatactgtcaaaattttgacttgggaatgaatactttgagcaagtaatataaccaaagttctctgtggaggtctggctaatgtgatttcttaagcggtgcaccatctcatatatcattgagctgccaatcttgatctacatcacactttgcggtattggttgacatgctttaggatattatgtcactgttaaaagagcttccctattttcttaggcaggaccttggcaacaactgcttttaggagagctattgtcatctgttattcaattttcttgacctctcaaactagttggaacgacaattttgtagacaagcacatttagctttgtgtgtcaaacagacattgtaccatttctatcaagaaagccttcatatggtttcttctaatttcaagtgttcaaatatagtaatatcttcatgttgag

SEQ ID NO: 170 - DNA, 2777 bp, Solanum lycopersicum
aagccctaacaatttctttcttcaatcccaatctgcaatccttacagttacatccgaaaaagtcccggcgaacggaggatggcttccgactcatctccggtcaatgctcgcggcggtccatctacaccagatgattccatttcaagtccaattggcaacacttactcttctcctggcgactctgctcgccggaagcgtggccgccgctcggcctcatcgacgccagtagcaccgtcaaatcggcgattcacaactcctgaggctacaccaacaccgtcgagtactaatcctcgccgtggtggaagaagagcatcctccaacactcctaccggtgccgcgactccatcctatgcctctgatgttccgccttcctcagaaggcggggaaggtgatgatgccgatgataccccacctatgtatgtgtggggcacaaacatcagcgtgcaagatgtaaacgctgcaatccttaggtttttgaggaatttccgggaggatccttctcaaactgaggggaaatacatgagggcagttcataatgtaattgaaatggaaggcgactcactcgatgttgatgcgcatgatgtgttcgactatgatggtgatttgtataccaaaatggtcagatttccacttgaggttctagcaatttttgacattgtcttaatggacatggttagcagaatcaacccactctttgaaaagcacatacaagctagaattttcaatcttaagacgtccacttcaatgagaaatctcaatccatctgatattgagaagatggtgtcactcaaagggatgattatccgttgtagtgcaattattccagagataagagaagcaatatttagatgtcttgtttgtggctattactctgacccaattgtcgtagacagaggaagaattagtgagccgacaatatgcggcaagcaagaatgtctggcaaggaactcaatgactctggttcacaatagatgcaggtttgctgataaacaaattgtgagagttcaagaaacaccagatgagatccctgagggaggaacacctcacacagtaagcttgttgatgcatgacaagctggtggatgcggggaagccaggtgacagagttgaagtcactgggatttatagggctatgagtgtcagaattgggccagcacacaggactgtaaaatcattgttcaagacttacattgactgtcttcatcttaagaagactgacaaatcaagaatgcacgcagaggatccaatggaaattgaaaatggtgttgttggaaatgatgagcctcttgatcatgaagaaaaggtggagaaattgatagaactatctaaacagcctgatatctatgaaaggctgaccaggtccttggcaccaaacatatgggagttggatgatgttaagaaaggccttctttgccagctctttggtggaaatgcattgaccttgccgtctggagcaagcttccgtggtgatatcaacattcttcttgttggtgatccggggaccagcaaatcacaactgctccagtatattcacaaactgtctcctcgtggtatatacacaagtggacgaggaagttcagctgtggggttgactgcttatgtagccaaagatcccgagactggtgaaactgtccttgagagtggcgctctggtcttgagtgacagagggatctgctgtattgacgagtttgacaaaatgtctgacagtgccaggagcatgttacatgaggtgatggagcaacaaactgtttcaattgcaaaggctggaattatcgcttcgcttaatgctaggacttcagtattggcatgtgcaaatccaattggctcccgttacaatccccgattatctgtcattgataatatacaccttccacctaccctgctgtctagatttgatttgatatatttaattctagacaaagcagatgagcagaccgacaggcgccttgcaaagcacatagttgctttacactctgagaatcctgagaactctgagcaagaagtgattgaccttccaacattagcttcatacttgagctatgctcgaaaacatatacatccacaattatctgatgaagcagctgaagaattgactagaggttatgtggagatgagaagaaaagggaatttccccggtagcagtaaaaaggtgattacagctacaccaaggcagctagagagtttgatacgtctaggtgaaggtcttgctcggatgcgtttttcagaaaaggtggagaaaagagatgtagtggaggcttttcgacttctagaagttgcattgcagcagtctgcaactgaccatgctacaggaaccattgacatggatctcatcacaactggagtatctgcaagtgaaaggatgagaagggagaatttggtgtcaagcacccgcaacataattatggagaagatgcagcttgggggaccatcaactcgtttgctagagttactggaagacgtcaagaagcaaagttctggtggtgaagtccacctagcagatctgcgaaatgcactggctaccctcgcaaccgaaggactggttgttgttcatggagacactgtgaagagaatatgatgagaggagtgctccggaaacttgggtcgatatgcacattgacattatttgctagagcattcacatgcacttggcatatccgcggtctacttcactgtgccctttgaaacgattagccatattgtaagagtaacatgtatgactttgcaatctagtgtttttgtctttgaacttgatctttaattaagagcttgggttaagtt

SEQ ID NO: 171 - DNA, 977 bp, Solanum lycopersicum
atactcatatttattcattctaatgtaatgtaaatacatgaaagctaccatgggagagtttcttaagaaatgcgagaaaatcaatggtgggatgaaggtgacggagcttggaaatggaggtttgagaataagagataatgatgtggaggaggaggttacgagtaattgttctatgagctattcaactaagagaagaaaatttggttctgttacagacgttgattttagtgagaattcagcttcgccggctacatctgtaacgtctgttcatattccgacgaattcgcagtgttcgagttgttacgagtctggtgaagttatgatgaagagtattttgaaatcgttagatctgaaggccgagaaattcggaacggacaattctgcttcttttaacggcggtttcagtgaaaatttcaagccaattgatcaaccgaatccacctagtgagcattgcggagactcggaagatatggagtcatcatccacgacaaccaaaaaatcatcttcgtctgccagtgctcccaggaaacagctgtctgcgtcgaaggttccaccagaagcagagatcgaagaattcttttcagcagcggaaaagcgcgaacaaaaaagattcgcagaaaagtacaattacgatatcgtgaaggacgctcccttagagggacgttaccagtgggttagtttgaagcctcgaagaataaatgaatgaagaaaaatagagatgagagtacaattgctgaaggggcggaatccaattctctgatccttttaaatttctttccatttctagttttagatcagcattactatttactgtttcagcttagtttagctttatcggtgtacagccattcgtctttccatatttgtgtaaagaagctatttatgtgaagccttgttggttttagtagtgctataactgaaccttgtttctgcaattttgcaaccttcctcatgaataggaactatctgcattaaaa

SEQ ID NO: 172 - DNA, 1619 bp, Hordeum vulgare
aggcagatcgagccctgcgcagcgaggggaaagagacacacacagcgccaccaggcaagtagtagtaaaaggcaaaagcacggcacattaaaagagaggccagcccagccccggaccggaccggagccaagcagcagccgcagccgcagccgcagcagaggagagagagagggagggagaagcatatatggcgatgccctttgcctccctgtcgccggcagccgaccaccaccgctcctcccccatcttccccttctgccgctcctcccctctctactcggtaggggaggaggcggcgcatcagcatcctcatcctcagcagcagcagcagcagcacgcgatgagcggcgcgcggtgggcggcgaggccggcgcccttcacggcggcgcagtacgaggagctggagcagcaggcgctcatctacaagtacctcgtcgccggcgtccccgtcccgcaggacctcctcctccccatccgccgcggcttcgagaccctcgcctcgcgcttctaccaccaccacgcccttgggtacgggtcctacttcgggaagaagctggatccggagccggggcggtgccggcggacggacggcaagaagtggcggtgctccaaggaggccgctcaggactccaagtactgcgagcgccacatgcaccgcggccgcaaccgttcaagaaagcctgtggaaacgcagctcgtcgccagctcccactcccagtcccagcagcacgccaccgccgccttccacaaccactcgccgtatccggcgatcgccactggcggtggctccttcgccctggggtctgctcagctgcacatggacactgctgcgccttacgcgacgaccgccggtgctgccggaaacaaagatttcaggtattctgcctatggagtgaggacgtcggcgatcgaggagcacaaccagttcatcaccgcggccatggacaccgccatggacaactactcgtggcgcctgatgccgtcccaggcctcggcattctcgctctccagctaccccatgctgggcacgctgagcgacctggaccagagcgcgatctgctcgctggccaagactgagagggagccactgtccttcttcggcggcggcggcgacttcgacgacgactcggctgcggtgaagcaggagaaccagacgctgcggcccttcttcgacgagtggcccaaggacagggactcgtggccggagctgcaagaccacgacgccaacaacaacagcaacgccttctcagccaccaagctgtccatctccatgccggtcaccagctccgacttctctggcaccaccgccggctcccgctcgcccaacggtatatactcccggtgaacggcgtcggccggcctgatctctgctgatttgccgtggtcacgacggacgtcctcaaatcatcacagatgagcgaaccggccgacccgatcgaatgtgtctgtgagccgactgcagcttgcttgctcattttgtatggatcgtcgtgcagcaggaacgaaacactactcctttaatttcctttctttaatttcacaacgttttttctgggttttgccgtgtatcggccggaactgtactaccaagttttctatagcctcgatggtcatgcacg

SEQ ID NO: 173 - DNA, 1356 bp, Hordeum vulgare
gcgccagagcacggagccgggcctttatcaaccccgcctcgccatgccattgccatccgcgagcgagagagcgagcgagagatagagagagcgtgtgtgtttgtgtgagggtgagggatcgagcgagccatgggccctggaatgcttgagatggcgatattctacgcacaggagcgcagcttcttccatcggctggtgcgcgacctcgggcaggagagggagcacatgaggtgggtgatcgcgctctggctttggctcgaggccgatgggcacgacaagttcatgcgccgcgcgtccgcgctcccgggccccgtcgtgctgcgcttcgtcgacgaggcgctggcgtgcctcgcccgcctcgcgggccgcgagctcgccggcgccggcacgctcctcccctgcaccaacgcgctcctcaacaggcccatcgacgacgtcacctacttcgaggagcaccgcgacaagatcatgcccggcgtcaagttactgtacaagaccgtctgccgcgtcgtcctcgacgacacctgcgcctccgacgacgccatcttcttacccaggagcagcaccgcctccgtgccgcgcgccatcggctctcccgcgttcgccggccccaccccggtccccgagacgccgacgacgccgacgacgccgaggttcgccgacctgaacgcgataatgacgccgaggttctcccagctgaacgcgatggcgccgccgtggtcaccggtccgggtggcgcagcagcatcaccagcaacaccaaatgatcatcgacccccttccagaggagttccgctcgctcttcatcaccttctcccgcggctaccctatcgacaaggacgacatcaaggagttcttcaactcgctgcacgggccgtgcgtggaggacgtgatggtggagagggcgccggcggggcagcttccggtgtacgggagggtggtgctgcagagcccggacatgatcccggtgctgctcgggggcgagccgacggccaagtacatcatcaagggcaggcacctctgggccagggtctacgtgcccagctccaggcactccaccttcatcgaagcctgaatgcttgatccatcctacaattaagaaactgtgtgcatgaagttggagcttgaagatgcatgtgtcatggcgatggcacagtcggttactcggttaattggctacctactactactcgattgattggtccacagactatactcgagagatgagaccatcgatcgatatatacatatgtgtgtccagtttgtgctttgtgcttgtcttaattatatgtatggaacaatgtgtgtttacttccgtttccttttcatatagacgtatgcttctttcagctctgtc

SEQ ID NO: 174 - DNA, 1248 bp, Phaseolus vulgaris
ctcacttctcacgcgtttcaaaagtcccacaaactttcgttacttctcaaacattgacaatggcgtgctgaattactgcatcttttcttacttccccactctgcagcttcattttctgcaaaatggattcgccattgctgtttagccacctcaagggtgcagacccgttcttcctgctagcgggacctaatgtgattgaatcagaggatcacattctgcggatggctaagcacctcaaaagcattgcatctgaagttggaatacctttggttttcaagtcaagctttgacaaagctaaccgaacatcatcaaaatcatttcgtggcccggggatggttgagggattgaagatactcgagaaggttaaaatagcttatgacatccctatagtgacagatgtgcatgagaccatccagtgtgaagcagttggcagagttgcagatatcattcagattcctgcattcttgtgtcgccaaacagatcttctagttgcagcagccaaaactgggaaaattatcaacattaagaagggccagttctgtgctccttctgtcatggcaaattcagctgaaaaggttcggttagctggaaatcctaatgtgatggtttgtgagaggggaacaatgtttggatacaatgatttgattgttgatccacgtaactttgagtggatgagagaagctaattgtcccattgtagctgatataacacattctctacaacagcctgctggaaagaagttggatgggggaggtgttgcaagtggaggtcttcgagaactaattccttgcattgcaaggacagcagttgccgttggagtggatgggattttcatggaggtgcatgatgatccactgaatgctcctgttgatggaccaacacagtggcctttgcgccatttgaaggagctacttgaggagcttgtagctattgctaaggtaagcaaagggaagcaacagttcaaaattgatctcacgccatttcgtgaataatggtgatggttttcagttatgctgaatatgattctgtgagtattgatgttttaagattgctcaaggttgaatacaaaactgtcttctcccacaagggccttataaagagatctagtttatcttaaaaatactatttgataatccatggttgttactctgaagtggtaacactgccaacttatgtcaggcaaatatcatttgtagtcttaatcatgttagttgtttaagttgaggtaattaattgaatactatttat

SEQ ID NO: 175 - DNA, 1732 bp, Phaseolus vulgaris
cagaaacgtttgttggtgatgaaggattggtgtgtataaataaggaggaagttggaagggcaagaagagaagtgatagcagagagtttttgttgatggcttcgttggcgatggtgcaaggtggaggtgtggatgaacggtgcgtgcagaaaagctattggatagaacacacgacggagctatcggttgagtcaatgatgctggattcaaacgcttctcatctcgacaaggaagagagaccagaagttttgtccttactaccagcatatgaaggaaaatcagttctagaacttggagcaggtattggaagattcacaggtgaattggccaagaaagctggccagttacttgctgtggacttcattgagagtgctataaagaagaatgaaaacattaatgggcaccacaagaatgtcaagttcatgtgtgctgatgttacatctccaaacttgcagatttctgaaggatctgttgatctgattttctcaaattggttactcatgtatctttccgacaaagaggttgagaatttagctggaaagatgatgaaatggttaaaagtaggtggatatgtattcttcagagaatcatgtttccaccaatctggagattccaagagaaaatacaacccaactcactacagggaaccaagattttacactaaggtgtttaaagagtgtcataagagtgatgacagagggaattcctttgaactttcgcttattggatgtaaatgcattggagcttatgtacgaaacaagaagaatcaaaaccagatttgctggatatggcaaaaagtgagatcagaagatgatagggggttccagcggttcttagatagtgttgagtataatcacaaggatattttactctatgagactgtttttggccaaggctttgtgagcacaggaggacttgaaacaacaaaggaatttgtggcaaagttgggactaaaagcaggccaaaaagttttggatgttggttgtggaactgggggaggtgacatttacatggctgaaaattttgatgttgaggtagttggcattgacctctccataaacatgatttctcttgccattgaacgtgtaattggactcaaatgctcagtagaatttgaatgtgccgattgtactaaaaaatcataccctgagaacacatttgatgtaatctattcccgtgacacattgctacacatcaaagataaaccatcactgtttagatcattttacaaatggttgaagcctggaggtactcttctaataactgattactgcaaaagtgtgggaagtctatcagtaggatatgctaactacatacaaaagggaggatactatatccatgagatgaaaacatattctcagatgctcgaatttgctggatttaatgatgtcattgccatggatcaatctaatttgttcatgaaaacactacaacaggagttaaatgaccttgagagcaagaaggatgatttcattgattatttctccaaggaagactacaataaaattagtgaaagatggaaggccaagcagatgaggggtgcagatggtgaacaaatatggggcttgttcattgccaagaaaaaatgatgcttcattctcatcatatctcttattatgcctatatattctgttgttatttatatgttttgagaaaagaacgtttgtgcactctagcacaacataaaccataaaatgttcttgactgattatggtttccatgctgcaaatata

SEQ ID NO: 176 - DNA, 1839 bp, Setaria italica
gctctccaccaagagctaataccagaatataccgtaacaccaccgcaccaccacctaacgccggctgcttgctttacaccgcgtcgtgcgttcccagatccgccgagttcttcgatcgctccagcaaagatgaagatcacggtgcgggggtcggagattgtgtacccggcggcggagacgccgcgtcggcggctgtggaactcgggcccggacctggtggtgccgcggttccacacgcccagcgtctacttcttccgccggaaggacgcggaggggaacgacctggcggccgcggacgggagcttcttcgacggggcacggatgcggcgcgcgctggcggaggcgctggtgcccttctacccgatggcggggcggctggcccgcgacgaggacggccgcgtggagatcgactgcaacgcgggcggggtgctgttccaggaggcggacgcgcccgacgccaccgtcgacgacttcggcgacttcgcgcccaccatggagctcaagcgcctcatccccaccgtcgagtacaccgacgacatctccgccttcccgctcctcgtgctccaggtgacacacttcaaatgcggtggcgtcgcgatcggcgtgggcatgcagcaccacgttgccgacggcttctccggcctgcacttcatcaactcgtgggcggacctctgccgcggcgtcccgatcgccgtcatgccctacatcaaccgctcccacctccgcgcgcgtgacccgccggccccggcctaccctcacatcgagtaccagccggctcccgccatgctctccgagcctccgcaggcgcccctcacggcgaagccggcggcgccgcccaccgccgttgccatcttcaggctgagccgcgccgacctcgggcgcctccgctcgcggatccccgcgcgcgagggcgcgccgcggttcagcacgtacgcggtgctggcagcgcacgtgtggcggtgcgcgtccctggcgcgcggcctccccgccgaccagcccaccaagatgtactgcgccacggacgggcggcagcggctgcagccgccgctcccggaggggtacttcggcaacgtgatcttcacggcgacgccgctggccgacgccggcacggtgacggccggggtggcggagggcgcggcggtgatccaggaggcgctggaccggatggacgacgggtactgccggtcggcgctggactacctggagctgcagccggacctgtcggcgcttgtccgcggcgcgcacacgttccggtgccccaacctggggctcaccagctgggtgcgcctgcccatccacgacgcggacttcgggtgggggcggcccgtgttcatgggccccggcggcatcgcgtacgaggggctcgccttcgtcctccccagcgccaaccgcgacggcagcctgtccgtggccatctcgctgcaggccgagcacatggagaagttccggaagctcatctacgacttctgatctccttcacacacgagccatccatcagtaagcgcaggagcagcagaaatcgaaacaggagggtgatcttacaagtttactaggttgcagcaagattctttgattgcacacatactagttcctgcacacgttttccgttcctgcctgccccttttgggcaggatgtacacgttttgtgccgtatatgattcacgggcctgaacggcctgagcaattgtatgatgaacaatttaagcagttccgaatgagacagatgaataaggttaattatctcttgatccatttttttaacaaaaaaatgtgtgcaggagtgcaggacagtgttacgaccctgagagttcgagatggatcaatcagtttgaaatagta

SEQ ID NO: 177 - DNA, 1767 bp, Setaria italica
cccttttcctctcgtcccctcttcccctcctcgagcccctcgctcccaatcccccccatctcgcagactcgcaccaccaaggcaccaaccttccccgatccagcgccgcacttccccccaccctcatgacacgcaagaggcgtaagcacgccgccgccgccgcctagggttcccgatcctcctctcgcatggattcgctgccgcggaagcggaagggcgcgcgcgccgcgtgctcgctggccggatccctccacgaggcccccgccgccgccgccaccgctcgcaagcgcacctgccgcgagcccaagccgcggcccgagaagaagaagctctcctccggcggcggcgacgaggcggcctccgcctcggcccggggtggcgtggtgatgacggcgccgccggccagcgggcgggcggcgcccgacagccccggccgcgggctgaagcggaagctgggctgcatcgagtccgccacgcggatggggcggaagaagcggctcgacagcgagtacgagctcggcgccgagatcgggcagggcaagttcggttccgtccggatctgccgcgccagggcggggggcgaggagttcgcctgcaaggcgcttgccaagaacggcgaggagacggtccaccgcgaggtggagatcatgcagcacctctcgggccacccgggcgtcgtcacgctcaaggccgtcttcgaggacgccgaccagttctacctcgtcatggagctatgcggcggcgggaggctgctcgacgagatcgccagggaggggaagttctctgagcagcgggctgccattgtgatcaaagatctcatggcggtgctcaagtactgccacgagatgggtgtcgtgcacagggacattaagccggagaatattttgctcaccaaggcagggaagatgaagctcgctgatttcggacttgctgcgcgtgtcactaatggtcagaaattgtctggcatagctgggagcccagcatatgtggcacctgaagttctttctggaagctattctgagaaagttgatatatggggtgctggtgtgctactgcatgtactactgcttggctcacttccatttcaaggaggctctctggacgccgtctttgagtctataaagatggttgaacttgatttcagcagtagtccatgggaatcaatatcaggtctcggaaaggatcttattggtcgaatgttgaatcgagatgtctcttctagattgactgctgatgaagtccttagtcacccatgggtcctgttttacacggaatgccccctgaaggtggtaactgctaatttgtgtgtcactaacaagattatagcacccataattccacggggcagacttaggtcagaatgtgagtcattgtcagacttaagccagagttcagaggagcaggatgaatgtggcatagttgacgcactgacagcagcaataacccgtgttagaatatcagagccgaagagaagtcggctctgtagccctgctcttcagcaggaatgctcttcaaacttgaagagcaatctgtgcacggctttctgacctgacccagtgtatagctccagatcgcaacggtgtgtccatttttctcgctgagattgttttacaatggctccactggctggtgtagagctgaggataataactcgggtttttcggcaaagcaacaagcggttggtatgtaggttttcttcagtaaatactgttgaacccgatggtagccattgctgtaaattttgtaaatagcatgatccctccacct

SEQ ID NO: 178 - DNA, 1106 bp, Setaria italica
gagcaaagcgagaccataacacttcctccaactcgacgactcgacggcgacgcaactcgccgcggccttcctcacctcgtctccctcccacggcggccactcccgcgcacgatggcggcgcgtaaggagtggagcatgtccgacttcgagatcggcaggtacatcggcgaggccgcgagggcaagtttcgcccgcgagaagaagttccactcgcacctgcggcgggagattgaaatccagaaagggctcgatcaccccaacgtgctccgcctcttcgcctggttccacgacgaagagcgcgtcgtcctcgtcctcgaatacgcggcccgtggtgagctgtacaaggtcctccgcaccgctggccgcttcaccgagcgcaccgccgccaccataaggaccccttgcccctatgaaaacggcagaggaaaaggaaggagaaagaaaagcaccttatccgcttccttcgtcctaaattaccattcgttttgccttgctggtgcactggcgcactgtcacaggaagcaggtcattcatagggatatcaaaccagagaatctgctacttgatatcgagggccggcttaaaattgcagattttggatgggcagctcgatcaaatgctaaacgacacacactatgtggcacaattgattatctggcaccagagatgatagataaaaaagctcacgatcatgctgttgacaactggactttaggaatcctgtgctatgagttcttatatggctcacctccttttgaagctgataaacaggctgataccttcagaagcaagatagttagagtggatttgacattcccttcaactccttccgtatcttcagaagctaaggatctcatttccaagcttctagtgaaggattcaagcaagaggctttctcttgaagacataatgaagcatccatggatcaaaaagaatgcagaaccttcagggagttgcattaagcaaaaagacctatgaagagttaagcctgttctcatctgaaaatcggcctattttggcgaacgacttgtttgccagtggcccagaaacttcacatgtaagttaactgatgtggtgtgccgaactcgtcgcttttggagctcaaa

SEQ ID NO: 179 - DNA, 529 bp, Setaria italica
aaacacatggacaccaaaatggagaagaaatacatatctttctcctcacatagagaagttcacagcttttccccatggcgctcaccaagtgcgccatcgctgttttcttggttcttgcagtcatatctaacacatccacatgttgtgttagggcaatctgctcgggctgccctactccgaagccaaaaccagggatgccgtgcttccacgctggatcctcacagcacccctgtacgactgagaagtgctccaggttatgcgagcacctaaaccacaatggcactttggcctactgtcgaagtgcttctccaggggtgtgctgctgcccaaatgaatagatgaatccatatgtttaatgataatacaatacaataaggttttgtattactctcgtcattcaaagtttttgtccatatctatatatagtatcagagagaaaatataatatcagagaaaaatctccaagaaaaacatgtatacatatgaagctttgttacaatggttctaaagtaccagtggtacttccaag

SEQ ID NO: 180 - DNA, 2029 bp, Setaria italica
ggacccttgcccctccccctcatctcgccactgctcgatccggcgactgccaccagcagcagtctcagctcccaactcaccgacggaggccatggcgcgggagcaggcgctgctctcgacggagatcgtgaaccgcggcgtggagccgtcggggccggacgccgggtcgccgacgttctcggtgcgcgtgcgccgccgtctgccggactttctgcagtcggtgaacctcaagtacgtgcggctggggtaccactacctcatcagccacggcgtgtacctggcgaccatcccggtcatcgtgctggtgtgcggcgccgaggtgggcagcctcagccgggacgagctgtggaacaaggtgtggggggaggccacctatgacctcgccaccgtgctcgccttcctcgccgtcctcgccttcaccatctccgtctacatcatgtccaggcccaggcccgtctacctcatcgatttcgcctgctacaagcccgccgacgagctcaaggtgtccaaggcggagttcatcgacctggctcgcaagtcgggcaagttcgacgaggacagcctggcgttccagtctcggctactcgccaagtccggcatcggcgacgagtcctacatgccgcgctgcgtcttcgagcccaacgtcaactgcgccaccatgaaggagggccgcgcggaggcgtccacggccatgttcgccgccctggacgagctcttcgacaagtgccgcgtccgtcccaaggacgtgggcgtgctggtcgtcaactgcagtctcttcaacccgaccccgtcgctgtcggccatgatcgtgaaccactacaagatgcgcgggaacatcctgagctacaacctcggcggcatggggtgcagcgcgggcgtcatcgccatcgaccttgcacgcgacatgctgcaggcgagcggcgcggggctcgccgtcgtggtgagcacggaggcggtctccttcacgtggtaccccgggaagcggcggtcgatgctgatcccgaacgccttcttccgcgcgggttgcgcggcggtgctgctctcgaaccggcggcgcgacttccaccgcgccaagtaccagctggagcacgtggtgcgcacgcacaagggcgccgacgaccgggcgttccggtccgtgtaccaggaggaggacgagcagcggatcaagggcctgtccatcagccgcgacctgctggaggtgggcgggcacgcgctcaagaccaacatcaccacgctggggcccctggtgctgcccttctcggagcagctgcttttcttcgccggggtgctgttccgccacctgttcccgtccaagacctccacaccgccgccggcgacgacacccggggacgcctccgccgcggccccctacatcccggacttcaagcgcgcgttcgagcacttctgcatgcacgcggcgagccgcgacgtgctggagcacctgcagagcaacctgggcctgcgcgacggcgacctggaggcctcccgcgcggcgctgcaccgcttcggcaacacctccagcagcagcatctggtacgagctggcgtacctggaggccaagggccgcgtccgcaggggcgaccgcgtgtggcagctcgccttcgggtccgggttcaagtgcaacagcgccgtgtggcgcgccgtccgacgcgtgcgccgcccgtcgcgcagcccctggctcgactgcgtcgaccagtacccggcgcgcatggacgcctagtaagttgatgatggtggtctctgtctaatctgtcgcgtgcgccctgcgctgcctgcctttaattatatgctaccgatgatccatggatggaataggacgcgatcgatctgcatgcgtgtaactttggtttgtgttgcttgtttagcggtttaagggagagagaagagacactagtaccataatggatgcgcctgcgtgcgcgccgtggaagtgcttctaggttttatttggtttttgctataacttttcagccctcctgtttattcttctccttttatgcataatatagacgttaatgtttcaaattat

SEQ ID NO: 181 - DNA, 1452 bp, Gossypium raimondii
ctcccttcccttccatcattactcttcttgttgcattgcacccctacactacattaattccgtttctcacatctcacaaaagagaacaaaaagaaatatgtgtacctctaaagctaaggtgaccacaggcactactcatgttgaaataacaccacctgctgtcgcccggatcaatggccgtcctgtccttcagcctacttgtaatcgtgttcctagccttgatcgtcgtaattccttgaaaaaaataccacccatctctcctccaccacctgcatcactaccatttacgccgtcagccaccagtactacaactgttgccaatggtagcagggctagggcctcactcacactgcctttatcgccaagctcaaagttcaccaccaagcgagggagtgatcccaatgcgttgaactcaagttctgaaaaggttgccattcccagaaacaccacaaaaaccttggataggaagaaatccaaaagtttcaaagagggtatggggaataatggattatcttcttatattgagccatcattgagttactcttcttctctgctggttgaggctccaggaagcattgctgcagttaggagggaacaggtagctcttcaacaagcacaaagaaagatgaaaattgcacactatggaagatcaaaatcggccaaatttgaatctaaggttgttcctctcgacaataccaagcctgccgaggaaaagaagaggtgcagtttcattacgcccaactcagatcctatctatgtggcttaccatgacgaagaatggggagttccaatccatgacgatagcatgctcttcgagttgttggttctaagtggtgctcaagtaggctcggattggacttcaatcctgaagaaacgtcaagatttcagggatgcattttcagggtttgatgcagaaactgtagccaacttcactgaaaaacaaatgaccacaattagctctgaatatgggattgacataagcagagttcgaggtgttgtggacaactccaaccgtattctcgaggttaagagggagtttggatcatttgacaaatatatatggggatttgtgaatcacaagccgatgtcgacgcaatacaaattcgatcacaagatcccagttaagacgtcaaagtctgagagcataagcaaggacatggtgagaagggggtttaggtttgttggaccaacggtggtccattccttcatgcaagccgccggtctaaccaacgaccacctcatcacatgccacaggcacctcccttgcgccttgttagccatccaaaggccaccggtccactcactccctgatttgtagatgattatgaattgacatttagacatatccaggcaacaataatgcattgcatgggacgacatcaaagcagtagcccagatgcatatacgtaactaaaacccaatttctaactaattaaaaccttttttttcccc

SEQ ID NO: 182 - DNA, 1998 bp, Zea mays
gtgatttctgcggcgcgagacaagcacacccaccctcccagctcaacttacggtgacgccgtgacggtgaggttaggagctgggtgactgacgggggaggcccaccggacgtacgtgatcggcagccaagccaaggcgatgcctgcagccgcggctccagctccacacaccaggaccaggaccaggtccagcggcagccccagcgcagccatcggccccccgcttccttactggggcggcgccgctgttggcgcagaggagcagaggtggcgcatcggcatggactccgccgccgctgccctcctcgactccgcctccgcgtccgcctcttccgccaacgccgcaggcaaggagatgcccaccgcccgccacatcgcccaccgcaccgcccacaacatgtcctcctcctcgctccgcaagaagtccgacctcgcgctcctccgcaaggtcccctgcgccccgctccgacgcctcctcgacaacctccaggaggttttgctcgccaccaagctcgccctcctcttccccgccgttctactcgcgatcgccgcgcgaatcttccacttcggccaggaatgggtctttgtgcttagcttgatcggtctcgttcctcttgctgagcgacttagctttctgactgagcaggttgcgttttacatagggcctactgtgggtggactgttgaatgcaacatttggaaacgtaacagaggtcatcattgcgatctttgcactctatcaaggcaaggtagtggtggtgaaatgctccctgctaggctcagtcttgtccaacctgttgcttgtccttggaacctcccttttctttggtggcctggctaaccttggaactgagcagctatacgacaaaatgcaagtagatgtcagcacaggacttctgattcttggtgtgctatgccactctctgccactgatgctgagatatgctgtgagctccggggagcacgcagaatcctcttgggattcaggactggagctgtcccgagcatgcagcattgtcatgctccttgcctatgtagcctaccttttcttccaactgaaaacccaccgccaactatttgaaccccaaccccaagaggttgaagatgatggtgatgattcggtctctcaagacgaggcagtactgggattttccagtgcaatgatttggctgggagtcatgaccctgatgacagcactcctatcagagtttgttgtgagcacaattgaggcagcatcggaatcttgggagctatctgtcagtttcattagcgtcatcttgattccaatagttggtaatgcagcagagcatgctggtgcagtgatatttgcgtttaaaaacaatctggacatcaccctcggagtatctttggggtccgctacgcagatttccatgtttgtggtgccattgagtgtccttgtagcatggatcatgggagtcccgatggatcttgatttcaacttgcttgagactggttgtttgtttcttgcaatattagtaacggccttcacgctccaggatggatcatcacattatctgaagggactgctgcttgtgttttgctacattgtcatctccttatgctttttcgttttgagacagcatggaaatggaagcaacgatgatcagctgggtgtagcaagcaagccatggaggatttagggcgcctgagctggcagtagtttctcaacaagtagcgtggactttggtttgcacgattttgcatggaacactggaggggagacccgtgaagtttgactaaagtatgtagactgcgggaagatgctgttcagctgatgtgtgaatgtaagtacatacaaagactatagatgaaaactgatgttgcgtgagagactatttgtgtgtgtttttcttgttctttccaccaagcaatggctagaattcggttgagctgttgaaattgtctcctgtataaatcagtgacatgtcatactattttccaactggacttaacagagcctttatccttctaattggtta

SEQ ID NO: 183 - DNA, 774 bp, Zea mays
ggttagttattccgtgccgtcccaactcacccgcggctccgtgccatccgtcgccgccggcgcaccgcgatggccgcctccgccccggccgtgaggcctctcgcccgggccgcaatccctatcccgctctctgcgcggccgcggaccgccagggtctccttgctccccctggctcctcttgctccggcccagcgcctcgctctcgggcggaccgggcaagcgcggctgccagcgcgcagccggtcggtgcggtgcctggcggcgctgagcccagagatgcgggagacgctggacaaggtcgtggggtccagcaaggtgttgctattcatgaagggcaccaaggactttccgcagtgcggcttctcccacaccgtcgtgcagatcctgcgctcgctcgacgtgcccttcgagacgctcgacgtgctcgctaacgaggcgctccggcaggggctcaaggagtactccagctggcccaccttcccgcagctctacatcgacggcgagttcttcggcggatgtgacatcaccgtcgaggcatacaagagtggagaactgcaggaaactctagagaaagcaatgtgttcgtagaaaaaaaatgaacaataagcagatggcatacaattaatcaaaatgttatagtatttgctgtacaattcaggcttgtcatcaactggagatgcaagttgtggataattcatgtccaaatgttcagtgcactttcgactggaaatacatctttctgcagtttgtgactagtcatccagtttgaacccc

SEQ ID NO: 184 - DNA, 830 bp, Zea mays
ttcctccctccaactttgcacagtctgcgcaccctgccacgacgagatggcttcctgttcctcatcgccacggccacccaccatccctctcctcctcctcctcctcttcctcctcctccacttctcctccgtcctcgccgcaccagctcctccagccttgtcacaacaggctggtaccggcggcggcaatgcgacggattcggcggcggcgtggacgccgcggctgaggaagacgttcttggacggcggcatggagcgctggcgcgggcggcggctggtggggcggttccaggtgtgcgcggtgtgcacctgctgcgggggcccgcacgggatgtgcatcccggcgccctgctgctacgccatcaactgcaacatccccaaccgccccttcggcgtctgctccttcaccccgcgcacctgcaactgcctcacctgccacctctagctagcgctcgccgccctggatccatggttttgcttgtctagctggtcgtgtcgtttcgttgtcgatggaagggatattcgtgattcgttcatttgggggacagattcgacgaagagttcatcctgccctaaaactgcttgtttgtagccatgactcacagttagtagcagtatggtgatggttggattaatccagcttttttttttctgcacttgcttggtgctcttcaacttcaactgtagatattatcaagtcctggcatctttttttttgtggccccagggtagtagactagtagtcatgaacttggtttcacggttcttgattctgcacatggcaatgccagttttccacaattttccagcgcggtttaataaaattattc

SEQ ID NO: 185 - DNA, 1913 bp, Zea mays
ctttttgattgaataataataaaaaaatcaggcaccataaatatcctatagtcaaacaatgacaacatctcatgttgactagacaatagtacaaaaatgagagcccctgtacaaaggacccagatataaaatgtcgtctagcatttctaacctgtcccgtctcatgtgacggtcatcttgttcttgtgtcactcatggactctcctctaatgaagcccctactagtgcccaacaaccacagtcccggaccggttgtcgccgccacgccgggagaacacggcggtgctgcggccgacgagagcagcaccctcgtggatgctgccagtggcacggatgagagccacagggcactcgccgacgccgacgtgaagatgaacgacgatggcgacgtacaaggggacgagctgtccgcgtccgtgcagcgccggctggacgagagcagcgccgtggagggggaggatgaagaggaggagattggtgacgacgcggaggccgacgacatggcggcgcgcatgggacggcgcctggcggcgctgcccgggaatgcgcacgagagcgagccgttcaccatcttccgcgtggcggggcccatgcgcgaccgcaaccggcacctctacgagccgcagatgatctccatcgggcccttccaccgtggcgccggccggcacctcgccgccatggaggagcacaagtggcggtacctccgcgacattctggcccgccccggcggcgcgacgctggcctcgtacgcccgcgccgcgcgctcgatggaggcctccgcgcgccgccggtacgcggagcccgtgctgctgcccgcggccgagttcgccgagatgctcctcctggacggctgcttcctggtggagttcttcctcaaggggcaggagagcgcggaggacgcgctcatcgacgcctcgtgggcgatgcagaacgtgtacaacgacatgctgctgctcgagaaccagctccccttcttcgtgctcgagcgcttctacgacctggccacgggcgggctcggccgggactacttcgtcaccaacgtcctcgtcaactacctcaccgtggacatgtgcgtcggcccgcgggaccccgagagcacgcggccccccgacggtgagatccaccacctgctgcacctctactactactggttcctgccaccggaggaccgggacgggagcggcacgggcagcaaggacaaggaagacggcgaggcgctcgaggaactgatgtccacgtctgcggatgagcgcatgccgtggcagctgccgccggcgtcggagctgaaggactccggggtgacgttccgcgccaagaagtcgccgcggagcatggtggacgtgaccttcgaccgccgcagcggcgcgctggagatcccggccgtggagagctacacgaaccacgccatcttcgcgaacctgctggcgtacgagcagagccggggccggtgggagctgcagcgcctggtgagctacgtgctgctgatggcgtccgtggtggacgcgcggcgcgacgtggaggtcctgcagcgggccggcgtgttcgtgcgcggggacgaggagacggcggcgttctacgcgcacctgggcgagctgtgcccgccgcccgagttcgtcaacaactgctacgccgacctgttccgcgacgtcctggagtactgtgggcgcagctggaacaggcaccgcgccgtgctggtgcacgactacttcagcaacccgtggaccagcatgtccgccgccgccgccgtcttcctgcttgtcctcaccgtcgtgcagacggtctacaccgtgctgccatactacagccagaattaacggggcaaaaaacaaaaaaggcgttttgccgccgtcacacagaccgggtgtcgccctctgttttttcttttttttgcctgcaactacaagaaaccctat

SEQ ID NO: 186 - DNA, 2828 bp, Zea mays
ctactcctgcctgtccctgtccccgactctctctctctccctctctcctgctagctacacccgctgctgtgctgacctcctccgatcctctgcccggcaacaggaatacagcaggggaggagagggggggcaaccggcggcggtcggtcgcggaggatggtgaagttctcgcgggagtacgaggccagcatcatccccgagtggaaggccgccttcgtcgactacaggtgcctcaagaagctcgtcaagaggatcaagatcgcccgccgcgacgccaccagggaagctgggggaggtagcagcagcgacgccaccagcagctacggcttctccgtcctcgaccccgtccgcgccctcgccgcccacttcgcctccgcaacgccgccggcggtctcaccagcgaacggcgacgaggaggaggaggacgacgacgcggagagcttggaaccggattcaggggagctcgtggtggtggccacggccaagcatgagcgagagtttttggagaaggcgggcgaggagctggagaaggtgaacaagttctacgcggcgcaggaggcggacatgctggcgcgcggcgccgcgctcgtcgagcagctccgcatcctggccgacgtcaagcgcatcctcgccaaccacgcggtggcgtcccggcgcagccggcccgccggagactcgccgccgcccccgccgtccgcggacgggcggtccaacagcggccgccacctcctctcctcctcctccccattcctgcaggcctcgccgcagtccatgttagatgggagcgcggagctgccgcaggcgcgcgtggcggaggaggtgatggcggcgctggagcgcaacggcgtgagcttcgtgggcagcgggctgggcagcaaggccaagaaggacggcggcgggaagcagctcacggggcgcgcggccgcgctgccggccacggtgcgcatcgacgtcccgcccaccagccccggccgggcggcgctcaaggtgtgggaggagctcgtcaacgtgctccgcaaggacggcgccgaccccgccgccgccttcgtccaccgcaagaaggtccagcacgccgagaagagcatccgcgacgccttcctcgccctctaccgcggcctcgacctcctcaacaagttcagctccctcaatgtgaaggctttcaccaaaatattgaagaaattcgtcaaggtgtcggagcagcagcggaagactgacctgttctcggagaaggtgaagaggtcgccgttcagcagctctgacaaggtgcttcagctggcagacgaggtggagtgcatcttctcgaggcacttcgcgggcaacgacaggaaggtggccatgaagtacctgaagccgcagcagcccaggaacacccacatgatcaccttcctcgtaggcctcttcacaggcacattcgtgtccctgttcatcatatactcggtcctagcccatgtcgccggcatcttctcttcgacaggaaacacagcctacatggagatcgtctaccacgtcttcagcatgtttgcactcatcagcctgcacgtcttcctgtacgggtgcaacctcctggcgtggaagagcagcaggatcagccacaacttcatattcgacttctcccccagcaccgccctgacgcaccgcgacgccttcctcgtgtcggcgtccatcatgtgcaccgtcgtcgcggcgctggtcgtcaacctcttcctcagcaacgccggggcgacctacgccaacgcgttgcccggcgcacttctgcttctgtcagcagcggctctcttctgcccattcaacgtcttctaccgctccacgcgctactgcttcatgcgcgtcatgcgcaacatcatgctgtcgccgttctacaaggttctgatggcggatttcttcatggctgaccagctaacaagccagatcgcactgctaagacacctcgagttcacggggtgctacttcatggctggaaccttcacgactcacgcgtatgggagctgcaccagcagctcccagtacaagaacctggcgtacgtgctttccttcctgccttactactggagagcaatgcagtgtctgagaaggtacctggaagaaggccatgacatcgaccagctcgccaacgcgggcaagtacatatcggcgatggtagcagctgctgtcaggttcaagtacgccgcggcaccgacgccgttctggatgtggatggtcatagtgtcgtccacaggcgccaccgtctaccagctctactgggatttcgtcatggactggggcttcttagacctcagatctaagaaccgttggctccgagaccagctcatcctcaagaacaagccgatctactatgcttccatgatgctcaaccttgtgctgcgcctggcctgggccgagagcgtgatgaagctccgtctcggtatggtggagtctcgcctgctggatttctcactcgcttcactggaaatcatccggcgagggcactggaacttctacaggctggagaatgaacacttgaacaacgctggaaagttcagggcagtgaagaccgtcccgttaccattccgtgaacttgaaactgattgatcaagtcaaagataagaacttgccagcatgttcccaggaatttaaggaggggggcaagagttccaggaatggacacactgcccctgctagtgcttgcgcaaggattggtgttcaagtgggtaataaaacaaatcagagagcataactgcacaagagcaagacgctgcagatttttaaagatggaattagctcagacggtgccgtgtagttgaggcgccagggtcaggaaagatgatgtgcgtttactctttattggttga

SEQ ID NO: 187 - DNA, 1813 bp, Oryza sativa
acaggtgttcgccatttcgccgcccccaccaccgcgcgccgccgccgccgccatggcctccatctccgccgcctcccccgtcgctgggaaggccgccgccttcgcccacaagaacgagctcgccgccgccgccgtggcgccgtcgcagcagcagctgcagcggagggtgagtgggaggagggcgcgttcggggagggtccgcgccgtcgccacgcccgcccgcgccccccgcgccccgtcctccactggctcggtgaagagcgccatgacgatgacagagaagatcctggcgagggcgtcggagcgcgccagcttggagcccggggagaacgtgtgggtggacgtcgacgtgctgatgacgcacgacgtctgcggccctggcaccatcgggatcttcaagcgggagttcggggaggacgccaaggtttgggaccgagagaaggtggtcatcatcccggaccactacatcttcaccagcgatgagcgagcaaaccgaaatgttgatatcctcagggatttctgtatggagcagaacatcaagtacttctatgacatcaaggacctgagcaatttcaaagcaaatccagactacaagggtgtttgccacgttgctcttgctcaagagggtcattgcagaccaggcgaggttctccttggtactgattctcatacatgcaatgctggagcctttggccaatttgcaactggaattggaaacactgatgctggttttgtgatgggcactgggaaggctcttcttaaggtgcctccaactatcaggtttgtattagatggagaaatgccaccttatttacttgcaaaggatctgattttacaaattattggtgagatttctgtatctggcgcaacatacaaatccatggagtttgttggatcaactgtggaaagtctaaatatggaagagcgaatgacactgtgcaacatggttattgaagctggtggcaagaatggtgttgtgcctgccgatcaaactacatttaactatcttgagggcaagacatcagttgaatacgagcctgtctatagtgatgctcaggccagatttgttagtgactaccggtttgatgtatccaaattggagccagttattgccaagccacattcacctgacaaccgtgctctagcaagagagtgcaaagatgtcaagattgaccgggtctatatcggttcttgtactggaggtaaaactgaggacttctttgctgctgcgaaggtgttcttagcttcggggaagaaggttaaagttcccacttttctcgttccggcgacacaaaaggtgtggatggacatttatagcatccctgtaccaggagccggtggcaaaacttgctcacagatatttgaggaggctggttgtgatacaccagctagccctagttgtggtgcttgtttgggtggtcctcgtgatacatatgctcgcatgaatgaacctatggtgtgtgtgtcgacgacgaacaggaatttccccggcaggatggggcacaaggaagggcagatctacctggcttcgccgttcaccgcggcggcttcagccctcaccggatacgtcactgaccccagggacttcctgatgtaaacagttaaaacacaaaaggagttggatgctcagagccattggcgtcttgtactactgtacaacggctgttttttcttgttcaatttcaggtgtagtgtaggtttgtccccttgggtaataacaaccaataagttattttcctttcattctatttcctaattgtgtactgggatattatatatttggtggacatgattttgcttgtggacagagcgc

SEQ ID NO: 188 - DNA, 1092 bp, Oryza sativa
cctaagcctctcacggttcgggttctccctcacacactgaacaccatggcggcggcggcggcggctccggctctatccttggccgaggcggcgccggtgacagcagttctggcaccgtgtcccacgccctcgaggacgttccgccgccgcagctgggtcgcggctatctgccggcccgccctgaaatgccaccacagtcgtcccctgaccgccgtggtcgccgcggctgcggctgccgctgcggcgggggactcgacgtcggccggcgtattccacggcgagtgcttcgtcgtgggggataacatcgacaccgaccagatcatcccggccgagcacctgaccctggtcccgtccaagcccgacgagtaccgcaagctcggctcgttcgccttcgtcggcctccccaccgcggcctacccgacgccgttcgtcgcccccggcgaggagaccacccgctacgccgtcatcatcggcggcgccaacttcggctgcggctcctcccgcgagcacgcgcccgtcgccctgggcgccgccggcgcccgcgccgtcgtggccgagggctacgcgcgcatcttcttccgcaactccgtggccaccggtgaggtctacccgttggagctagcggacactggagcctggaaggagtgcaagaccggggatgtggtcacggtggaacttgataattgcgtcatgatcaaccacacatccggcaagcagtacaagctgaagcctatcggcgatgccgggccggttattgaggcaggcgggatctttgcctatgcccggaagaccggaatgatcgcatccaagtctgcgtgagggaaaggcgagtttggtctgctgtcaagatagtcgaggcctctgcagatagcaagtaagactgggttgtggatttgaacctattgcacctctatgcgattgtccatcagttgtactgctgtttttacctaggttgtgtgtcatcagtggtgtttttggaataagttaaaagttacagagtactgaactatgatgtattagtccatgtgatcttatgtaacaccttatgtaatacactcgtttatacctgccgatttgcctatctcgtttcga

SEQ ID NO: 189 - DNA, 2056 bp, Oryza sativa
aagcatctctcgagtctcgagtcttcccttctcagccagcttcgcctcgctcgctagctatccatctcttcctcctcttcttctcccttcccttgtttgcttggaaggagagggggaagaaaagtaggaggacgcggttgcgggttggtccagatctagggcaaggcggtggccggagtttgagctgggcccgccggcggcgagatgaagcagtcgatgcggagccggcaggagccgcggcgggtgagcaacggcgtcatcatcgccgccatgctgctctccctctgcgtcctcagcatcgtcaaggccagatactgctccacccccttcgttaagcccgacgaccagctacaggagcagatgaactccagcatcaggatggagaccgacgagccggcgaccatggcggcgggagagcaagaggaggacgaggaggaggagagctctggcggtggcggcgctgagcctgaggtcagcgccacccctgccgtcgtggtcaccgccgcagccggcggcggcggcggcaagaggaagccgacctgccgcatgacgagcaagcggtcggagcggtgcgaggcgagaggggacattcgtgtggaggggaacgcgtccaccatctacatcggcgggatcgacaaggagtggaagacgaagccgtacgcgcggtaccacgaccccgtcgccatggccgtcgtccgcgagttcaccctcaagccggtcaccgagtcgtcgccggcgtgcaccaggaaccactcggtcccggccttcgtcttctccaacggcggcttctccggcaacctgtaccacgactacaccgacgtgctcgtgccgctgttcctcagcacccaccagttcaagggccaggtgcagttcttgctcagtgggctcaagccatggtgggtgaacaagttcaacctcttcttcaggcagctcaccaagtacgacatcctcgacatcgacaacgacaaggacgtgcactgcttcccccggatcgtggtcggcgccaccttccacaaggacatgggcgtggaccccaagcgctcgccggggcacgtctcggtggtggacttcaagcgcgcgctccgccgcgccttcgggctggagcgcgtcgcggcgtcccgaggcggcgccacggggaacggcaagccacggttgctaatcatttcccgcaagaactcgcggcggttcctcaatgagcgggagatggcgcaggccgctgccgctgtgggcttcgaggtgcgcattgccgagcccgatcagcacaccgacatgtccacattcgcccagctcgtcaattccgccgatgtcatgatcggtgtccatggtgctgggctcaccaacatggtgttcctcccccgcggcgccgtcctcatccaggtggtgccattcggcggcctagagtggctcaccactgtcaccttcaagaatccggcgaaagacatggaggtcacctacatggattacaatgtgcagctggaggagagctcgctgatcgatcagtacccgcgcaatcaccaggtgctcactgatccctacgccgtgcacaagcaaggctgggacgcgctcaagacggcgtacctggacaagcagaacatcaagatggacatggacaggttcaagaagacattgcaggaggcgctcgacaggttgccgccagcatgagagcttgatgaactgatgaaagctcaagcccacgaggtggtggtggtggtggtggtagatagataggttggtgtatctatctgtgccttctcttgcttaacttatttttccttttgaaattctttttacgccttcttcttcctttagcaacattcatttgatctgttgttttggaaaagaaaaaaagaggatgaacaagaacatcatgttacatatgcctagctgatgagtaatttataccctttgtgattattaattggttgtttatttacaagtaaatgtcaagatacaaaattgtggattactagtaagtatcaaatgtgagtgtacctccctctaatgccaggggggcaaactgtattctcctatgccttcttcattgtatcaattcaat

SEQ ID NO: 190 - DNA, 978 bp, Oryza sativa
ggatgccttagctgccacatagctggtgcctggtggcgagcgcaacgaaccacaaggaagagcagatggcggccaccggcgctggagaaggcaaggagacggccgccgtcgccggcggcggcggcggaggtagcctgcacagtaagaccctcctcaagagcgagccgctctaccagtacgtgctggagtccaccgtgttcccgcgcgagcccgactgcctgcgcgagctccgcctcgccaccgccaatcaccccatggcggtcatggcggcctcgccggatcaggtgcagctgttcggccttctgatcgagctgatcagcgccaagaacgccatcgaggtcggcgtgttcaccgggtactcgctgctcgccaccgccctcgcgctccctgacgacggcaagatcgtggccatcgacgtgagccgggagagctacgacgaggtcggagcgccggtgatcgacaaggccggcgtggcgcacaaggtcgacttccgcgtcggcctcgccatgccggtgctcgacgagctcgtcgccgaggaggggaacaaggggaggttcgacttcgcgttcgtggacgcggacaaggtgaacttcctcggctaccacgagcggctgctgcagctggtcagggtcggcggcctcatcgcctacgacaacacgctgtggggcggctcggtggcggcgccgccggcggcggccgacgaggcggtgccgtcggggcgggaccgctcgctcgccgcgctcgccagggagttcaacgcggcgatcgccgccgaccgccgcgtcaagccgtgccagctcgccatcgccgacggcgtcatgctctgccgccgcgtggcctgaccaccacaacacaccgatcccctctccatggatgtacttttcagaaagtgcgttgggtaaaagtaaaaatgaataaaagttgctactacttggactcttttagtcataaaatataaaaatttggatgatgtgagta

SEQ ID NO: 191 - DNA, 2056 bp, Oryza sativa
atcaattcattaacgggtcatctcctgccttccccattggtccgaacagctaccgctagcacacaaaagtacagaattccaaaccaaatcctgtaccaaaacaggaagggcgcaggcatgcctcttcttatcgtgcagcccgtacccatttcgacaggtcctattgcctgcgctagcaccgcgcgtcctgcagcagcggcgcacgatgacgacggccaccttttcgacgatctcgtgctcggctacggcggcgacgacaagacgagcgccgacgccgacgatccagcgaggaagctcgagtggctcaggtcgcaggtcatcggcgcggacgcggagttcgcgtcgccgttcgggacccgccgcgtcacgtacgccgatcacaccgcgtccggccgctgcctgcgtttcgtcgaggacttcgtgcagcgcaacgttcttccctactacgggaacacgcatacggtggacagctacgtgggcttgcacacgagcaagctggcgtcggaggcggcgaagtacgtgaagcgcagcctgggagccggggcggaggacgtgctgctcttctgcggcacgggctgcaccgcggccatcaagcggctccaggaggtgacgggcatggccgtgccaccgacgctgcgctccgtggcgctggacgtcctgccgccgtcggagcggtgggtcgtcttcgtggggccgtacgagcaccactccaacctgctcacgtggcgggagagcctcgcggaggtggtggagatcgggctgcgcccggacgacggccaccttgacctcgacgccctggaggcggcgctggcggcgccggagcgcgccggtcggcccatgctgggatccttctcggcgtgcagcaacgtcaccggcatccgcaccgacacgcgcgccgtggcgcgcctgctgcacggctacggcgcgtacgcctgcttcgacttcgcgtgcagcgcgccctacgtcggcatcgacatgcggtccggcgaggaggacgggtacgacgccgtctacctgagcccgcacaagttcctggggggaccgggaagccccggcgtcctggcgatggcgaagcggctctatcgcctccgccgcaccgcgccgtccaccagcggcgggggcaccgtcgtctacgtcagcgcatacggcgacacggtgtactgcgaggacacggaggagcgcgaggacgccggcacgccggcgatcatacagaaggtccgggccgcgctggcgttccgggtgaaggagtgggtcggcgaggcgtgcatcgaggcgcgcgaggaccacatgctcgcccttgctctccgccggatgcaagcgtctccaaacctgcggctgctgctcggcggcgaccggcccagcggagggcgctgtctccccgttctctccttcgtggtgtactcaccgcgcgacggctccgagcaggatgagcggccgcagctgcactgccggttcgtgacgaagctgctcaacgacctgttcggcgtgcaggcgcgcgggggatgctcctgcgcggggccctacggccaccgcctcctcggcatcacgccggcgcgagccaaggccatcaaatccgccgtcgagaagggctaccacggcgtgcgccccgggtggacgcgcgtcagcctggcctactacacgtcgacgcgggaggcggagttcgtgctggacgccatcgacttcgtcgccagtttcggccaccggtttctgccgctctacgctttcgactgggaaaccggggactgggagtacaaccacagcttcggtcgtgtcctggcaaacaacaacgccatcagcaatgctgccgctgctgcttctagtggacgggtcaaagcagaggacgagtaccggagctacatggcatttgcacggagcctagccgactccttgggcggatgtctggataacactcctgctagacacgttcccaagggcatcgacccacagttgctttacttccctatgtgagatcggatagttggattctttgttgttgaattttacccttggtttttggccgaaaacctggagagatgcttcttttgtgccgaaactt

SEQ ID NO: 192 - DNA, 1309 bp, Oryza sativa
cagcattgtgggccccacatgccaggaggacaggtggggcccaggtagccctttgctgcactactacccacaactgccgcttaatgctgctgcctcagcttaattatagccttcctcctcctcctttcctccctctcgaggcccaggtgttcgtccgtgtcctcttctccactccacacacgcacacgcacaagccaagcagcaagcagcggcgccgatgagaggaggagcagctgggcccaccgccggcgagccgccggggacggaggcggaggcggaggaggtggaggagagctcagctggggacgacgaggagctggagctcgggctcagccttggctccaagaaacagcagcagcagcagcatgcgccgtgccgaatcctgacggccagggacctgcagccggcggcggcgctgtcaccggactcctccgtgtcgtcgtcatcccccgcggcggcggcggcggcgggggggaagagggctgagggccccaccgccaccacctcgcctgggacggttgcttccggccatccacacagctttggagtggtgggatggccaccgatccgacagttcaggatgaacagcctgttcaatcaggctaaagaaaacacatctgaaaccgacaccaagaagaccgccaccaatgaatctgatgtgcagaaggacaaggaggagggcgaaaagaaaggacgggttgctggatgggtgaaggtgaacatggatggagaggtcattggaaggaaggtggatctcaatgcgcaccgctcatacaagacccttgcattagcccttgaactcatgttcacgaagccgtccattggcctttgcgcttctcataatacaaagtcgctgaaactactagacaactctgccgaataccagctcacctacgaggacagggatggtgactggatgctcgttggagatgttccttgggaaatgtttgtcagctctgtgaagaggttgaggatcatgaggacatcagatgcgaatggtcttggtcagcgataccagggaattcacagaaccattgcttcaacaagaggcagatcctgagagcgtgtgacaaggaaaagagctataccgctggtgaagcttggagcgtgcttgatggttaattacttgtccagttaaaatagcagaaggctagtaagaaagagccacagggctcacccggttctgttatatttttgcctttgtggtgcctgtttttgtttgcactgtcgatctgcaagagcatatggtcgccttgctctgcttgcatgtacaagtatgtctttctagtagtttttatggtgtttgatg

SEQ ID NO: 193 - DNA, 2677 bp, Oryza sativa
caaccgcttccgctttccgctgcctccgctatactacaaaagagagagacgcctttggccttttccgctttaaaacaccacacagtgacacacacaccgcgagcgcgccgctcgcgagtagagtgggagttcggttcggcgaggcgagaccggccatggcggcatcggagaccgcgccgttcggcgtctcggcggcatccaagggcggcggcggggtggcgggggcgagggcgcagcacgggcaactggcggtggcggggcgggtgcacgacgcgctcgtcttcgcggcgggcgcggtggcggcggtgctcgtgctgctggccacggcgtcgttcctgtcgcccatgcccgtcacgaacctcgtcgcgttccgctccctcccggtgtcggtcgcctccacgtccgccgcctccgcggcgatcgacgccgatgtcggcgtacgcggcgggccgggcgcggcggggaggacgttctacgacgactcgagggtgtcgtacgccgtggaggtcgggcggcgtggggggatcaccgggtgggacgcgaggcgggcggcgtggatgcgactgcggtacccgcgcgggctcaacgcgacggcggcggggagggagcgggtggtgatggtgtccggctcgcaggcgccgccctgccgcggcgagggcggcgaccacctcctcttccggttcctcaagaacaaggtcgactactgccgcctccacggcgtcgagctcctctacaacaacgcgctgctccagcccaggatgctcgcctactgggccaagatccccgccgtgcgcgccgccatgctcgcccaccccgacgccgagtgggtctggtgggtcgacgccgacgccgtcttcaccgacatggacttctccctcccgctccacaagtacaaggatcacaacctcgtcgtctatggctggaacaaggaggtgtacggcgagcgctcgtgggtcgggctcaacgccggcgtgttcctcatccgcaactgccagtggtcgctcgacttcatggacgcgtgggcgcgcatgggccccgcctcgccggagtacgccaggtgggggagcgtgctccacgacacgctccgggggaagtccgacaaggagtccgacgaccagtcggcgctcgtctacctcctctccgagcacgaggagaaatggggggccaagacctacctcgagaagggctacttcttccaggggtactgggtggaggtcgtcgaccggctcgacgacatcgcggcgaggtacgaggcggcggagcggcggccctcggcggcggcggcgcatctccgccggcggcacgcggagcgggagcacgagcggtacgcggcggcgaggaacgcggcggtgaggggcgccgtcccgggccccgccggcggcgggcagagcgggtggcggcggccgttcgtgacgcacttcaccgggtgccagccgtgcggcggcgagccgaacaagatctactccaagaagagctgcgccgacgggatgaaccgcgcgctcaacttcgccgacgaccaggtgctccggaactacgggtaccgccacaaggacccgctctccgacgaggtgcggccgctgccgttcgactacccagccgcccggtgacgcggcggcggcggcgccgccgccgccggccttggcctggacgcgcgcctagctctttcgttctctctcgttcgttacagtaaaaaagaaaagaaaatgaaattatcagtgctggtaatagcagggacagataaattcggcccaaatttgcatcttttcaagtcaaatctaccctgcttttgatcttgcttttgtacctttgtttacttctttttgtgaagtatatatgatcatcaaaactatagttggattcgaatgaaatcttcagttcaaagcaaaaacaaataaaaataaataaacttcagttgcttcttgttattgagagtgggaaacatgactgttgcattgccaatgcttttgattctgatctcatttcagagacttgtttgatcagaattgtcggtgagtcggtgctcattagaaaataaggcattgtttagcaggggaaatttttcggatatacggtcacacatttacaatattaaatatagtctaataacaaaacaaattacagatttcgtcaaaaaattacgagacaaattttttaagcctaattaatccatcattagtaaatgtttactgtagcaccacattgttaaattatgatgcaattaggcttaaaagattcgtctcgcaatttacacgcaatcatgtgtaattagtttttttctatatttaatattccgtccaaacatttaatatgatagtgtaaaaatttttgttttgtgaactaaacagggctaaactgtttctaatgcctccagcttcggatcacgggagcttccagaagaattactacaaaacacctccagcttcgagaagaattactacaaaacacccgatcccggatcaagccacaaattgctctgctgacaaaagattaaagatcaatcgaattgcagatctcgagatgcttaacatttatttcaaatattgcaatggtttttaaacttaaaacagccagtcagtttaggctttacggagtatgtggctgaactgagaagatgttgtagtgcagtgctgtactgacaaggtgcttaaagaaatactagtgtgttttaaggtttgga

SEQ ID NO: 194 - DNA, 711 bp, Oryza sativa
acacacatcagcatccatcgcagcgagcgaccgtcggcatcacaagccatctccctctctcttgtcttgtgatctagctcccgtcgcgatcattgtgatataggcatggccaggtcatcgtcgtcgctgctcgtcctcacggtcctggtggtggccgcggcggcgtgctccactacggcggcggcgcgcagcgtcccggcggaggagaagaagacggctgcgccggtggcggcggcggacgtgaagcagccggagacgttccacgaggggacggtgttgatccctgggctcgggcggttcgagctcggcagcacctacgtgccggacatcaccggagtcgaccacagcgtcccggcagccgagcacgggcagttcctccccggcgccgacgacacatgggtccccaaccccggcttcgaggtgcccaaccccttccagcccggctcgtcttctccctgaatcacccgccggctcgccgtcgtcgccgagctagctagctaggcggcggtttgccggagtaataatgtgtgtgatcccacgtgtccccgtcggtgcacggctgccgtagtggagtcgtttagtttttcaattgtgtgtggatgcgtaggatgcattcagatgtttggcttgatcgatcgcgtgcttttgttagctttgaactcgtaataatgtattaattggtgagtgattatgcaagagctcggtaaagta

SEQ ID NO: 195 - DNA, 528 bp, Oryza sativa
gccctaggcgagcgagggagaaagagagaggcgttggtcggtggccgcccgtcgcttctcctcttccgacgccggcgcggccgagagaaatggcggtggctgcgagggctccgctcggggtggtggcggtggtggccgtgctcgtcgtcggcatcttcatgcccgccgcggcgcaggccccggcgcccgcgcccgtcagcgacggcacatcgatcgacctggggatcgcatacatcctgatgctggtggctcttgtgctcacctacctaatccatccactggatgcttcttctccctacaagcttttctaatcccttgttcttccttcatctggcttggttagggtaaattctacttattatttagccatggcgacgattgttaacattttaggtgagatgttaggaggtttggagtgatttgtctgtccatgatgggggtggtatcaatcagatcgttgtttggtggtgcgattggctgtattggattccatgatttggtgccaagttgtgcgtgctggattcgttc

SEQ ID NO: 196 - DNA, 3057 bp, Oryza sativa
aggctgatatttagggtggatgtggaagccaactcaacagatttgaagccactgcatgaggggctaataaataagtctacatgcttcactttcttgtggtaaccttgtatgctgtatcagtctctagagaaatatcaactcattggtggaaaagaaacattctggtgtgttcataactcagccatttagagaagacaatgtcagcttcggagttcaggattccttaccagcaagtatcatcttcacagactactgagaatgcaggccagttcaagatctgccgatgtggggaaggagacccaaatacaaacacatctgaaactggtgataaatcgccaactagttgtcctaattgccaggttcttaagagtggacatttactgctctcatctaaaggaattggttggacaacatggaaaaagcgctggtttattcttacaagggcatcattggtgttcttcagaagtgatcctaatgcacctcccagaggaaatgaaccgattgttacactaggtggaattgacttgaataactccggaagtgttgtggtcaaagaagacaagaaacttttaacagtgttatttcctgatggccgcgatgggcgaactttcactctcaaggcagaaactacagaagaactcaatgaatggagaagtgcactagagaatgctctggcacaggcacctgttgtagcaaatactgttggccaaaatccaattttcagcactgacatagcagagcctgctgaagctccagctgaacagtcggacaataaatctatcattggcagacctgcagagtttgcccttgtagatgctgatggtagtccagctttcctggagaaggccttaaagttcattgaagattatggtgtcaaggtggaaggaatcctacgtcagtctgctgatgttgaagaagtcaaacgaagagttcgggactatgaaaaggggaaaaatgagttctccccagaagaggatgcacatgttattggtgactgcatcaagtatgttcttcgagagatgccttcatctccagttcctgcaccatgttgcactgcactggttggagcttaccgaactgacaagacaagaaggcttgatgctatgaatagagtaatttatgaagttttcccagaaccaaaccgacaactattgcagaggactcttaagatgatgcagattgttgaatcacacaaagctgtgaataggatgtctcaatctgctttggcggcttgcatggcaccactccttctccgacctcttcttctcggtgaatgtgaaattgatagcgactttagtatggctggggatggttcattccagctgcttcaagctgcagctgctgccaaccatgctcaagcaatcgtcatcattatgctcgaagaatacgatcagatatttgatgacttggaagacggttcctactcttcagatgcatatactgagtccgaagacggtgattttgacaaggaatattccacagacaacgatggccctgaagaggatgactcttatgattctggtgaagataacattgaagaaggcatggatgatgatactgagcactcatctggtggcagtgaatgtgacaacaacattaagaccagtgtctctgatgacaaggttaaaagcaataactctggcacagcatctaatggcaacgatcagggtttacaacctcctaagaaagcagcaagaacaggacatggtgcggtaagggaagacacctgccaaattgaaagcaatgatccatccaatcgaaaacaagaattatacgaatcaaatggatccacagaccaaatagaaaagttaaatgttcgctcatcatcagcaagagcaaaatttatggagaaatcaagcagctcaagaaataagagcaaaaagaccttatggggccgtacttcagcaagaaaaaacctgtcagcagaggagattgactattgcagtgatgacgagactcttattgagaagcttgagaacagcaagacagatctccaatctaaaattactaaggaggcgaaagaaaattcaatcctacaagcaagtctcgaaaggaggaaagtagaattgcataaacgccgattagcactcgaaaaagaagtggaaaatttgcgagatcagctacagaaggagagaaatttgagggtctcattggagtcagggctgatgaatttgcgaagagggcaggcgtccttcccatcaacaattgacaacaagggttctgatctccgtgggcaactcaacaaccaggtccagatgagctccgcctcattatgtgactcatgcaacaaacgactgctaaatacagacaagctaaccgaaggtgaacagagtaccacatcatcaaatgttgggcccaattctatatctgacatggtatcggctacacacatggctcaaagaatgttgatttctaagggtgagattgtgaaggatggccaagatccattggcatcaaagtggaaccttgcacagaaacaatactcaaataatccactattaggcaggcttggatctagaacagaggattccggggcaccatctgcattagccaagctgacaaatcgactcaatttcttgaaagaaagaagggcgattcttgcaagtgagatgcagaacttagatttggctcgcccgccagggcctccagctccagctccgaagagagactccacatgagaagtgagaattttaacatggcatcattatcaggctacggaactttgcactgtttggtctcaaatgtgagcaatgcacatatgatggacgttacataagctatttcactcctgctttggaagatggggattggggatgatgtatattgtaagttgtaacattaccagatgttgctcagtctgagacgcatcatcatgtgagaaaaagaggttggtggtggtgtttacataaatcgttgattctacaaacatccatagctctaggtaaacatgatctgtaaatttctcaggtaatcgtgtttttcaccacgaaacattgacttacctggtttgcgccattggatgtatgtagagaatagttaaaccaaaaagcgctatcg

SEQ ID NO: 197 - DNA, 889 bp, Oryza sativa
atcgcttctcctcttccatctcacagagcttccagattccaagaactgaagaaaaaactttcaagaacatctgaaacatggcactgcccatcaagcttctcctagtctctgcatttctctccctcctcctcctgatccaaggcgcggcggcgaggtcgtcgccggcggcggggaagtgcgcggcggcgagcgtggaggtggagcaggcgaacaccggcgagaaggcggggtacgacccggtgttcgaggtgacggtgcgcaaccggtgcgcgtgcgcggcgcgcggcgtgcgcctccgctccgaggggttcgcgagctccgtcgccgtcgacccgcggctgttccgcctcgaccgcgacgccggcgactacctcgtcggcgacggccgccgcatcgagccctccgccgccgtcacgttccgctacgcctgggaccgcgccttccgcatggcgccggccgccctgctcgacgactgctcctgaaaaaccaaccatcatcgatcgtccactgattgattctctgatcgagattcaagaacaaccggtgataaatgtgtttattagcagcgtgtagtgacagtgaattaaggagtaattagtagtagtatttacttagttgagagtgttcttgggtatttgctggcttgctgctaatggcatcaatggcatgaatgatcattgggcattggcatgtgctgaagaacacaaatcggattcagaaaaaaaaagtgaaaggtggatgaggcttttttgtttttagctgagaagatcaagtgtctcagtttcaggtgacgggaatgtatggtttggttggttgtttgcttcccagtaaaggagcttagtggctaagtcttggattaatttaacccctgtgttcaacttcattttgc

SEQ ID NO: 198 - DNA, 1272 bp, Oryza sativa
ccgcgcgccaccaccccgcgggcgcctccgtctccggatttcacccggtataaatctatgaccgagccgacgcgagctttcttgcgtgttgtagctggagtgttcgaaggaattactggctggcacgcacgcgcgcacgggcatggtggcggtggtgatgatggcgatgaggaagaggatgcgcggcgcgctgctggcgctcgcgctgctgctcaccgcgacggccgtcgtgccgctgctcctcctcggagaggccggggacgacggcgtcggggccgtcgccgccgcgccgccgttcaacgcgtcccgcgtcagggcggtgtcgtggaggcccagggtcttcgtctacaaggggttcctctccgacgacgagtgcgaccacctcgtcaagctggggaagaggaagatgcagaggtcgatggtggcggacaacaagtccggcaagagcgtcatgagcgaggtgcggaccagctccggcatgttcctcgacaagcgccaggatccagtggtgagcaggattgaaaaaagaattgcagcatggacctttcttcctgaagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggggtgggaaaatcagcccaaggatgacactttctctgaatgtgcacaaaaaggattggcagtgaaaccagttaaaggcgacacggtgctcttctttagccttcatatcgatggcgtaccggacccgctcagcctccatgggagctgcccagtgatagaaggtgaaaaatggtctgcaccaaagtggatccgtatcaggtcctatgagcatcctcctgtctcaaaggtgacagaaggatgctccgacaacagtgcacgttgcgcgaaatgggctgaagctggagaatgcgagaagaacccggtatacatggtaggtgccgagggtttgcccggcaattgtcggaagagttgtggcgtttgtgattcctaggatgtgtttattttcctaaatctgatgtttgtgtcacttgctgaacacttgatttgtacatacttagagcattttcagatgaaataggtagcatttgaattttcagacagtgaacagtagcatactatttcttcaaaaacaacggcttacatcctttgcacatggttttg

SEQ ID NO: 199 - DNA, 967 bp, Oryza sativa
ctctctcgccactactccagctccaccagcggaagaagaagaagaagatgagcttgtttgggcggagctccaggagccagctgacgttcaggcccaagaagagctccccttccgggagcaagggcttgccgctgaagaagcacatcgacgccaccctgggcagcggaaacctgcgagaggcggtccgtctgccaattggagaagatctcaacgaatggctcgctgtcaacaccgtagacttcttcaaccaagtgaactttctgtacggaaccctgatggagttctgcacttcatctacctgcccgatcatgtctgccggaccaaagtacgagtacaggtgggctgatggaatgaaggtgaagaagccagttcaagtgtctgctccaaagtacgtggagtacctgatggattgggtggagagccagcttgatgatgaggccattttccctcaaaagattggggctcccttccctcaaaactttcgcgaggtgatcaggaccatcttcaagcggctcttcagggtgtactcccacatgtaccactcgcattttcagatgatcctcaagctcaaggaggaggcccatctcagcacttgcttcaagcactttgtgctcttcacttgggaattccatttgatcgacagggcagagctggctcctctcaacgagttgatcgagccgatagtgtttcggtatttttaagagcgctccaacaactgatgaggcaaacttcagagaaaccttgttgttttttgtatgtctctgttggcccgcaggattaatttgcagcccattttccccttttcgtttcctttcaaatttgatgaatttggatgaacagtccgattcatctccattttgggagtaggttaattggtgctgttgtactcagttcagaagtactaatctgcagttgctttttgttgcaatctgttgtgattagttcaaatgaaatcttgggtttcggc

SEQ ID NO: 200 - DNA, 1460 bp, Oryza sativa
gccgccgcctgcctcgccgcgccgccgtgctaggaggaggaggagggagcagccgcggagatggccggcaaggagaacgccgcggcggcgcagccccgcctcacccgcgccgccgccaagcgcgcggccgccgtcaccgccgtggccgtcgccgccaagcgcaagcgcgtcgcgctcagcgagctccccacgctgtccaacaacaacgccgtggtgctcaagccgcagccggcgcccaggggcggcaagagggccgcctcccacgccgccgagcccaagaagccagctccgccgccggcgccggcggtggtggtcgtggtcgacgacgacgaggagggggagggggatccgcagctctgcgcgccctacgcctccgacatcaactcctacctccgctccatggaggtgcaagcgaagcggcggccggcggcggactacatcgagacggtgcaggtggacgtgacggccaacatgcgaggcatcctggtcgactggctcgtcgaggtcgccgaggagtacaagctcgtctccgacacgctctacctcaccgtctcctacatcgaccgcttcctctccgccaaatccatcaaccgccagaagctgcagctcctcggcgtctccgccatgctcatcgcctcgaagtatgaggagatcagccccccaaatgtggaggatttctgctatataaccgacaatacctatatgaaacaggaggttgtcaagatggagcgcgatatactgaatgttctcaagtttgagatgggcaatcctacaaccaagacgttcctgaggatgttcatcagatctagccaagaagacgataagtatcctagccttcccttggagttcatgtgtagctatcttgccgagctgagcctgctggagtacggctgtgttcggctcttgccatccgttgttgcagcctcagtggtgtttgttgcaaggctaacccttgattcagacaccaatccttggagcaagaagttgcaagaggtgaccggctacagggcatctgagttgaaggattgcattacctgcatacatgacttgcagctaaacaggaaagggtcatctctaatggctatccgggacaagtacaagcaacataggttcaagggcgtatcaacattgttaccccctgttgagatccctgcatcatacttcgaagacctaaacgagtagatgttactggatgatgatgtggtgagattaagattgagctttcctcaagatagatccatggtgactgaagttgaaagggggcttgtcagtacactcagtacaagagatgtcctaccttggatgctggactgtcaaagcttagctaggagctcttagggttgatttattaagctgaagcttagtacacttcagtaagatgctaggcatgtggagagttgtacctctgtatcatattcatacattacaacctgatgccttaatttttgggccagaactgc

SEQ ID NO: 201 - DNA, 1883 bp, Oryza sativa
atctcagatgatactgaattctttcttgctattttgaaacattgctgctttcaggggaacaaattctcttctgtaggtgtggtgatcctctatctctcgtattgccctgggttttgcttatgatggaaggtcatagcaatgaactgggacgggccaacaccttgaagaaaggaggtcttcgaccaatcccggtcatcatcgcaaatgaagtatctgaacgaattgtgagcgcatcagttactgcaaaccttattatctaccttacaacaaagtatcacctcggtgctgcaagtagtgcaatcatcatctttgtgtatcaagcagctgcaaattttttgcctgtgtgtggtgcaattgtgtctgatgcactattgggtcgttacctgatggttacattaacattgttctcctgcacaactgggacttttatgctattcctaacatcactaattccaaaattaacacccccagattgtggtctttcaaatcaaggttgtacttcgccatctccactacaactgtttgttctgtgtgcctctcttggtttcatgtcgctcggagcgagtggtgttcgcccctgctgtcttgcctttgctgaggatcaaattgctcattgggacgaagcccaaaaggaccgtgcactccgtggtttgttcagctggtactatgtatcggtcggcttcgcgcagatagtggctgttaccatcctcgtctactttcaagatcaggtgggttggaaggttgggtttgggatttcagccgccgttatgctatccatcacacttgtgaacttggcagcatcacccttctatgtgaagatgaagccacagaggagtatatggatcagcttactgcaagtggttgttgtgtctcttaagaaccaccacctggtacttccgaagacatatcagagtgctcagttccataatgcctcgggattaagagagctagttccatctgaaaaaatgagattcttgaacaaagcatgcattctgagataccatgcaaccaatgtgagcgatggagcaggcagaactaactcatggaacatctgtaccgtggagcaagtggagaacctcaaatctgcactcagcgtgataccgatgtggtcagcaatgataatgaccttcctgatacaaagctcatccttcggggtactacaagcagccaccatggaccggcgagttggcacaaaaaagttccaactaccggcgggctctatctcaatctttgagatcataaccttcacgatatggtcaggctgctatgaccggtacattgtgccatttcttagaagaatcacaggtaggcagcaggtgctaacccttaagcaacggatgggcattggtgtgtccttgtccattgcatccatgcttgtggcatcagcagtggagacatacagaaggaaggttgcggttaagggagggttgcagcacgatgctaagggaacattggaaatgtctgtgctgtggctggcacctcagtatgtcataataggccttgcaggcgcatttagctccattgggcagatcgaattctattatgcggtgcttcccaagtccatggggagctttgtgctagcattgctcttcttcggtgctggtgtcgcaagcatcattgcaacattagtgatcaaggccatcaacctgatcaccggtagaaatggcatggcaccatggctgtccaataacctaaatgagggtcactataactattactacttccttcttgctgtccttggtgccattgacctgatctatttcatagtttgctcttatgttttcgacgaaaggacacaaaacatgtccctggaaactagtggtgatgcaaaagacatggtagagtttcaaggctagctcaagcaatggtagtgcaaattagtg

SEQ ID NO: 202 - DNA, 2584 bp, Sorghum bicolor
agagaaccaaaccgtaacgtgtgacgaggcgaaacctcgctgactggctccgccgccgccccgaccgcaccgcgcgtgccccccgccgccgtcgtcccccggaaggttttcgcctcagcgcatgtggatctgttagttcacctcctgcaagcaagtatagctacaaggttcaccgctgcagaagtatgaatccttactttgttgggattcttgtccctgtcgcggtctcccttttgctccgcaagaggagaaaggccgaaaggaagaggggagtgccagtcgaggttggtggggagcctggatatgcagtccgtaactatcgatttgagcagcccgttgagacacactgggagggggtctccacacttgctgagctgtttgagcaatcttgcaaagagtatgtcaacatgccactccttggcaccaggaagctcatctcgagggaaactgaagcagcacctggcgggagatcgtttgagaagttgcatctgggcgagtatgagtggaagtgttatgcagagtgcttcaagagcgtttgcagcttttcatctggactaattcgagtaggtcacgagaagaatgaacgtgttgctatttttgctgagacacgggctgagtggcagattgcgttgcaggcgtgcttcagacaaaacattacagttgtcaccatctatgcctcattgggggaggaagcattgtgtcactcactaaatgagactgaggtcactactgtagtttgtggtcagaaagaactaaagaagttgattgatataagtgggcaacttgacactgtcaagcatgttgtctatatcaacgaggaaggcatatcagctgaagtttctttagctcaaaactgcactagctggaaggttgaatcatttgaggaagtaattaggttaggatctgaatcacctgttgaagccaacatgcctctcccttctgatgttgcggtgataatgtacacaagtggtagcaccggattgcccaagggagttatgatgacccaccgcaacgtcctggctacactctcagcagttatgaccattgtgcctgcacttggcagtaaagatatatacttggcctacctcccacttgcacacattcttgagttggcagcagaggcactaatggctgctgttggggcctccataggatatggatcacctttgaccctgactgatacatccaacaaaataaaaaagggaactctaggtgatgcttctgcactaaagccaacattgatgactgctgtacctgctatacttgaccgtgtgcgtgatggtgtgaggaaaaaggtggatgcaaagggtggtatagcaaagcaattgtttgacattgcctataaccgtcggcttgctgcaatcaatggaagttggcttggtgcctggggtttggagaaacacttgtgggatacgcttgtgtttggaaaggttcgtgctattttgggaggaaagattcggtttgtactttcaggtggagcacctctatctggtgatactcagagatttatcaatatatgccttggggctccaatagggcaaggttatggtctgactgaaacttgtgctggagggacattttcagagtatgatgacacatctgttggccgtgttggtgctccactaccttgttcgtttattaagttgatcgactggcctgagggtggatacttgactactgatttaccaatgcctcggggagaaatagtcattgggggtccaaatgttactaaaggctatttcaagaatgaagctaaaacaaatgaagtgtacaaggatgacgaaaaaggtatgcgatggttctattctggtgacatcggacgattccatccagatggctgccttgaaatcattgaccgtaagaaagatattgtgaagcttcaacatggcgaatatgtatcgctcgggaaggtggaggctgctttgattgtgagcccatatgtggagaacattatgatccatgctgatcctttccacaattactgtgttgcgcttgtggtagctgcacacattgagctggaaagctgggcttcacagcaaggaattaaatacagtgatttctcagatttgtgccagaagcaagaggctgttaaagaagtgcttggatctttagcgaaggctgcaaagcaagcacgacttgagaaatttgagataccagccaaaatcaagttgataccagagccatggacccccgagtcaggactcgtcactgctgccctcaagctcaagagggaggtgatcaggaagacgtatgagaatgatctggctcagctgtacgcatgatggttctactactatttttgatacgtttagtgtggagataatatagagtgccaatgtcactatgaaagctgtgataatttgataacgattatcgatctttagggattacgttttttttttggtaaagctagaggagataaaccttgaagttttgagttatggcttctcttgatgctgagacgctatcctgctctttctgtcaaaaacactctgcggtagcctcatgtgatggttcctatgtgtttaggataaaatggctttgaattcttgttgcacttgttcatctcttatcttgagataac

SEQ ID NO: 203 - DNA, 7518 bp, Sorghum bicolor
cagcatcatcatcagaacttcagaagaaataaaaagagagaaggtagaaaagaatccctctggatgtggatgatggatggctgtcttttgaacacaccactacccaatcactcccgtcccattctgcaccactcaaaccggctggcggctgctccttgtgcatttcatttcccccgcccctcctcttcgtcctcccggacaccacaccagcccctgcaggctgcagcttccccggccgcggccaagccagctgcctcgctcgagaagcacagccaccagggcaagctggaggatggccgcagtgatgaaggctctcgcggtcgcctcgccggtgtcggcacgggcagcgcagcagccccgtcggtacgtcgcaggtggcgctagccagcttcagtcgtcgttccacggcgtgtcggtgcagtgccctgggcgaccgcggcaggcaacgccccggcggggggtgcaggtggtgatgatggcggctcggccgtcgatccagttcatccagggcacggacgagcagacgatcccggacgtgcggctgaccaagtcccgggacggcaccaacggcgtggccatcttcacgttcgagcagccgtcggtgttcgactcgtcggcggagctcggggacatcacgggcctctacatgatcgacgacgagggcgtgctgcagtccgtggacgtcagcgccaagttcgtcaacggcaagccggcgcggatcgaggccaagtacgtcatgcgcacgccccgggattgggaccgcttcatgcgcttcatggagcgatactcccaggccaacggcctccagttcgtcaagaactgatcgatgtactcaactcaactcatgagctgacgatcgagcctgctttgagagctctctcgatcgatccacgcaatggccggcaattgctctcatagttgccttcacctcactctttctgatgacgtactcgatcgagtgcctgctattatctacgtactgctagtcttctttttctttctcccctggtgttgtgatgtgacctgctgtgattgaatttttgtagagaaaaatatgcatatgtactactacaacaaaaaaaaagaaagggaggtttgtttatttgtgtatcaacgctggtcatgagtttggaacgtccgtcagaatgctttggattaacgaattggaagagaatttactactagtactaatcgtacagtctgccatgattgctaggcatgctgcattttggcgcgaaccgtggggtgcagttaggaaagccgccggtcttgctaaagcttcggctccgtgtaggtctgtggacccaaaaagggcgtggcggcccacctccacctccacgtatgcggagacagccagacagggcaagggccaagggcgcaaggcaagctccagccccagcgccaaatgcgtcgcgccgccgccgccgcagtggcggtcgacccgcagctcctagcgggcgcggtcgaggcggcgatcgcctcccggtccccgcggctcggccgagcggcgcacgcgcgcgcgctgaggctgctggctccggccctcccgcccttcatctgtgcgcacctcgtcaacctctactccaagctcgacctcccgggcgccgccgccgctgcgctggccgcggaccccagccccaccgtagtgtcctacacggccttcatctcgggcgcggcgcagcacgcgcgcccgctccaggcgctctcggcgttcgccgccatgctccgcctcggcctccgccccaacgacttcaccttcccttccgccttcaaggccgccgcctccgcgccgccgcgctgcgccgcggccgtcgggccgcaggtgcacgccctcgcgctcaggttcggctaccttcccgacgacgccttcgtctcgtgcgccgcgctggacatgtacttcaagacgggccgactcgctctggcgcgccgcctgttcgacgaaatgcccaacaggaacgtggtcgcctggaacgcggtcatgacgaacgcggtgctcgacggccggcccatcgagacggtggaggcctactttgggctccggggggctggtgggatgccgaacgtggtctcggtctgcgcgttcttcaacgcgtgcgctggcatgacgtgcctgtcccttggggagcagttccatggttttgtggccaagtgcggctttgacaaggatgtgtccgtgtccaattctatggtggacttttatgggaagtgtcgatgcatggggaaggccaggttggtgtttgatgggatgggagttcggaatagcgtgtcctggtgttctatggttgttgcgtatgcgcagaatggggcagaggaggaggctttcttggtgtacttgggtgcaaggagagctggggaagagccgactgacttcatggtttccagtctgctcaccacttgtgcgggtctgctaggacttgaccttgggcgtgctctgcatgcagttgctgcccgttcctgcattgatgcaaatatttttgttgctagtgcgttggttgacatgtatgggaagtgtggtggtatccaagatgctgagcaagtatttttcgagatgcctcagcgaaatcttgtcacatggaatgcaatgatagggggttatgctcatattggtgatgcttggaatgcacttgcagtgtttgatgaaatgataatgggtcgagaaacagcacctaattacatcacaattgtcaatgttctcacggcctgcagcagaggaggtttgacaaaggaagggtatgagttgttccagacaatgaagcagaggtttgggattgaaccaagaattgagcattatgcttgcgtggtggacttgcttggtcgtgcaggaatggaagagcaagcttatgagatcatacaggggatgccaatgagaccttccatttctgtctggggagcactacttgggggatgcaagatgcatgggaagacagagctaggaagggttgctgctgaaaagttgtttgaacttgatcctcaggactcgggcaatcatgttctgctctcaaacatgcttgcatctgctggcaggtgggcagaagcaacagatgtaaggaaggagatgaagaatgttggaatcaagaaagacccagggcgcagttggatcacatggaaaaatattgtccatgttttccaggctaaggacacaacacatgagatgaatagtgagatccaggcattattggccaagctcaaagggcaaatgcaaggtgctggctacatgccagacacacaatatgctctctatgatcttgaggaagaagagaaagaatcagaggtgtttcaacacagtgaaaagcttgctctggcgttcggattgatatgtataccacctggtgtacctataaggatcatgaagaatctgcgaatttgtgtagattgtcaccgggcttttaaattcatatctggtattgttggtagggagataattgtgcgggacaacaataggtttcatcacttcaaagattatgagtgttcatgcaacgattattggtgaaagttttatccaccagtatactgatgcatgttttgttggcatctctagaaccacttctgcagatatagaaggtaactattttagttcctttacatcatttgtattctgtcatgtgacacacccgggcctgagatggtgtggccccaagacgacggtggcctggctccaaggcggcgactcgcaccctgggcaacagcgtgcaccccgggctgcggcacgggcctcagctcccttgtggcttctgtggggttatatttatctaagatatctggttgattgacttgcagagaggaagaagtgcaagttcttcctttctatagctgacccttgaaccaaggtttgtgctgaactaattttccttttcaatgccttagtgacaaccaaagctcaatggccccatgaactatttttctctgttttaagcatagtctagtttgctgttctgttagtataacttgtactctttaaattctgttagtataacttgtactctttaaatttccaccatgctaccatgtcaatgtcccattaaaaaatgtttcttaagcaataaatctatacagcttcagatagaaacttacactgcttctatcgctagaaatattaaagtgatcattgggacactactaatggttgctttgtcaaccatttcttatttccatccactgatctgataattgtgtaatctggtaattgtctatctagttagctaatttggccagcttaagagtagaaacttgtacactctttctatccttctgctgtacatggtaactagagggacattattattgtggtactaggaattgtaatttgtgaccagcaatggatttgagacattttggtgtaaattttatcgctgcagatccattgtatggggttttaggattcctaaatatccctattgatggtacagtgccagttctagttttgtgcacttctgatgtgatgaatttattgcagtgttgtcacactgcattagtgagggatttaccaagcttttttatttgttcttctgtataagcaattccagtaggttccttctagttgtaaagtagttctaatatttcctatctatccattttccacattgaggaggctttcctcaagcagatttctcaaattatagcacaaagaaatctggcaaaggcggcaaccgattctttgcattgaccttggcttcaaagactcccaggaaagcaattgaaggtttaatggtttcacttcgctggtgatccctagtgctatgacgtaccttgtttgagatggtgaaggacaacatgttcagtttaatacttttctgttctgaatggtttttttgttcctgcttgatagaattttgtcctaaataattaaattcgtagtctagctccaaatttcatttgctattttgaaaacaatgaggctatgttccctagcacatgaaagcaatgcatttcttagtgattatcctaacatgctttatttatatgcagaagtagatcagttttgcttaaagtcccatgacatttgcaagatctctaacagtagaatattccactccaggttttgttgaagtggaagaaccctgctgatgcaagtattgaaagtctgttagtgcaaaataggctaaatctttgtatacatagcattaatgatgtactaaaacatcagtgattcagtgggtcttagattttcattggaacgctcagtctcgtgggccatattttatttaattaaatcaaataaatcctaggaccatatttaatgctatgtgcaatatggtttaggccatgtttagttctaaaaagtttcttttcgttctatcacatccaatttttgggcggacgtatgcatggatagattaaaaaataactaattatacagtttacatgtaatctatgagatgaatcttttgagtctaattagtccataattgaacactaattgtcaaataaaataaaaatgctatagtagtcaaattttaaaaaataagaactaaaacacaaatgctatagtagtcagatttagtccgtatggaagtcggactatatatatgttgactttgttctgtgtactacgcgttattttttttgaagtactacgcgtattgagaagttgagaggctaagggcgtgtcagatgcacccctcggacgccgatccgtggcgagttgccacaagcgggctacgcgacgtgcatgtcaatagcaagatttttaacatgtgtatatcatgtgtagttaccaactgagactgagagtgacacggagacaccgcattcattctcaccacgcgagcctgcatattatgccgtcacctgagcctcatgaacatgcagatcgagcaggagcaagcactaataatccatccatcgtatctactatcatcagctttgataaaaacctagtagtaccaagtgtaagcatcatgaaagaaacttaaaggggcgtcctccaatccgagctttgggtctgtacctgtaccctgtgccccaaatcattcagacacatctcatctgcgccctactgtttatttattacacttccatggcatcatcaaaaagcagatcaagcaagccatctagagtctaatcctgaccttctagcccacccccctccataccgtaatgtttgttatctgcctttttcggtccccctcttcttctttgtactccttccatcgaaaaagaaatgtgattctcactttcagaagaatatgatataacaagtttaaacttgatcaaacatataaagtactagcatgtaatatttatgagaccaaataaatattattagattagtatagaatatattttatatagtgtacctattcaaaaatataggacctaattgatttgcttctccaaaatttggcatgtcaatgatttggcaagccataatttttgctattatttggttttgctaccaaaacatactaaactcttgcatttggcttgccaaatctatgacaatgtttttgcccaaactttagcttgccaaatctttagcatgacaaaacttggatgtcaaccaaacaggctcataaatatttgatactattttttaaaactttatttgtcaaacctaagaaagtttggcttatattgaatttagaattatattatttttacactatgagagtaacaaaaaaaatattaggaccaacgctaaaaaacacaattaggtctatgcatactaatttatatagacactacatataaaatctatgtcccaatagataatttttatagaatattctttttgcaacacatgttttctttttctttatcatctaccaatcacatctcttttatatcatggttatcgtgtatatggttcctgtaaaccatttcctcatctatctgctttaattggagtgccacgtcatctttttttagtttgcatcttaattagtgaacataaaaatccatctcgttttcatggttgggagtagctagttatcggacatccacatcttctctctaatcatgtagcgaagtcataggcacccacggtcctgtcatttttttaacatcctataaaaatgttgttctcactttctaaaaggtcaaacaattttaactttgaatctaaatatatataagaaaatatttaatatttacgcgattagtatcactagatgaatcactgaaggtatttctataataaatttattaagagatgtaaatattactaaaattttctatagacatagttaaattaaatttaggaaaaaattgatcaatacaaacctcataactacgttttaatttggatggagggagcagcatgtagagtaactagtactggtacagtaatgatcacggggttcctagacctagtcggctaatcctagtcccaaccccaaactggtttgatttgatcctgcagtaatttgacgtccaaatctcgcgtgtgttaacacctgatctgatgtccctctcttgtctcagatgtgtcctcctggacctgcggagcagaggatgaggggtcgagaggaggaccagacccgaccacgagcaaaagctcattgacgctgagatggatgg

SEQ ID NO: 204 - DNA, 414 bp, Sorghum bicolor
aggtagaacatcaaacattggcccgcttttgattccttcacccagtttgtactcacctgctaaatcggcaaaaagatgttcgccttgaaagtagcagttttacttttgttgatcacaataattgctgttaaccctgcgactgcatggccatgtaccgctcaagaaaaggaccaaattgtgggcgtgtgcagaatttacatcctgaaaggagccctcgttcagctcccaccccaaactggaccatgttgcggggcagtgcgacaattagaaaaattacacaagagtccgcagatgaattgcatcgccagtaaactaaacgcggcagatttacagaaatacgatccaacaaaggtcaggcatcttgacgaatcctgctaccaaaagcattagtttcctcctccccatcgttataag

SEQ ID NO: 205 - DNA, 1648 bp, Glycine max
tagtctgaatcacaagtcgcaccacgacatcaccgtctcaaattcgcttttcgtcattcctttttattttcagtgttggctgtgctgtcgcctccccatattcagattcatttcaattcttcttttttttttttctttcttcttcttcctcctattcggattcgccacatacagatggagggctcaaaggaaaactgtgtgcctcggattccgctcataccctcttcaaatcttcaagaaggtccaagaatgaagcctctcctccatcaccggctgcctctcggcaacatcagtcagaatgttaatatgcctcattctcaagtcaacaaactagatctttcccgcaagtgtacggctcacacaattcagcaccacttccctcaagaaactaagaaacagaacctgttggccccgaacccgagttgcaagttagattgtgatatcgtagatattgatgatgacgatggggatggcagtgacgatgccgttccagtatttgtcaagcacactgaagccatgcttgatgaaattgacaagatagaggaagttgaaatggaagatgtggaggaggaacctgttttggacatcgatgcctgtgataggaaagatccacttgcagtggttgagtacatagatgatatatacagtttctacaaggacattgagaattcgagctgtgtctctccaaattacatgactagtcaacttgacattaatgagaggatgagggcaattcttattgactggcttattgaggttcactacaaatttgagcttttggaggagacgttgttccttactgtcaatctcatagacaggttcttggagcgtcaggcagtgatcagaaataaacttcagttagttggtgtcacagctatgctaatagcttgtaagtatgaggaggtcacagttcctaccgttgaggattttattctgataacagacaaggcatatacaagaaatgaggttttagatatggagaaattaatgatgaacatcttgcaattcaagctgtctatgcctactccatacatgttcatgagaagatttctcaaggcagctcattctgataaaaagctggagctcttgtccttcttcttggtcgagctttgcttggtagaatgcaaaatgctgaagttttcaccatctttgctggctgctgctgccatttacacagctcaatgtagtctgtaccagtttaagcaatggactaagaccaccgagtggtacactgattactcagaagagaagcttctcgaatgctcaaggctgatggttactttccatcagaaagctggatcagggaaactcaccggtgtatatagaaagtacaatacatggaagtatggctgtgccgcgaaaatagaaccagccctgtttctactggataattaagggaatgcaagtaaacttctagtttctaatgcattgctttggttgttttgagagtttgcttgtgctagaagtttgttttgagagcttcagagacctatcaacagaagttggcctttactctttcagtaacgtgtgtctttttctttacactcaatcttggctttcaggattgtatggacaaagtgaattagcacataaattgcttttactaatcactgaaagatacagttagtcatatggttcttgaattaac

SEQ ID NO: 206 - DNA, 1644 bp, Glycine max
gagagagtatctaataaaccgaaagtgtcttagtcttccctgcttccgtcaactgcaatggcaatggcaattgcaatggttcctcaacctctgctgacccttttcctctttttctcccttctctcaattgccaactcttctccttcccaacaccttcagatcgccaatgccgaacgcaggattgatttgacttctcacattattaaggtgtacttgacattgaaggttgaaaatttggggacatctcctgcttcagaagtacatattgccttttcgcccactgaagtagaacatctagcaatagtcaaagctgctgcaacttctgggaagaggaagaagaaaacttatgttcctctagatgtcaaatctgctgagctacctgatggaccaaatggaactaagtttttctctataactttgttaactccactaagtaaaggtgaaaccacaacactagaggtgctttacatattgacacattctctggaacctttcccagtagaaataagtcaatcagagtcacagttggtttatttccgtgatagtgcaatattattgtctccctatcatgtcaagcaacagacaacttttattaagactccaagcacccgggtagaatcattcacagtggtggaccccactaaacgtgctggtacagagttgaaatacgggccatatgaaaatcatcccccgtattcatattctcctgtacttattcattttgaaaataacaatgcatttgctgttgttgaggagctagaacgtgaaattgaaatatctcactggggaagcattcaagtcactgagcaatatagcttggtccatgctggtgctcgacataaaggtgttttttcaagggttgaatatcaaactaaaccaggtggtactggtgtttcttcatttaaacatcttttagcgaaactaccccctagggttcactcagtatactacagggatggaataggaaatatttcctcttcacatctacgtacagattcttggaagtcagaacttgaaattgaacctcggtatcctctatttggaggctggaaatcaacctttgtcattggttatgggctaccattgcaagacttcctttttgagtctccggatggcagaagatacctcaattttacttttggttgccctcttgtcgagacagtggttgacaagttgattgtaaaagttgtgctgccagagggatccaaagatcccacagttgagattccttttgaagtgaagcaacatctagagatcaagtattcatatcttgatgttgtcggcagaactgtggtggttctagaaaaaagaaatgcagttcctgagcataatgctccttttcaggtgtactacagttttaaccccatattcatgcttgctgagccattgatgctggtatctgcatttttcttgttttttgtggcttctgtggcatatcttcacattgatctttccatacgcaagtgatgaacacctagctagtttcttgaaaggcagtgactgagcagatccaaggttccttatttttgaaggtcatattgcattttggcaattttgtatggagttaagaggattaattgcagttatagatatacttgtttgtacattttttcccaggcaatttgatcttgtgccattcatcca

SEQ ID NO: 207 - DNA, 2603 bp, Helianthus annuus
aattccacatagatcctagtgcacctttccacccagtgagatcatcacaaatacaccatttgtctccccattcgccggccaccgacactttctaattccggcaacatcgccatatctccggccaccaccactcccttcacatccatcaacccgtcggtaaaaaccgcattccatatctcaactttcaccgtcggtatatttttatttccaaattaatctcacataacaccaacaggttacttttctctcaaattctaccctaaatgttgctcaaatgttagagatattatgttgttttgatgatcgagataactgtgcattgttttgaggatcaatttcaccggaaaacttgtattttggtagattagtttacggttaaattctggttgaatttgatataattgtgtgccctaagtgttattcatatacattcaccagttcggtgacaattcggcggttttcgtggtgaatcgtgatcattatttagatatttagggatagttagggtttgagttgtggatgtgtgattgagagatgtgtaaggtagataattagcctcaagtagcatacattcagcggtttggtgacaattcagcggttttcgtggtgaatcgagatcattgtttagataattagggttttgaggtgtggatgcgtgacagagaaatgtgtagggtggaggatagagataagaagaggaggaggtttgcaattggaacaatgggattaaggaaattgggggaaattagggttgagaagttgaagaattctatggtgaacgtaaggtcgggtaagatgaagatgatgttaataagggcgatgacgacggtgttattgtggatttgtttggttcagttgactgcattaggaggttctttgggacctagggttttgaaagggtggccttcttgctttactcaagattctcattcggctgctgcgttggatgttaagttgttgcctgttcatgccagagttcttccgcacaagagggtttacaagaacaatggttacttagtggtttcatgtaatggaggactgaatcaaatgcgttcggctatttgtgatatggtcgcgattgctagatatttaaatgttactctaatagttcccgagctggataaaacttctttctgggctgatccaagtgagtttgaggacatttttgatgttgatcatttcattacatccttgagagatgaagtccggatacttaaacaacttcctccaaggcttaaaaagagagttgaattgggaatcgtgcataccatgcctcccgttagctggtctgatatttcttactatcataaccagattcttcctctgattcagaaatacaaagttgtgcatttgaacagaacagatgctcgtcttgccaataatggtcaaccccttgagcttcaaaaacttaggtgtcgagtaaatttccgtgctctgagattcaccaatcaaatagaggaattgggtagacgtgttgttaaacttttgagacaaaacgggccctttttggtgcttcatctcagatatgaaatggatatgttagcattttccggctgtacacaaggatgcaacgctgaagaggttgaagacttgaccagaatgagatatgcttacccatggtggaaggaaaagataataaactctgatttgaaacggaaagacggtttatgccctttgacccctgaagaaactgctcttacacttagagcactcgatattgaccgtgatatccagatttatattgctgccggtgaaatatatggtggaaaaaggagaatggatagccttgctgctgcctacccgaaactggtaagaaaggagactctgttaggagcagctgaccttcaatatttccaaaatcactcatcacaaatggcagcattggattatcttgtgtcactcgagagtgatatttttgtacctacttatgatggaaacatggccaaagttgtcgaaggccatcgcagatttttgggtttcaagaagacaatactcttggacaggagggttctggtcgaattaatcgacaaatatactagtggcttgctgggttgggatgaattctcgagtgctgttaaggatacacatgcgcaacgtatggggaaccctagaaaaagattggttattgcagatagacccaaagaagaagattacttctatgcaaatccagaagagtgcttgcagccatcggatgatgatgatgaagaagaagctgtgaacatcctatgatcaaggatttgcggttaatttggtatgaatttacgagagtatgatttttggtcctcgaccctgtcggtgtacaatgagtgtttgttcaaaatatgaggatgccgcgcattttggcgagagaccatggcagatgacaatgtttccacgaatgcgaaggggaatccgttattattgtcttgttgcttttatttcttgtatagaaaaactgctgagatagcagggttgttcactactagtgatatgtatgtacacagagagagtcgaaaccgtaggtgtgtttttgctggtgctccattttttgcctttattattattcaatgtcagttgtgacatttgagtatatgcaattatataataaatagcataattattgt

SEQ ID NO: 208 - DNA, 1328 bp, Helianthus annuus
tgcatataccgaaaatgatggcagttggtgtgtcggccctgcaaataactgcagcaaggccgtccgtttttcttacacaaagaactctcggggctacgatggcaacttttgtacatgaatccgatagaattttgtcatctaagcttaccagctcttctcatctgtcatcggtgctaaatattaagcataagtgcacaacaagtcgtcctaggtttcaaaagttcgttacgaggtcgatgtcagaagcttctggaagcaagtcggtttcccagctgtccattgatttaaaaggtaaaagggcgtttattgctggtgttgctgatgacaatggatatggttgggctattgcaaaatcgttagcggctgcaggtgctgaaattcttgttggaacatgggtgcctgccttaaacatatttgaaatgagtctacgcaggggcaaatttgatgaatcacgggtgttgccagatggttctttgatggagattactaaagtttatccactggatgctgtctttgataaccccgaggatgtacccgaagatattaaaaccaataaacgttatgctggagcaagtaactggacagtgcaggaagttgcagaatcagtaaagcaagatttcggtagtatcgatattttggtgcactcacttgccaatgggccagaggtcacaaagccgctgttggaaacatcccggaaaggttatctagccgcggtatctgcgtctagttattcctatgtttctttgctcaaacattttcttccaattatgaaccccggtggttcgtcaatatcgcttacgtatattgcttctgagaggataattcccggatacggtgggggtatgagttcagcaaaagccgcactcgagagtgacacaagagtgcttgctttcgaagcaggaagaaaacataaaattagggtcaacacaatatccgcaggtccacttggaagccgtgctgctaaagcaattggatttatcgatacgatgattgactactctttcgcaaatgcacctctacagaaaacactatctgcagatgaggtggggaacacagcagcattcttggcatcaccattggcttctgccattacgggtgctcttatatatgtagacaacggcctgaatgcaatgggtgtgggggtcgacagcccgttgtttaaagatcttaatgttccaatggacaaacattagtaaaatgtacaagtcgaaaggtatgtgttgagaataaagtttttgaagttccggctagtagatttatatcttagttgtttgtaagttaagcgaagattgtgacaacttaatcatgtaaaattagaagatgtaagt

SEQ ID NO: 209 - DNA, 2665 bp, Helianthus annuus
gttccacagatttccgttcataacagatttctgttacattcaattcagttgaataacgatgacggttggagcaggtatatctgtaactgatcggaagctcaatgtgttcggaaatcctgtgttgaaggacgtacatgacaatgttttcgtcacttcttcaaccggtgacggtatgatcaatggcgcgttcatcggcgttcgatcggaacaaaccggtagtcgtatggtgtttccggttggaaaactcgagggattgaggtttatgtgtgtgttccgtttcaaactatggtggatgacacaaagaatggggaattgcggtcaggacatacctaccgaaactcagtttcttatagtcgaaacgagtgaaggttcacatttcggagaaaataatgaaatcgatgacggatcacaccaatctgctctatatacagtcttcttgccaattcttgagggtgattttagagcggttatacaaggaaattctaataacgaattggagatttgcttggaaagtggagatcctgctgtaaaagagtttgaaggtagtcatctggtttttgtggctgctggacccgacccgttcgatgttatcaccaacgcagtcaagagtgtggagagacatttacaaacattctctcatcgcgaaagaaagaagatgccgaacatgttggattggtttggctggtgcacatgggatgctttttacactgatgttacttctgaaggtgtaaaacaaggccttgaaagttttcagaaaggaggtatctcaccaaaatttgttatcattgatgatggatggcaatcagttggtatggaccccactagtgttgaagctaaagcggataattcggctaattatgcaaataggctaactcatattaaagaaaatcacaaattccagaaagacggtaaagaaggtcacagagtcgaggacccgtctatgggacttcgtcatgttgttacagacattaaagatcatcacaacgtcaagtatgtttatgtttggcatgcgttaaccggatactggggcggagtgagacctggaacggggcaatacgattcaaaactatcatttccgattccctctccaggaatcgaatccatcgaaaactgtgatgcttttatagccattgccaagaacgggcttggtcttgttgaccctgaaaaagtcttcaacttttacaatgaattgcattcttacctcgcgtctgctggtgttgatggtgtgaaggtagatgtgcaaaacattctagaaacacttggagcgggccatggtggtcgggtcaaacttacgaggaagtaccatcaggcgttggaagcttcagttgctagaaacttccctgataatggcatcatttcgtgcatgagtcacaacacagatggtttgtacagtgccaagaggacagctgttatgcgtgcatccgatgatttttggccacatattacagcttcacacacggtccatattgcttctgttgcttataatacagtcttccttggagaattcatgcagccggattgggatatgtttcatagcttgcatcccatggctgattatcacggtgctgctcgtgctgttggcggctgtgctatttatgttagtgacaagcctgggcatcatgactttaatttattaaaaaagcttgtgcttcctgatggatcgatactgcgggccaaacttccagggagaccaacaagagattgcttgtttactgatcccaccagagacggaaaaagtcttttgaagatctggaacgttaacaattacactggagtggtgggagttttcaactgccagggagcagggtggtgcaaagacggtaaaaagatcctcacgcacgatgaacaaccaagcaccatcactggcgtcatcagggctaaagatgtaaattacttgcctaaagttgccgattctacatgggatggtgatgcagttgcatacagtcacgtcggcggtggactggtttacctaccaaagaatgcatccatcccagtaacattgaaaccgagagaatacgaggtttttacagtagttcctatttcgaaactgtcatgtggtgtcggttttgctcccataggtttgacggaaatgttcaactctggaggggcgatttcggaattacggtatgagacagagaaagaaggaaatgtggagttgaaagttagagggtgtggtgtgtttggcgcgtattcaactagaaaaccgactagagtaattattgattcgaaagaaaccgaatttgggtatgaagaaagaagtggacttgttagtattaaactgagtgttcctgaaaaggaaatgtatttatgggatatcatcattcaagtgtgaagaggcgtttagtgtcggtttgcaactcagaatggcttcaagagcttgcagggctataagtaccaaaagtgggatatttatgagggttgttctaccctgttatttgatattcatctgactcaagtcaaccgtcatttagacaagacttgatcgttaaaataattcaacgtagtatgtcgcagcgtgttatggtgttgtatagtgagatgcataacaaatgtcatcatgattaatagatgtggtttttataagaactatttatcttgtactttaacaagaacaatgtattttagctttgatattatatgaatgcatttgggtcttgttctgatt

SEQ ID NO: 210 - DNA, 2551 bp, Solanum lycopersicum
aaaaacccttaaacaatcacttcactcttcaactcgaaaagcttcagctggccgttaatggcggcctcttcagataccgttacgccgtcgagcctccggttggctttcggcaatgtgttctcgttgttcattcttatactgatcggagttctcgctttctcgatccgtatcttctccgtgattaagtatgagagtgttattcatgagttcgatccttatttcaactatagagtcactcagtttctgactaagaatggaatttacgacttctggaattggtttgatgatcggacctggtatccacttggacgagtgattggtggaactgtttaccctggactgacattgactgctggcactttgtggtggatacttaattccttgaatattcctctttctgtggaaacagtttgtgtgtttactgctcctacattctctgcctttgctgcttgggcaacataccttctaacaaaggaagttaaaggggttggggctggactaactgctgcagctcttttggccatggttccatcatatatatctcgatcagtggctggaagctatgacaatgaagctgtggccatatttgcattgatcttcactttctatctctatataaagacactgaacacggggtccctcttttatgctactctaaatgccttgtcatacttttacatggtttgctcctggggaggatatacctttatcatcaaccttattccaatgcatgccctactttgcatcgtaactgggcgttattcttcacggctttatattgcctatgctccattagttatcttgggaacactattggctgctttggtccccgttgtaggttttaatgcagtaatgacatcagaacattttgcctcatttctggtgttcctaattctcaatgttgtggggcttgtctattacatcaaagggatgctcacaccaaaaatgttcaaagtagctgtgactcttgttgtatctgcaggcttgattgtttgctgcgctgtggtagctgtgctagttgcgcttgttgcctctagcccaacaaagggatggagtggacgaagccttagtctgcttgatccaacttatgcgagcaagtatataccaattattgccagtgttagtgaacatcagccacctacttggccttcttactttatggacataaatgtattagcatttttggtccccgcaggcattattgcatgctttttgcccctgactgatgctagctcctttgtgattctttatttagtgacttcagtgtacttttctggtgttatggtccgcctaatgcttgtactggccccagctgcatgtataatgtctgggattgctctatcatcagcttttggtgtttttactcgatcaatcaaatttgcatcaactggaaaacaggctgatgcaggggataatggtgatggggttacacagaatgatgtggtgaaatctgatagaaatgaagaactcccaaaggaaaaagcttcgagaaaaaagaagaaagaaaaggagaatgttgaaaaagttcccattgctaataaaaaaagtgagaagaggcttttgatgttacccatggaggcttcttttgttgctattctattacttgtgttgctgggtgccttttatgtggttcattgtgtctgggcagctgcggaagcttactcagctccttctattgtactaacatcacagtcgcatgatggacttcatgtttttgatgacttcagagaggcttatgcatggttgagccacaatactgatgtagatgataaagtggcatcatggtgggactatggctatcaaactactgctatggccaatcgcactgttatcgttgataataacacctggaacaatacacatattgcaacagttggtacagccatgtcctctcctgaaaaagcagcctgggagatcttcaactctttggatgtaaaatatgttcttgttgtctttggaggtcttgttgggtatcccagtgatgatatcaataagttcctctggatggttagaatcggtgggggtgtcttccctcatatcaaggaacctgattatctgagagatggccagtaccggattgactctatggctactccaaccatgctgaactccctcatgtacaaactatcttattacaggtttgtggagacagatggcaaggggtacgatagagtaaggcggactgaaattggaaagaaacattttaagctcacccactttgaggaggtatttaccactcaccactggatggttcggttatacaaattaaaacctcctaagaacagaatccgtggaaagacaaagaagtctaaatcgaaagctacttcttctagctcgagaagaagcgcaactcaaaagaagaatccctggcaatgaagggctactcataacaagtaacttctatttatcagctacatgataggaatacttcatacgatgagtagcttcatgtgaaaggattgtgctttaaaacgcggtcctcttaggtttttcgttcaagttttgaattgcgttgatattatacacagagaagacgattatcccggagctc

SEQ ID NO: 211 - DNA, 2547 bp, Solanum lycopersicum
attttgttacaaggttcaaagctcttgtctttctctctcttcatcaacctcattgtggttatggggatggattatgattgagtgaactagacaaaagcttagctaagtcatcaggacatatccccttttcattccccacactctactgtcagtcaacattatgcattttttttctctttgagtttactttcctttctttgttgttttcccctcaatttcatatcttatgagagttatttggtgaatggggttgcaagatttcttgttgaatacagtaaaaaactgatctttcttgtttttttctatcaagaaaatgtggggagctgaaagaaaacagagattcaagaaaggaatagagtgaaaaatcaaatattttttctcccctcttgcatttttatagcctgctacattcaatcagcacaatgaggaagcatggatggcaacttccctatcatcctctccaggtggtagctgttgctgtgtttctggcactgggatttgctttctatgtcttctttgcaccttttgtgggaaagaaattgtttcagtatattgtgatggggctttatactcctcttataattagtgcatttggcttgtatatctggtgcgctgctgctgatcctgctgatccaggagtttttagatccaagaagtatattaagaagctagaccacgaaaagcaagttcaacttaaagaatctaaattagggtgcgagacgaattcttctatacaagatgctaatgctgcatcgattggggaaaatgcatctggaaaaagcaataaaggagctgaaccagctgcagatcacaatgaaactgaacagaaaattacagctactcgtgaacgatctttctcttccggattgttggctctactaccttgtgctcttatcagcaactgcacaggcagacatgaggagtcttctcagcaacagttgagtgaagatggcatgttctactgcagtttgtgtgaagtagaggtatttaaatacagcaagcattgcagagtatgtgacaagtgcgtcgatcagtttgaccatcattgcaggtggataaacaactgtatagggaaaaggaactatcgcaagttctttgcgctcatggtttcagccctcctgctgcttatacttcagtggtcaactggaattcttgtactaatctgctgctttatcgagaagaagaaattttctgcggaaatcacctccaaattaggaagcagtttctccattgttccttttgttattgtagtggctgtctgtaccatcttggccatgatagcaaccctgccactagctcaacttttcttctttcacatacttctcataaagaagggaattagcacctatgactacatcattgctctcagagatcaagagcaacaaggagttgcaggtcagcaaagtcctcaaatgtctactgttagctccctaactggattaagcagtgcaagctccttcaatactttccatcgagcagcatggtgcacaccacctcgcctttttgttgaggatcagtatgatgtagttcctcctgatacagtatcggtcagttcacttgggaaaaggtcaacggcggatgaacctatcaagaaaaagaatccagctgccgtgaagattagcccatggacactagcacgattaaatgcagaggatgtttcaaaagctgctgctgaagcaaggaagaaatcgaaaattcttcagccagtggtgagaaacaaagaaccttacattcttgaaacaaatagcagtttaggaagtagcgggcgtcgcatggtgcctaggcttgataacaatagaaggagagctagtaaacgagttagactccctgcagagttaccctttgaaaccatgagtaaaattcccaatgatatagctcaaaacagcagaagacccatgctaactgagtcatcaagcagtttagctccccttcagcttgaagcacggagtgatttccgaacaacccgaggactgtccacctcaggtgttgttgttgcttcttcacctgagagtagtttggactctcctgacattcacccactccggatgtcatcctcaggagttgaagatgctgcacgtcttgtaggtcacctatcatctggaatgactcttcaaaaggatacaccattgtctagatcaactagtgatggatacgaggcatctggtggggaggatagtgatcgtgtgcctacccgaattgtgcaaaggtcaacaaggtggagtagcattctttttggttctgatcaacaagatgatagagtcagaagattgatggtcccgtcttcatcaacccaggctaacatcaggaagcattgagcctccaaacatacttgggaattcttctgtaagctcttgaagctacatgatctgttgacatttcttaatttgttgatgatgtttgtccagtagtatataccatcaacttggtctgttccattgtccattgagttcaatttttggatttttgggtgagagaagtgctgtaaatgtctagtggaaaaaacattatgtctattctcttgtcctcaaaatgcagagcattcaatga

SEQ ID NO: 212 - DNA, 1270 bp, Solanum lycopersicum
aagcacacaaggaacaaatttgtaaaattgtagtagtataaatagaagacgcatgttaacaccgacaaaacaacagaaatgccgatctgtagctcttcttcatcatcttcttcctctagctccgcaaaatcatggatccttcacggcttagccgtcggagcagcagcagcagccgtagctctcggcgctcacgcttaccttagccgatccggcaagtttcggagccgggtcataggtatcatacccgctcgttttgcttctactcggtttcaagggaaaccgctcgttcagattctcggcaagcctatgatccagagaacatgggaaagggcaaagcttgctgagacattggatcaagttgttgtggcaacagatgatgaaaagatagctgagtgctgtcgtggttttggcgctgaagtgataatgacttctgaatcatgtagaaacggaaccgagcgttgtaatgaagctcttcaaaagcttgataagaagtatgacattgttgttaatatacaaggagatgaacctcttattgaacctgaaataatagatggcatcgtcaaagccctacagtctgcaccagatgcggtctttagcactgctgtgacatctttgaaacctgaggatgcatttgatccaaatcgtgttaaatgtgtggtagacaatcgtggttatgcaatatatttttcacgagggctcatcccttataacaagttaggcaaggttaatcctcagtttccttacttgctgcacctcgggatccagagttatgatacgaagttcctgaaaatatatccagagctgacaccaacaccgttgcaactagaagaagatcttgagcagctaaaagtccttgaaaatggatacaaaatgaaggtgataaaagttgaccacgaagctcacggtgttgacatcccggaagatgtcgagaagatagagcagttcatgcgtgagaggaacatggcttagagcaaagtgagttattttgatgattcacatataactcctacagctataaaggtggtgttctttggtttcaatttgcgctttggttagcacgtcaattatcactgagagttaacttttgtgaagaaaaagaaaattggaactgaactcgccgtgtaaatcctgcaaatagttcataatatagagttgtttgaagtgtgtgtttcacttacgtattcatttgttgtaggatggttgtgtatcacattttctttcatattttacgattaattgatttgtatttattaaaactatgatttagtga

SEQ ID NO: 213 - DNA, 1597 bp, Triticum aestivum
atctatatatagcacttgtgggctctcagtacttggatttacggcgatggcgagggataatggcgacgggctggcggcgattgccgggcggatcggcgtgctcgggtccgtcgcgctgaacatcgcggcgctggcgatctacctccgtggccgcgccgccgccgagaagcaggccagcaagaaggtgaagaaggcggcggctgtggcgccgtcctccggcaagccgcccgtcgcgtgtgattcggtcatcaacttggatcacggtgatccaacgatgtttgagacgttttggcgcggaccgattggcgaaagtgctacgttggtgattccagggtatcaaacgatgagttacttctccgacgtcggcaacctctgctggttcctcgagccaagcttcgagcgtgaggtgcgccgcctccacagcctcgtcggcaacgccgccgtcgagggctaccacgtcctcgtcggcaccgggtcctcgcagctcttccaggccgcactctacgcgctcgccttgcccattgccgacgcgccagtcagcgtcgtatcaactaccccattctactccatgtacccgcccttgacggacttcctcaactcggggctctaccgatgggccggcgacgccaacacattcgacggcgacgactacattgaggtcgtctgctcaccgagcaaccccgacggcagcatccgcgaggccgtcctcaagtccaagtccggcaaggacatccacgacctggcttactactggccgcagtacactcccatcacccaaatgcttgcccacgacatcatgctcttcaccgtgtcaaagtgtacgggccacgccggcacgaggatagggtgggcgttggtgaaggacaaggaggtggctcagaagatgagcaagttcatggagcaaagcaccataggcgtgtccaaggacgcgcagctacgcgccgccaaggtactcggggcagtcaccgacggctacgagcaccagcttgccaccgctgccggtggggacgcgaacctcctcttccattacgcgcggcggaagatggcgcaccgctggtgtgcactccgtgctgccgtagcagcctccggcatctttagcctccccaacgaggtggccggcttctgcaccttcaccaaggacactgtcacctctaatcctgcattcgcatggctgcgctgtgagaagcaagaagtggaagacctagagagcttcttgcgtgagaacaagatcataacccgcagcgggactaagttcggagctgatcaaaaggtggtcaggatcagtatggtcgacactgatgaagcattcggcatattcgtcaatcgccttgccgccataaaatgaggacaccggataagtgaataatgtgtttgtttttatggccagtgaatgatgtgttgtttctcttagcttctctatattttcgtacctccctagttagggatcgatcgatgagttttgtttccgaatacccagcttagtgatccagctaaataatttcatttttctaggtttctttacttatgaaacaacctgagatgctatttattccgaaagagaggttggaaaaaataacacagtacaaataccgaaaac

SEQ ID NO: 214 - DNA, 1973 bp, Triticum aestivum
ccctgctgcttccgtctccgtttctgcttctgctccactccactggccggccggtcgttcatggccgcgatgatggggatctccgctttgcgctcccaccacccgctccccctgtcgaccgcgcgcccggccacggctctcccccgcgccacgtcgccgacgtcgcaccaacccagctcgctcacgcttctacgatgccgatgccgatgccgacgcagcctcccccattcttgctgcagctcctctcctcgcgcctcgctctcgccaggcgcccccgactcggctgctttcatggcattggctcccaacaatgccgcccttcgccaccgcctcatcgcccccaactccaccgccggctccggagacgccgccgccaccggaggcctgcccagcgttgttggcatcgcgcacctggcggtgtcgctgggcatcgtgctggccacggacaagtacctgaagcaggcgttcgtggcggcgtccatcaagttccccagcgccctcttcggcatgttctgcatcttctccgtgctcctcgtcctcgacaccgtcgcgccggcgctggccaaggccttcatggacttcttcgagcccgccacgctcttcatccagcgctggctgccgctcttctacgtcccctccctcgtcgtcctgcccctcgccgtcagggacgtcccggccgcctccggcctcaagatctgcctcatcacattcggtggctggttcgcttcgctggcggtggcggggtacacggcgctcaccgtgaggaagatcgtcaagacggagctcatcgcggccgagccgatgggcaagccgtccgccttcgcgacgttggagttctgggcgtggggcgccgtcttcgtcgcctcgttcgcgacggcgttcgtgaaccccacggcgcttggcaccacggccaggacgtgcctcccgttcatgctcgcttccactgtactgggatacatggttggttctgggttaccgcctggtatcaagaaattgttacacccgatcatctgctgcgcgctttctgcgaatttgtcggcggtcgcatacgggtacctctccgggtccggaatcgatgctgcgctaggtgattacctgacaaaggtgccatcaaatcctggagctggtgacgtcctgatgggttttcttgggtctgtcatcttatcatttgccttctcaatgttcaagcagagaaagcttgtgaagaggcacgcggcagaaattttcacgtcgatcgcgattgcgtcgacattctccctgtactccacagccatcctaggacgcctgattgggctggagccaacattgaccatctcgatattgccaaggtgtataaccgtggcgttggctctgagcatagtgtctttcttcgaaggtgcaaacacttcgctgacggctgccgtggttgttctgacgggcctgatcggcgccaactttgtgcaagcggccatggataagcttggcctcaacgaccccatcgccagagggatcggaacagcttccagtgctcatgggttgggaaccgcggcgctgtcggccaaggagcctgaggcgctccctttctgcgccatcgcctacgcgctcaccggcattttcggctcactgatctgctcctctccggccgtcaggcaaagcctggtgttcatagccggctgacacacatatacactggtatacagcaacaacagcagcttgtgatgagtttttctttcctttttataaaagaatggtaagtgcttggagaacaaaagtgcaaaatttcccgccaaaaaaaggtcaacatgtaaaaatggatggttgcaacaagtcaaggtgtgagtagtactcccttgcttgtatagctgcaaaatgttcagtgattgcttttcttcatgtgatgttttttctaaaggaacaagagtaatagcctaattgctttgatgccaacaattggcattcctatcaattggttggttggcaacaaatcgttcttg

SEQ ID NO: 215 - DNA, 2465 bp, Oryza sativa
gataccgatagctcccggtcaaatccttcgtagggcaggcttcctttattgcactcctgctcccgcgaaagcctcgcctcgccttttctccctaccaagccaccacgccacccaaaccgcgatttctgatcgatcgatcgttagctcgatccaagaacccatcttttctttgatccccaatcctcttttgccgaggattaattgggagaagatgacgatgatggggtgtgccgtgctgctcgtggtggtggcgtccatggcgggggaggcggcggggaggttcgtggtggagaagaacagcctgcgggtgacgtcgccggcggggctccggggcgtctacgagtgcgccatcggcaacttcgggatgccgcagtacgggggcaccatgcacggggtcgtcgtctaccccaaggccaacaagaaggcctgcaggtccttcgacgacttcgacctctccttcaagcccaagcccggcggcctccccatcttcctcctcgtcgatcgcggagactgctacttcacaacaaagggatggaatgctcaaaccgctggagctgcagctgttcttgttgccgatgatagattggagcctttgataacaatggactctccagagtctagtggcacagattacatagagaaaattactgttccttcagcacttgtaacgaagaagtttggggacgaccttaagaaagcactggaaaacggtgatatggtcaatgtccttctggattggagggaatctctccctcatcctgatgagcgtgtagagtatgaattctggacaaacagcaacgatgaatgtggtgccaaatgtgacatgcaaatgaattttgtgaggaacttcagaggaacagcacaggttcttgagaaaaggggttacactcagttcacccctcactacattacatggtattgtccggaagcttttgtcctgagcaagcagtgcagatctcagtgtatcaatcatgggagatactgcgctccagatccagagcaggatttcaacattggatatgatggaaaagatgttgtgcttcagaacctgattcagatttgcttgttcaaggttggcaatgaaactcacaaaccatgggtgtggtgggattatgtacacgatttttcaattaggtgcccaatgaaggagaagaaatacacgcgtgaatgcgctaatggtgttatcaagtcacttggattggaccttgagaggatcaacaagtgtgtgggagaccctgaagctgatgaagaaaatcccgtgcttaaagcggaacaagatgctcaaattggtcaaggctctcgaggagatgtcactatattgccgacccttgtcgttaacaacaagcagtacagaggtaagctggagaaaagtgctgtgttaaaagcagtatgctcaggatttgaggagacaactgaacctgatgtttgtttgagtcaagagatccaaacaaatgaatgtttggagagcaatggagggtgctggcaggacaagactaataattttactgcgtgcaaggacaccttccgtgggcgagtttgtgaatgccctattgcccgtggtgtgaagttcgttggtgacgggtacactcactgtgaagcttctggtgtcggtaggtgccaaatcaacaacggaggctgctggaaggaaactaaaaatgggaagacggtttctgcctgctcaaatgaagaatctaaaggctgcaaatgcccaccaggtttcaagggtgatggtataaaaagttgtgaagatattgatgaatgcaaagacaagcttttctgccagtgcaaggactgctcttgtgagaatacatggggaagctatgagtgcagctgtggtggaagtaatatgttatacatgagagagcatgacacttgcatcagcaaagttgcttcttcgtcagtgggctggggcttcctttgggttattttctttggcctcgctttggctggaattggagcatatgccgtatacaaatatcggctacggagttacatggattcagagattcgtgcgatcatggctcagtacatgcccctggagaatcaagaaacaccgaatcaacatcgtcctgtggagcatgctgatatctgaaattgcagcaagcttaactgggagctggcagcagtatcggtggtcgccatcttgacagagtggtaggcttggagctaccctttgtgcccagaagataaaaaaaaattcagtatagcttatgtttctgaaacgacaagatttttgcatatcctctttttctctttgctgaaacttgcaggacagattaggatctccccagaattaacacctcattggcctctagtcataattatgagcttctggtcttgttcttactctactcctacatgtttttttgtttttcagcgagatactcctatatgttaaaagcttgtaaatactgttgttcagacaatagtccttaataaagagaccggaagagcattctacacct

SEQ ID NO: 216 - DNA, 2797 bp, Zea mays
cactcacactcgctctctcactgaagtgaggaagaacagagagaaggggagggagatcgtagcagcggcgctgttcgagagctcgccgatctgctgcgggaatggggtgcacggcgtccaaggtggagcaggaggacacggtccggcgctgcaaggagcgccgccgccacatgaaggacgcggtagcggcgcgccagctgctggcatccgcgcacgccgactacctccgctctctccgcgtcaccgccgccgcgctctcgcgcttcgcgaagggccacccctcgctcgccgtttcgcaccacactacccccgtcctcctctccgctgccgcaccgccgcctgcccccagcgccgcccgtgcgctccccacaccggcgccgtccaccgccgcgtcgtcatcgctcccgcctccgacgccgctcgcccagcacccacacccgccgccgcagccgccggcggcgatggcggcgccgcaaccggcgccggcgagggcaccgcgtccgcggcggctcagggtgccccacatcctgtcggactccagcgtggccagccccgcgcggtcgtcgttccgcaagcagccgccggtgggcacgccgtcctcctcgtccgcgtgggactgggagaacttctacccgccgtcgccgccagactccgagttcttcgaccgccgcaaggccgaggtcgagcatgccagccgtctccgggagctcgaggaggaggagaaggcccgggcctacctccagcaccacacccagtacaacctcaaggaagaagacgaggccgccgaagacgacgacggcgaggtggaccatgaaccggaggggatgcattgcggcggatgggaggacgacgagcactacgcgtccacgaccacatcggagaccagatcggaggatgagggcgagatgggggacagatcagaatgcgggttcgcggccagatcggagtgcgggttcgtggccagatcggagtacggcgggacggcaccgtcagagtacgccgccgtcccattgcccctgaggagggatgagaggtcggaggctggcgactcctccacggtcacggcggcgacagagatgcggatggtggtgcgccatcgcactctcgaggaaatcgtggcggccattgaggagtactttgtcaaggcagccgactccggcaacgatgtgtccgagctcctggaggccagccgcgcacaactcgaccgcaacttccggcagctcaaaaagacggtgtaccattccaacagcgtgctatcagcattgtcgtcgacatggacatcaaaaccgccattggctgtacgatacaagttggacactaatgcactggagatggagtcgacggaagggaagagtcatggatccactctagagcggcttttggcttgggagaagaagctctacgaggaggtcaaggctagagagagtgtgaagattgagcatgagaaaaagctttctactctgcagagcctggagtacagaaggagggatagcgcaaagctggacaagaccaaggcctccataaacaggctgcaatccctgatcgtagttacgtcgcaggctgccacaaccacatcatcagccattgttagagtccgtgacaatgagcttgcaccacagcttgtccagctctgttttgcgctactgggcatgtggaggtcaatgaaccatttccacgagatacaaaacgagatcgttcagcaagtccgcggcctggtggacaactccatggccgagtcaacatccgacctccataggcttgcgactcgtgatctcgaggccgctgtcgcggcatggcactcgaacttcaaccgtctcatcaagtaccaacgcgactacatccgctctctgtacggctggttgaagctcacgctctgccaggtggacagcagcgtgccccaggaagtccatgcctcgatgatctcgcgcgagctcaccagcttctgcgacgagtggaagcaggcgctggaccgcctcccggacgccgtcgcctcggaggcgatcaagagcttcgtgaacgtggtccacgtcatctacaccaagcaggccgaggagatgaagatcaagaagcgggcggagacgtactccaaggagctggagaagaaggccaactcgctcaggtccatcgagaagaagtactaccagtcctactccatggtcggcctcggcctccccggcagcgggcgcgatggcatcgaaagccacgctgcgtacgatgcccgcgaccctctcgcggagaagaagaccgagatcgcccagtgccgccggaaggtggaggacgagatgacgaggcacgccaaggccgtcgaggtcacgcggtccatgacgctgaacaacatacagaccggcctgccgggtatattccaagccatagctgggttctcggggacagtggtcgaagctcttgatgtggtctgccgccgagctgggtctgtgcggtagaagaagctctttcccatcaggattaccaagagaccatttgctgcctctctctctctctctctctttctgggtgattcagtagtttatttatatagggaaactgcaatatattatatatatagctcaaagtagagtggtcaagtatagaagatggttccccggatgttttgccctgtcacaggatggtttcagttgtagttgtagataatgtgattttgcccaggatttgttggtctcctttttctggggcgagtgcgaggggagagatttataatgtacagacattaaggttgccttgcactctagcctcatcatgatcaagcctgtgtttctgtttagcaaaagcgctggtgtcc

SEQ ID NO: 217 - DNA, 2631 bp, Zea mays
cgagcaacccactgccgcccgggatcgagccgccgcattgccgcgtcccttctggagccgccgccgcccacgggggtaccggatctgaggagcaaaggccattacttatcgtaagcaagatttctaattggcggaagcttttatgtgtagctgactgttgaatttactggtctcaagtatagagtaggcaggcaatctgcagtttagtggaacccaatgggttcttctccttccaaagccactggagaggatgccctggttctgtgcaaggatcggatgcgccacatcagacaagctattgactcgagagatgcactgtcagcagcgcacttatcttacacacaatctctccgtagtgtgggtactgcactgcggcagtatgctgagtctgagatctcaccggaatcatcgctctccatttcagaagtggataagtcaccatcacattcctctatggcatctccttcgccttcgcgtgcagtagagagtgttgcctctctggggcatcgagcaagtccatctattactccaccctcaacacgaatccattgcatgaaagcagcagcaaccactcctttgacctttgtgatagatcaatctactgctgaatttgtggggcgcgaatccccagtatcagcttttgtcccacccccaccaccattgcctccagaattatgtaccacgtgggacttctttgatcccattgatgctgctggtacctcttcctccaacaatgagaatgaggtaaccctgaacttcagtagattgagggatctaagagagtcaagggtagctgaagtagttccattgaaagaagttgaagaggaaatcatgtccagaaggcatacagaaatttctgatgataatacaccacctgagcaggaaagagagccaaagcaaggtgggaccggaaaaccaagtcagttggtggatacttcaaccaaagctacatctgagcaggttgctgcaaagttggaggaaagtgaaatggaaaaagaattatgtgcagaggcagaggacccttcagagttcatcactcatcgagccaaagattttgtgtcgagcatgaaggacattgaaacccggtttatgcgtgcagctgaagcaggaaatgaggtttccagaatgcttgaaaccaagaagatccgacttgacatatgtgctaaaataccaggttctccagtcaagctaccttctgcccgatttgtgtcagcacttcgagtgtgctgcaatcgtgatgttattctcaaccaggaaactgcgcagcatgtttcaaaggttgtcacatggaagcgttctgtctcatctctttcatcatcatctaagagtgcacttatgacatcgataatgaaagatgatgtggatgacagtaatagtgattttgttgaggaattcgccatggtatccggaagccattcttctacgttggacaggctacacgcatgggagagaaaactatatgatgaaatcaaggcaagtgaaaatgttaggaaggcctatgatgagaaatgtaacctactccgacgccaatttgcacgaggcctaaatgcgcaggtgattgataagactagagctgttgtgaaggatctccattccagggtatctgttgtgattcaagctgttgatgcaatctccaaaagaattgagaagataagggatgaagaactgcagccacagcttgtcgagctaattcaagggctaatcagaatgtggaaactgatgctggaatgtcaccacaaacagttcatcacgatcacattagcataccacgtgaaagactcgacctcggcgcgtcaaggtgagcaccaccatcaccgccaggcggcgatgcatctgtggaatgagatggacagcttctcctccagcttcagaaactgggtcaccgctcacaaatcgtacgtcgaggccctcaacgcgtggctccagaagtgcgtcctgcagccgccccaggaccggcgcaggcgcaaacgcaaggtctccttccctcctcggcaggctgtctcccctcccatattcatcctctgcggggactggctcgccaggacagaacctctccctgctgacgagctatgcagatccctcaaagacgtgatgcagctcctccgcggctcgttcgagcaccgcgacgagcagaacaggcccagaagcggcgagtcgcaggagtgcgggatgctggagaacagtagcgagcaggaggcggcggctaagagtgggagttgtgcagcatcagctgaagggctgcagtcgagactgacggcggttcttgaccgcctgacaaagttctcggaggcatcactgaagtgctacgaggagctcaagcagaactacgagatggcctgtgctgattataggagagttggaccaaatgctcagcttgcttaggattgatgttggctgtggtgtgtgactttttgctatctctgttctggatgacaaattctctagtgttttggtatatattttgtgaacaatcaggtgatagcacaatctttggccgaatattactgatgatttagtgctatcagttatgtaagcttcatcacttgccctgccctgatgcttcgaaaggcctatgagaaccgttttcacaacgatataacaggcaaaatataccatgattcctgtgcgcta

SEQ ID NO: 218 - DNA, 2194 bp, Brachypodium distachyon
cctttgcgcttgcggtggtgcgcattggccaacccaacccaacccagctcctcaaccaaacgcacccaccgcccggggtcgcgctcttcctctcgtgactcgtcagccagccccctccttcgccttggccctggccctggggagagaggtaacctcaccaccaccagcaccacccccttcaggacacgccacaagaagaacaccagccccaaccgtcgccggccgcatttaatccccgcatcgccaccgccaacgccgatccccgggccatgatggagacgaagccgccgtcgccggggacggcatcggccgcggcggcggcgcaccaccaccggcgctgggcggcgccgctgctcgcgtccgtactgctctcctccctcctcatctcagcctccctcttcttctcatcctcgcgggcgctgctcctctccttctcgcccctcccgtccgcggcctccgcggagccgctcttcgtcgaggccaagctgcggcagcagcagcagcagatgcggcccgacggcgtcgcgcggacgcagcgcgccgtgcccaggatcgcctacctcgtgtccggctccgcgggggacggggtcgcgctgcggcggacgctcagggcgctctaccacccggccaaccgctacgtcgtgcacctcgacctggaggcgcccgcggccgagcgcgccgagctcgccgccgccctgcgcgccgaccccgtctactcccgcttccgcaacgtcagggtcgtcacccgcgccaacctcgtcacctaccggggccccaccatggtcgccaacacgctgcacgccgcagccatcctgctgcgcgagggcggcgattgggactggttcatcaacctctccgcctccgactaccccctcgtctcccaggacgatctactgtatgtgctctctaccttgccaagggagcttaacttcattgaacacaccagtgacataggatggaaggagtatcagagggcaaaacctgtaatcgtcgacccagggctatacagtctgcagaagtcagatgttttctggattacagagaaaaggagtgtgccaaccgcgttcaagctcttcactggatcagcatggatgatgcttactcatcagtttattgaatactgcatatggggatgggacaatcttccaaggacagtcctgatgtattatgccaattttctctcttcaccagaggggtactttcacacagtcatctgcaatgtcccagagttccgcaataccacagttaaccatgatctacatttcatttcttgggacaacccaccaaagcaacatccccattacctcaccctcaatgactttgatggtatggttaacagcaatgctccctttgcaaggaagtttggaagagaagatcctgttctagacaagattgatcaggaaatattgggccgtcaacctgatggatttgtggctggcggatggatggatatgttgaatacaacagtgaaaggaaaacatttcactgtcgaacgtgtacaagatctccgcccagggcctggtgcggacaggctaaagaatcttgtcacaggcttgctcacccaggaaggttttgatgacaagcattgcttgtgaaacttccagaaagatgataggttactcggtcaaaatctgagggttgagccattagctagtcattctgctagctgaagaagcagcacatagcgtcaaatcccgcatggatggaatggtctgataggtattcttatagacaaccacttgagttgagttaccgtacagcaggagaccacggccttagcaggcagagattatacaccactaatagctcattaggttatgttagaagattatattagcccaaccataaataatattggaattttcggtttctcagcgctgagggttgtcgaaggtagtccattcttcctttagaaaccacgggactgatctacttagccaaccatcagcgcattgtattaattgtggatcctttgggcaaactggacattttggctgcgtacatgtattctttgatttgttttcctttttcccactgctgagtatacagattattttgcactgtttttctccttggtaaaaaaatatgcattctagtgtctgtgatgtgcaactatttgtggaaacttaaaaggtagatacagtattcagttgagacttgtggaaactgacttggctggtatgaaacaggtgca

SEQ ID NO: 219 - DNA, 2187 bp, Oryza sativa
tttctcaccctatatcacacaaacgaatgcagcctagattgacaatagatgaattggagctagtagtgggctatactattatcggcatgttgtgaggaaaggcgtattttcgtgaatcccgtgtttattcagggggtaacgcagagcaaaacagacgccacgcgtcatgtggtgattggtcctggctacgtgtcccgtttccgtcccagttaacttgtgtacgcgaatgaatgagaaaatttgagtctaatttagcaggcagaactaagagagcacggcggcggcggcggcgatggcgcggtggccgtggaggtggagggtgctgctgccgctgcttctccttcactcctcccccgtcttcgcgcaagaaggccaagataatgatccctctactttgttcaaacgagcctcagaaatgatgaacctaaggaaatatgatggatcacttggtctgctaaatgctgtgttggaggttgacccaaatcactcagaagcttacaggcagcgtgcatctgtgcttcgtcacaagtgcaggtacaaggaagcggagggtgactatagcaaatacctggagctaaaacctgggagttcttctgtggaaaaggaattatctcaactgcttcaggctcaaaatgcattagagtctgcttatggccaatttgaatctcatgacttctcaaaagtcctggagtacatcaacaaaattgtgcttgttttttctccaaactgcttaaaggcgaagcttctcaaggctaaagcattgctagcacttgaagactactcaagtgttatctcagaaacaggatttattctgaaggaagatgaagataacctggatgccttgttgcttcgtggccgagcatattactacctcgctgatcatgatgttgcatccaggcactaccagaaaggccttcgtctagaccctgaacattcagaactgaagaaagcatattttgggttgaaaaatcttctgaagaagactaagagtgctgaagataatgctgccaagggtaagctacgtgtgtctgctgaggactacaaggcagccctagcaatggatccagatcatacttcttacaatgtacatctttatcttgggctatgtaaggttctggttaaactcggaagaggcaaggaggctatcagtagctgtacagaagcactcaacatagatggagaacttgttgatgcattaacacagagaggtgaagctaagcttcttacagaagactgggaaggagcggttcaggatctaaaagaagcttcccagaaatctccccaggacatgggaatccgagaagcactaatgagagctgaaaagcagcttaagttaagcaaaagaaaagattggtataagatccttggcatttcaaagacggcatcagctgcagatattaagcgtgcctacaagaagttggcactgcagtggcatccagataaaaatgtagataaccgagaagaagcagaaaacatgtttcgagaaattgctgcagcttatgaggttcttggggatgaagataaacgtgtaagatacgaccgaggagaggatcttgatgagatgaatatgggaggaggaggtggtggtttcaatccttttgggggaggtggtcagcaatacacattccattacgatggtggattctatggaggaggaggattccccgggggcggctttcctggaggatttcagttcaactttggatagaaagttactgtctgtggagttggagtttgtatgtttgtttgttttaggaacgctgataagcttaacaacaggtattgattgtaggcagtcaggccgaccgaccgatcgatcaagatgagaatcgtatacaagtgttgtttaagcaccatcaaattttccttaagttgtatccttccttgggattttctgacgcatatgatccaatcgaaataaactgagccttactgtggagctagctgtttcactttcactagccaaggatttgcgccgaaaccataaaaaccgaaggtccattccatgtattgtgatcggagtcggcacgcaacagaaaaactaacccaaaaaaaaaacttagatcctctgaagaaacatactgaaccactcgctggaccgtctagccatcagtcaaccatgagcgtcatgtctaacaatctccatgttaactgtaacatctggctagctaactttctctgttttat

SEQ ID NO: 220 - DNA, 1389 bp, Hordeum vulgare
caaaccctaaccacagccgccaccccaccaaatcacccgtctcgcacggcaacccaccagagagagagagagagagaaagcgcggatctgcgcgatggcgacgctccagcaccagaaccagggggcggcggcgccgatgaccacgaccggcggcggcctgcgcgccatggacctctacgagaagctggagaaggtcggggagggcacctacgggaaggtgtacaaggcccgggagaaggcgacgggccggatcgtggcgctcaagaagacgcgcctcccggaggacgacgagggtgtgccccccacggcgctcagggaggtctcgctgctgcggatgctgtcgcaggacccgcacgtcgtgcgcctgctcgaccttaagcagggccagaacaaggagggccagaccatcctctacctcgtcttcgagtacatggacaccgacctcaagaagttcatccgcggccaccgccagaaccaccagaagatccctgcccacaccgtcaagatcctgatgtaccagctctgcaagggcgtggctttctgccacggacgcggtgtcctgcaccgtgacctcaagccgcacaacctgctcatggaccgcaagaccatggctctcaagatcgccgatcttgggctcagtcgtgccttcacggttcctctcaagaagtacacgcacgagatccttactctgtggtacagagctcctgaggtccttcttggcgccacacactactccacgcccgttgacatgtggtctgtgggctgcatatttgctgaattgatcactaccacggcacttttccctggagactctgaggtgcagcagctcctgcacattttccagttgttgggcactccaaatgaggaggtctggccaggagtaggcaagctccccaactggcatgagtaccctcagtggaacgtctcaaagctgtcttctgtaattcccagtctcgatgccgttggtattgatctgcttgagaaaatgctgcagtatgagccggcaaagcggatctctgcaaagaaggccatggagcacccatacttcgatgatgtggacaaggcgctgtactgaagctgtcttggtggctaacaagaagcggatttcttgtgatttgtgcttgtcctgaagcatatcttttgcttccaggacaggcatttttacctctgttattccagctgccatttagtttgcaccactgactgatggttgtgatggatagtggctatggaactatgcataattaaacccctcttgtcaggtgtcaaacactggtcttgtgaagcactgcttctgcttctgcttcaaaatcaggctttatactgtatgccattcatttctgtttctgatggaaaacttgataaatataaaagacttctgagacttgg

SEQ ID NO: 221 - DNA, 948 bp, Hordeum vulgare
cctgattcccctctgctccctctccggctcccccgatctgaactcgccgccgcctacctccggggtccgtgcctcgccggcccctcgccgtcgccacctccctcttgtccacgtgccccgccccgccgcccccttccccacgcgctgcttccgcgcctgcgcactccgccgcacccagccgcccagtcctctccgcggcggtgtgcaggcgtgagcgagtgaggcgtgcaccacgccctgcactacctaagcagccatcctgcagccaccagctacacatccatccctcccgccgcccctcgactgaacgcagcacacaggtagaccaccctctttaaaattcctaggttcggctaccggagagcacaactgtgcccgcgcgagatgggaatggaggaggcagctgcggggggtgccgcgaggcaggcgaaggagtcgctggagctggcgttccagatgtcccagatcctggacaccggcctcgaccgccacaccctctcgctgctcatggcgctctgcgaccgcggcgccaacccggaggcccttgctgccctcgtccgtgagctctcctccgccgctcccccaacacccgccacccccaccgcgcccgcctccaacgcggcggcagccccgactgctccctcgctgttcccctccggctttcgccagctctaggctagggttcgtgtcctcgaccccttcttctttttcctcccagatgacaccgcttgtcacttggatgcgttgtatgtgtgcacttaggccttccattctgtaggctgaaactggtttgtggtttgtattctcaagattggtaatgcaaggggagctgtgtcaaactctgttacactctagcaaatgattttctcttctgttggctaaaactgattcctggtttgtatcctcaagattgataatgcaatgaagtctgtgtcaaattatgttatc

SEQ ID NO: 222 - DNA, 1436 bp, Zea mays
gaggacatatccggtgcaatcactcattttggtgcaagcgtacaatcaaactatccagagcatccaatctagatccaacggtttcatacggaagtggttaaatgtaaaatagacactaggttttaggtggaaggggttaaatgtaaaataacagttaccattaaatctaaatcggatgcaccagatcgcttgattgcatgcttgcactaggataagtgattgcataggatattttctcactaaggttgagacatattttttagcgaatacaacttgagggatgagattgccgatgattgtcacttgactgggagtctggatctcaagcaaccagccccaagaactgttctgctccccagttgtatatacgatcgaagaaaaaaaaaagatcccaaaccctagcatctctcatggacgacggcgacggcggactgagcttcgacttcgagggcggcctcgactctgccccggcggccgggggccccgtgccgtcctccactgaccctggcgcgggaggcggcgacgggccgggtatgcacgggcgcggccgaggtcgcgggagctaccgccagacggtgtgccgccactggcttcggggcctatgcatgaagggcgaggcgtgcgggttcctgcaccagttcgacaaggcccgcatgcccgtctgccgtttcttccgcgacttcggcgagtgccgcgagcccgactgcgcgtacaagcactcgtacgacgacgtcaaggagtgcaacatgtacaagatggggttttgtcccaatggtcctaattgccggtacaagcatatcaagctacctgggccaccgccttctgttgaggaagttcttcagaagattttgcagatgcgctcttttaacagatacagtcagaatagaaatagtaattataatcagcaaggggagaggccacaacatccacagggttctgcgttgcctaaccaaaactcagcagaaaatgctactgctgcagctccaccagctggtggacaacaagcacaaacgctgaatcaacagccaccacagcagcagcagaagccaaatacaaatgaccaggcccaaggtgtttcaaatggccatcaggccactagaatcgccacaccccttccacaaggaccatctaggtgtgtgtggagtttctagtcatgcttgtaaagcttttagaactgtgaaaactacatacatagttttggttgcaatagcgtatctcataaaactactatattatattatatgttttgacacttgataagctgtacacttgtacttaattttaagcttatgtcatctataactaattgaaagaaaaaagttcgtagtcatgttgctctttggattacaaagctaggttatatgttaggtagttgaggttggttccacaatattcagctcttcaatagaagcctttgtaatgatagttactgctaa

SEQ ID NO: 223 - DNA, 2613 bp, Sorghum bicolor
ctctcctccggcctcctcgcgattgcggcgacgagtcggcgagagagagagagagagagctgccccgcaagaaaaaaaacggataagagagggagaagttgacagcgagggggagacggaggaccaggagcggcgtcgagctaaaagcgccggcggcggtcatggccaccgcggaccggacccggtctttcatgaaggatgttaaacgcgtcatcatcaaggtgggcactgcagttgtcacgaggcatgatgggcgactagctctgggtagattaggggctctttgtgagcaggtgaaggagctgaacgccctaggatacgaggtgatcattgtgacctcaggtgctgttggtgtggggaagcagaggcttaagtacaggaagcttgtcaatagcagctttgctgatctgcaaaagccacagatggagctggatggaaaggcctgtgctgccgttggacagagtggcctcatggctctttacgatatgctatttactcaacttgatgtatcctcttcccagcttcttgtgacagacagtgattttgagaatccaaacttccgggagaggctccgtgaaactgttgagtcactattagatcttaaagttgtaccaatatttaatgagaatgatgccatcagcactagaaaggctccatatgaggattcatctggtatattttgggataacgatagtttagccggtcttctggctatagaactcaaagcagatcttcttgttctactcagtgacgtggatggcctctatagtggtccaccaagtgaacctcaatcaaagataatacatacctacatcaaagaaaaacatcacaatgaaattacttttggggataagtcacgtgtaggtagaggaggaatgacagctaaagtgaaggctgctttcgtggcttcaaacagtggcacacctgttgttattacaagtggatttgcgtctcagagcattgttagagttctccaaggagagaaaattggtactctctttcataaggatgcaagtttgtgggaaccatccaaagatgttagtgctcgtgagatggcccttggtgcaagggagtcttcaaggcgtttgcagaatttgtcatctgatgagcgcaagaaaatattgttggacgttgcagatgccttggaagagaatgtggatttaattagaactgagaatgaaatagatgtatctgcagcacaagaggcaggatatgaaccatctttggttgcgagattgactttgaagccaggaaagatagcaagccttgcgaaatccattcgcactcttgcatatatggaagacccaatcaatcagataattaaaagaacagaggttgctgaagatctggttctcgaaaaaacatcttgtcctctaggtgtgctattgatcgtttttgagtccaggcctgatgccttggtccagattgcgtctttagcaatccgaagtggcaacggtcttctcctgaaaggtggaaaagaagccatgaggtcaaacacaatactgcataaggttataactagtgcaattcctagcaacgtgggtgaaaaacttattggccttgttacaagtagagatgaaatcgctgatttactaaagcttgatgatgtgattgatcttgtcattccaagaggcagcaataagctggtgtcgcaaatcaagtcatcaactaagatccctgtccttggtcatgctgatggtatctgtcatgtatacatcgacaaatcagctgacatgaatatggcaaaacgaatagtgctggacgctaaaattgattacccagcagcctgcaatgctatggagacattgcttgttcataaagatctcataaatgctccaggtcttgatgacctactgctagcactcaaaacagaaggagttgctatttatggagggcctgttgcacatgaactattgtgcattccaaaagcagattcattacatcatgaatatagctctatggcctgcacaattgaattcgttgatgatgtacagtcagcaattgaccatatacatcgttacggaagtgcacatacagattgcattgttactacagatgataaagtagcagaaacttttttgcgtcaagttgatagtgctgctgtattttataatgcgagcacacgattctctgatggggctcgttttggattgggtgctgaggttggcataagcacagggcgcatacatgctcgcggacctgtgggtgttgaaggtctcttaacaacacgctggatcatgcgagggagtgggcaagtggtgaacggtgacaaggatattgcatacacccataagaaccttcctttgcaatgagggcatttttgtgcttaatcaggattcgtgtcgatccagtgatgtatgatagtttcatcagataggagcagagaatggtgaatcttttcgattgaggactgtgaatccatggactgcaatgttcagtcagtgtgtagaccatcattctggtggttcattctgtatgagcttggaggccaccctccctaataaagcagtgctgggagtcagggcactgatgtaccgtgtaccgagggtgtctaggttaaacaagataaaccggttatattcttatatttattttctttttttggtgcgatcg

SEQ ID NO: 224 - DNA, 2182 bp, Sorghum bicolor
ctctcttttcccctccctttcccggcacggggagcgacctccgccgccgccgccatgccgaagcactaccgccctgcgggtaagaagaaggaggggaatgcggcaaagtacatcacgaggaccaaggcggtcaactacctgcaagttagcctcgcaatcttcaggaagctatgcattctaaagggtgtctttccgcggcagccaaagaagaaggtggaagggaaccacaagacctactaccacacgaaggatattgcattccttgctcatgaccctttgatcgagaagttcagggagattaaggtccatcgaaggaaggttaaaaaggctgttgctaagaaaaacagggatctcgcagacaggctgttgaatcggccaccaacttacaaacttgataggcttgtccttgaaaggtatccaacatttgttgatgctcttcgtgacttggatgactgccttacaatggtgcatctgtttgcggcattacctgctgttgatggtgaacgcgttgaagtcaaacgaattcataactgccgcaggttaagccatgaatggcaagcatacatatcccgaactcattccctgaggaagacatttatttccgtcaagggcatatatttccaggctgaagttcaaggacaaaagatcacctggctaacccctcatgctcttcagcaagtattaaccgatgatgttgatttcaatgtgatgctctcttttctagaattctatgagactcttttaggatttgtgaacttcaagctctatcattcaataaatgtaaattatcctcctattctggatccacgtctggaagctttagctgctgagctctatgcattgtgccgatacatgtctgctggttccagaagaatgattgggaattcacaatctgacgaagtaatggaggataaggatgagaagagtaaagctgatggaataactgaggaagagaaggatgtgaagaataaagcaagctcaaaagcagatgaatctgagctcagattagcacagcttcaacatcagctcccaactaatgaacctggtgcactgatgaatcttgtagaagaatcaactgctgatgatgcagatgatgacgatactaaagaatgtaaaggtttatttaagaacttaaagttctacctgagtcgggaggtgcctagggagtctctattatttattatcccagcatttggagggactgtttcatgggaaggagaaggagctccatttaaagaagtagatgaagatatcacccaccagattgttgataggccgacacaaagccatgttttcctctccagggagtatgttcaaccgcagtgggtctttgattgtgtaaacgctcgtatcatattgccaacagaaggttatcttgttggaagagtacctccaccacatttgtctccttttgtggacaatgatgcagagggctacattcctgagtatgcagaaacaataaagaggctgcaagctgctgctcgcaatgaggtcttgcctcttcctggtattggtgatgaagatctagacaattcattggtagcagcaatgatggatcgaacagaatctaacgaagctgctgaaaagaagaggaagttggagatgctagagaagcaataccatgatgaactgaagatggaaattgacggtgttgctttctctagtctgtcaaataaggaagcaaataaatcaccagatgccaaagatgatactcagtcagatcacgaggcggatgccattaaacaagaggagaaggatgatgatgacattggtactgctctcatgtctcgcaagcagcaaggcctttataaagctatgaagatgggcaaagaaaagaaaaaagagaaaattgagctacttaagaagaggaaaaagaatgcggattctagtgcttcttccaagaagcggcactgatgctcagagttcgcttcatagcattggtgtggcatctctagtagaatgttgccatgatcatcttcgtgccaagtccctgttatgagtggttgtattttgatatctctcctatgtatgctgaagatgagcttaaggaatatgtaccaggaaacttgaattggaaaagttttgatccgtcgttattattgtgtatcaggaaacttgaacagataaattttgatctcctatgtattaagcatttagagtcgttattattatttttgcctgg

SEQ ID NO: 225 - DNA, 1868 bp, Glycine max
agtagcagagaaaagaatagggttttgctatggagaagctagaagcagagaacgttctggtccttccctctgagcaacccaacaacaataggccaaagccaaaaccaaagcgtttcgtgaaaaaccaaatcccagactcaatccttaacaaccctcttctgagcgccgcaatctctgtgctcccttccaactacaacttcgaggtccacaagtgcgtctggcgcgtgctctccacgggagcaaaacgcgtggctctccagttcccggagggtctcctcatgtactctctcccactctccgacatcttcaccaccttcgccggcgtcacccactgcttcgtcctcgccgacgtcacctacggcgcttgctgcgtcgacgaccttgctgcctccgccctcggcgccgacctcctcatccactacggccacagctgcctcgtccccatcgacgccaccacaatcccctgcctctacgtcttcgtcgacatcaaaatcgacgtccctcacttcgtcgacaccctcagcttaaacctcctcgcccaaaccaaaaccctcgtcgtcgctggaaccattcaattcgcctccgcaattcgcgccgccaagccccaattggaggagttaggatttagggttttgattcctcagtccaagccgctctccgcaggtgaggttctgggctgcaccgcgcccaaggtatcatcgtcgaaattgctcggtggtggtggtgacattggtgaatgtgttttggttttcgtggcggatggaaggtttcacttggaggcgttcatgattgcgaatccggggattagggcattcaggtatgacccttacatggggaagttgtttttggaggaatatgatcatttgggtatgaagaggtctaggaaaaatgcgatttttaaagccagggaggctcggagttggggtctggttttggggacgctggggaggcaagggaatccgaggattttggagaggttggagaggatgatgagggagagaggcttggattatactgtggttttgatgtcggagatgagtcctacaaggattgcgctctttgaggattccctggatgcttggatacagattgcgtgtccgaggttgtccatcgactggggggaggcttttgtgaaaccggtgcttactccttttgaggctgaggttgcgctcggagtgatacccgggtggtgggagaagaatgaggtttgtgaagagggtgagggttgttgcaacaagagtgggtcttgttgtgaggatgcaaagggaggggaagattttggtggggattatccgatggattactatgctcaagatggtggggagtggaattcatcttatgtgaaaaagtctactcgtcctgccagaagagtttccgtgtcgtctgttgctgatactgccatttcccaacagccttagatttgctgcttagttacaagtccaaggttttaaaagacagtcttgaacatgacttcagccacaacgttaagatttgtgttgtggctgcattggctgtatttctctgtgatttctcgcagtatcaatgatagcaactggaaatttaaaacatttgttataacaatttttttctctgaaaggatagagtctatatagtctattgttttcttttgtttttagctttgtcttatttaggataaattatgttggatgagtgtttgggtgagaaaacatgttgaagtgttcttttctttggtctgatatgggagcgaagaagatagaatgtgataagctcagtttctgtttcaatttggttgacgtagccaccaagcttttctggtgatcaattgatttgggccttctttggtgacacgtcggtaaccactacccttgcatggaatccatgttaat

SEQ ID NO: 226 - DNA, 1196 bp, Brassica juncea
gtctctttctccgggaaatggagcttaccatctgaggaaactcatcaagcttttttgcaggtgatcctgatccaaattacgatgggatcaacgttccgtgatcgcacggcggagtttcgttcactctaccaaacgttgaagaagatcggagcgatcccgtccgtccatcaacccgaaagcgatccgacaacatcctccaaacggtcgccgccgggatcttcaagatccgagttcaacaagaaggcttcccagatcggtctgcgtatccacgagacgtctcagaagaccgcgaggctcgctaaattggcgaaagaatcgtcaattttcaacgaccgtactctggagatacaggagctaactgtgttgatcaggaacgatatcacggggctgaacatggctctctctgatctgcagacccttcagaacatggagatcgctgatgggagctattcgcatgacaaggtcggtcactacactgcggtttgtgatgacttgaaaaccaggctcatgggagctacaaagcagtttcaagacgttctaaccgcgagatcagagaacatgaaggctcatgaaaaccggaaacaactcttttccgcaaaaaatgcaggagtagataagcagaataatgcaaaagctgtacctgagcctcctccttggtcaagttcatcgactccttccgggaatttacaacagccactattgccgccagtaaatagtggagcttcttcaggtagccagcttagacgcagatctgctatcgagaatgctccatcgcagcaaatggagatgtccatgttacagcaaacagtcccaaggcaggagaactatagccagaaccgagctgttgcgcttcacagtgtggaatcaacgataacagagctcagtggaatattcacgcatctagctacgatggttactcaacagggagagctagctatcagaatcgatgacaatatggatgaatcgttagttaacgtagagggagcacgcagcgctcttctgcagcatctcactcgaatttcatcaaatagatggctcatgatcaagatcttcgctgttatcatattgttcctcattgttttcctattctttgtggcttgaaacaatacctttatatcttgttgcatcaaattccagaggtaaaagtaaaacttccatctatacacaggttaagttcaaaaaagatttaaattttt

SEQ ID NO: 227 - DNA, 901 bp, Phaseolus vulgaris
acttcctttcttcaatttctctcatcgcaataaaccagttgcaatttctagggaagaacagaagcaagaaacccaaaagcgagcgagttgtcactcagcgagttccgagttacaagttagaaatggcgagcgcgtttcggagcgtgaaggtgcttccgaactcggcgagtatggaggaggcgcgtcagcgcgtgttcaatttcttcagagaagcgtgccgttctctaccctccgtcatggaaatctacaacatatacgacgttacttctgtcgcccatctccgttccaccatagcctccgagatccgcaagaacatccacgtcagcgatcccaaagtgattgatatgctgcttttcaaagggatggaagagctgaaaaacgttgtggaccattcaaagcagaggcatcatatcattggtcagtacgtagttggtcagcacgagcaagtgccggattcagcctcaaaagacccggccatctctccctttctgaagaatttctacagcagcaattacttttgaaacttggtcatgagctgttctgtttcctcaaataaagagttatcttaaaatgtttttgtatgtccatactggatgagataatgcttttggttttggatcaaactactgcattcattcttcctggcttaagttaagaaagtgatgtttttctgattgtcgtgcatgcttgcacactgctgaaaatattgtgacgtataagtctattttacctcatttcattttacatcattccagattaatacactgggtagcatgttagagaaataatattgtattttgtgtaataattccatgatgttaggtcactacagtacacaggtgctaatgattttttatggagcatcctgtcattgcatttccattaattgtcttttactgtt

SEQ ID NO: 228 - DNA, 1691 bp, Glycine max
cggcggtgtaagagacagagatatagagtaaacaaaaacgaaaggcaaagtgagtacgagaaatggcatgtcgctctgttctttcatcttctcctcacataacgaactccatggccatcaaggagggtgtcctctccttcgcacccaaccctcctctgcttcttcgtctcccgaaagccgttacctttctctccttttctgcttccactaaaccccccactaagtcttttcaagtgagatcagttgctggtactacagaagctgcatcggggtttgatgagatgatttctgggactaagaggaagtattacatgcttggtgggaaagggggagtagggaagacaagttgtgctgcttcgcttgctgttaaatttgccaataatggacaccccactctcgtggtttccaccgatccagcgcattctttgagtgattcttttgctcaggatttgactgggggtgcattggtgccagtggaaggacctgattatccactttttgctcttgaaattaaccctgagaagtttagggaagagtttcaaaatgccgcccagaaaaagggtggaaccggagtcaaagacttcatggatggcatgggccttggaatgattgcagatcagttgggagaactaaaactgggagaattactggattcacctcctcctggactggatgaagctattgcgatctccaaggttatacaatttctcgaatcacaggaatatagcatgtttactcgaatagtatttgatacagcacctacgggtcacacattacgattattgtccttacccgatttcttggatgcatccattgggaagatactgaagctaagacaaaagatagcttctgctacctcagcaattaaatccgtatttgggcaagaagaaacccgacagaatgctgctgataaattggagaaactcagggagaggatgataaaagtgcgtgaactctttcgtgatactgattcaaccgaatttgtcattgttacaatccccacggtgatggcagttagtgaatcatctagattgagtgcttccttgaagaaggaaaatgttcctgtgaagagacttattgtcaaccagattcttccaccgtctacatctgattgcaagttttgtgctatgaaaagaaaggatcaaatgcgtgctcttgatatagttcagaatgatccagaactctccagtttatcaatgatccaggcaccactcgtagatgttgagataagaggtgttccagctctcaaatttcttggtgacattatttggaaatgatttacacagttactcaagcaatgattagttgaaaccatagacacatggcatgatatcagggctcatcagattttgtatgatgaagttttggagcacttgagatgttcagattctggtactggcagttcttaaagagacactggcttccaatattcacacgctagagtttcaaaacaccagaaagcttttttggtttttcacattataaatattgttattgtaaatttatttctccagtaattgtatctgcactttttattttttttgttctaatccccttatttaagccttttttttttgttgggggctgtaatggtctttatgttttgaagtgttgactgagatattcttgacgcacacatgaaacatataagaaaagttatatttcaaatgttgattatcatcaacaaatat

SEQ ID NO: 229 - DNA, 1463 bp, Medicago truncatula
acattttgcattagtatccctctgcgcaaccaccaccgtcttccttccgagtgtcgaccaccatcaccggtcgaattacaaaccttcattttcaccggcgaacatctcagctcggtactccaccgaagagcaggtacagaaaagctatggacgagaatgatgtatcaaatgaagtagtgaaagggaagaagaaagggaagcacgataaaccaaaaccatgggatgacgatcctaacatcgaccactggaaggttgagaaattcgatccatcatggaacgaaagtggaatgcttgaagtcagttccttctccaccctctttcctcaatatcgtgaaaaatatcttcaagaagcttggccacttgttaaatcctccctcaaagaattcggtatctctgctgaactcaacttggttgagggttcaatgacagtttcaacaaccagaaagactaaggatccttatattattgttaaagctagggatcttatcagacttctttctcgaagtgttcctgctccacaggcaataaaagtacttgacgatgaaatgcaatgcgacatcattaaaattagtgggttggttcgcaacaaggaacgatttgtaaaaagaaggcaacatcttgtgggtcccaattcttccaccttgaaggctcttgaaatactcacaggttgttacattctcgtccagggaaacacggtttctgtaatgggttcatacaaaggtttgaagcaagttagaaggattgttgaggaatgcatgctgaataaaatgcaccctgtctacaacattaagattcttatgatgaagaaggaacttgaaaaagaccccgcacttgcccaagagaactgggataggtttctcccaaagtttaacaagaaaaatgtaaagcaaaagaaggttaacgctaaaccgaagaagccgtatactcctttccctcctcctcaacagcctagcaaggttgatatacaattggaaactggggagtactttttgagtgacaaaaagaaatcggcaaagaaatggcaagagaggcaggtgcagcaagcagaaaaaactgctgaaaacaaaagaaaacgagacgagtcctttgtcccacccaaggaacctgcaaatctggtgggtaactctgaggatgctagtaataatgtagctgaaatggcaatgtccttaaaggaaaaagctaggaagtttggcaagcgcaaatcggaagaaaatataaatgccgagacatatattatggggtcatcagaccaaccatcaaaaaagaaatctaagaagcaaaagtcttgagtgtgttcttcattttagagatggaatatgtgcacatgtgatgtgaatttaatccataaattttgatccaatatctgtagtctgtaacatgttacttctggtccttatacaattttcccttcagaatcaatgtcgcacacttgggtatatccaatgtcttcttgagtaacttat

SEQ ID NO: 230 - DNA, 2570 bp, Medicago truncatula
acacaacactattagcattctcattttttttcgcgctcctttcatcttctcttccaaaatctcattttctcttcttcggtttgaaaaatggatcccaagaacaatgtgaagaacgacgatcctccagcggaatcaccaacgtcagttcttgaagaagaggaagtggaggtgaaatcggaggaagaggtgattgcggatgatgggtcatcgcttgtaccgaaaacaatggcggaggaagaagagaagttgctgaaagttcgtgtaaaggaagaagaggaaaagattgaagttgcgccgaatctgaatgattcacagtttaataagttggatgagcttttgacacagactaaactctactcagagtttcttttggagaaaatggatgatattacaatggctgcgggtgaacaagagaaaccggatgaagaagagagtaaaccagttgctaaaaagaagggccgtggatcaaaaagaaaggcagcttcacaatgcaacactggaaaagccaaaaaggcagttgaagccatgattacaagatctaaagaaaatgtgaagactgaagatgtggatttgactgaggaagaaagaactgagaaagagcagagggagctgatgcctttactaactggtggaaaattgaaatcttatcaactgaagggtgttaagtggctgatttccttgtggcaaaatggattgaatgggattcttgctgatcaaatgggtcttgggaagacaatccaaacaattgggtttctttctcatctaaaatcgaaaggattggatgggccatatatgataattgctcctctatcaaccctctccaattggatgaatgagattaataggtttacaccaacgctccctgctgttatctaccatggtaacaaacatcagagagatgaaatcagaaggaaacatatgcccagaacagttggtccaaaattccctctagtaataacttcttatgagattgctatgaatgatgctaagaagtgtttaaggtcatacagttggaagtatcttgctgttgatgagggacacaggctgaaaaacgcaaactgcaaattagtgaggatgttgaaatacatcagtgttgaaaataagcttcttttgactggtacaccactccagaataacttggctgagctatggtcactgctgcacttcatcttacctgatatattctcatctcttgaagaatttgagtcatggtttaacctgtcaggaaagtgcactactggagcaacaatggaagagttggaagagaaaagaagaacccaagttgtggccaagcttcattcaattcttaggccatttctgttgcgtaggatgaaatctgatgttgagctaatgttgccacggaaaaaagagatcattatttatgccaacatgactgagcatcagaagaacttgcaggatcatttaattaatgagacattggggaaatatttggataagaaacgatcaattggacgtgctccaacgagtcttaataatttggtaattcagcttaggaaagtctgtaaccatcctgatctcttggaatcagtctttgatggttcatatttttatcctcctgtgaatgagataattgaaaaatgtggaaaatttcaattgctcgaccgattgctggagcggctatttgcacggaatcacaaggttctgatcttcagtcagtggaccaaagtgctagatataatggattattactttagtgaaaagggtttcgaagtttgcaggattgatggttcggtgaagctggatgataggaaacggcagatccaggacttcaatgatacaaccagcaactgcagaatctttcttctttccaccagggctggtgggttgggaataaacctcactgcagccgacacttgtattctttatgacagtgactggaatcctcaaatggatttacaggccatggatagatgtcacagaatcggtcaaacaaagcctgttcatgtttacaggctcgctactgcacaatcagtagagggtcggatgttgaaaagagctttcagcaagttgaagcttgagcatgtggtgatagagaaaggacagtttcatcaggagcgcacaaagccttccattatggatgaaatggaggaagaggatgttttggcattgcttcgagatgaagaaaccgctgaggacaaaatgatacagaaagatattagtgatgaagacctggagaagctcttggatcgcagcgatcttgttatcaatagctcaactgatgataaagctgcagttagtaccttttctcttaaagggcctggatgggaggtggtgatgccaactgcggcagggggcatgctttccactcttaacagctaatttcccaatctgcaatagaaatttttgagggctgaatattttcaaaaaaattgccttttgtggtttgagatgtaattgactttttaattttgagacaatctcagccagtgatgtcaattgtcagaggtaatgtcctggagggcattcatttttgtaaagcctactaacggaactagatgtagaaatgaagcaacttagtggtcatgttattttttttggaaccattcaca

SEQ ID NO: 231 - DNA, 2265 bp, Medicago truncatula
catatccctgtcttcttccattaaaatcccacaaaaccaaaaccctttcacctcccaatgcctcttttcttcagttcatagaaagtttcttcctttctccttttccctcacttcctaaacacacccccttaaccttcaacacacccccataactcaaaacttcaataagccaaacaaaatgataagtgctttagacttataccatgtcctcacagcagtagtaccactctatgtagcaatgatccttgcctatggttctgtaaaatggtggaaaatcttcacaccagatcaatgttcaggcataaaccgttttgtagcactttttgcagttccacttctctcattccacttcatctcaaccaacaatccttacactatgaactacaggttcatagcagctgattcacttcaaaaaactatcatcctaacactccttttcatttggtcaagaacaagctccagagggtcattagaatggtctataacactgttctcactttcaacacttcctaacacacttgttatgggcattcctttgttgaaaggaatgtatggtgatgattctggtacccttatggttcaaatagttgttcttcaatgtatcatttggtatacattgatgttgtttttgtttgagtataggggtgctaggattctcattgttgaacagtttcctgatactgctggttctattatatcattcaaagttgattctgatgttctttctttggatggtaaagagccacttcaaactgaagctgaagttggtgaagatggtaaacttcatgtgaaagttagaaaatcaactagttcaagaagtgagattttttctagaaggtctcatggtgttaactctggtgtttctttgacaccaagaccttctaatttgactaatgctgagatttattctcttcaatcttctagaaatcctacaccaagagggtctagttttaatcatactgatttttattctatggtgaataatggaagaaatgttagtcctagacaatctaactttggaagtttaggttttgatgaggaaagtggtgttgctaaagctaatggaaatggtggaaatggctaccctgctcctcatagtgcagggattttttcacctgtggctaataagaaaaagggtcatggtggtggtgctggtgatggtggaaaagatcttcatatgtttgtttggagttcaagtgcttcacctgtttctgaaggtggaatccatgtctttagaggtggtggtgattatggaaatgatcagcttaatggagtagctcaccaaaaagattatgaagaatttggtcatgatgagtttagctttggaaatagaactgttgctaatggtgtggacaaagaaggaccagtgctatccaaacttggttcaagctcaactactgagcttcatcctaaagctggatctcaaggtgaagctaagccaacaaacatgccacctgctagtgttatgacaagactcattttgattatggtgtggaggaaattgattaggaatcctaatacttattccagccttattggtcttacctggtccctggtctcattcaggtggaatgttgttatgcctgctattgttgctaaatcgattgcaattttatctgatgctggccttggaatggctatgtttagccttgggttgttcatggcattgcaaccaaggattattgcttgtggaaacaccgttgcttctttcgcgatggcggttcgcttccttaccggccctgctgtcatggctttttcttcatttgttgtaggactcaggggagttctgttgcacattgctattgtacaggctgctcttccccaaggaatagtcccttttgtgtttgccaaggaatacaatgttcatcctgacattcttagcactggggttatatttggaatgctaattgctcttcctatcacattagtttactacattttattgggactttgaagcaaatatttgaggacttgaaagaaagaatgaagactaatttcagtggattaggctctcttacatatatataactactccattttagtgtttttttttttttttgggctattatctaacaatgtagaaatttggcagttggtaagatttgcaaatgggaagacatgtaattttagggcaatagctagttaggtagtagaaggagaaaaaaaaagttggtaatgttttttttaagcctttttttgactgtgaacccaacttttgcatattttgcttggattaatgaaaaaagaggaaagtgaaggttgttt

SEQ ID NO: 232 - DNA, 3562 bp, Oryza sativa
tcttcctcctccgagctcaagctaaaccctaaacccccgcacgctctcgccttcccgccgccggcggccacctcgaatccaaccatggccgccgccatcgccgccgcagccgatgactccatcgtctacaagctctccgctctcctcgaggaggtgcggccgagcgccgccgcactccgcgccgcgagcgaggccgcggatgccgtcgcgggcctcgtcaagaggatcccgacgcagcaggcgactcacgaggctgtcgctgggttcgtgagggacctggggctcgcgggggagaagctcgcgttcacgttccggccgccggaggtcgttcgggtcgctgggagccacgcggccggcggcgccgtcgcgaggcccgacgtctccgctgacctcctcgtgcgcttgcctaaggaatgcttccatgaaaaagattttctaaaccacagataccatgcaaagaggtgtctttacctccatgtcattgagaaaagcttgaggtcttctccattaattcagaagatttcatggtctaccttcctagacgaggcacggaaacctatccttcattactttactgttgcagcaaaagaaatcgcagaacttcctgggttctatgtcaggataataccaactgcaagctttttgttcaatgtttcaaagatgaatttatcaacaagaaacaatgttcgtgcatacacaaaagatggcataaacctgcccacaccaaagtacaattgtagcatattggaggatatgttcttggaggaaaatgtagaatttatcagcagttcagttgcagattggaaagccttgcaagaggcattggttttgctaaaagtttgggcacgtcagagaacttcaatatatacacatgattgcctcaatggatacttaatatctgccatccttgtgttccttactgtggactcggcaggaagcatgattaatagatcaatgacatcgagacaaatttttcgcgttgtgatgaagttcttggcaacttcgaagatgtggacgaagggcttggtgattcagccaactaagaagcgtacaatcaccaaagaggatatggtttgtttcctgaaaacatttgatgttgtcatctgtgatgtatctggacatgtaaacttggcatctcgaatgacgaagtcagcattcatagagcttcaagatgaggcagcttgtgcgcttaattgccttgataaatgcaaagatggtggatttgaagagctttttatgaccaaggttgatttaggtgctaaattcgattcatgcttgaggataaacttgaagggaaacttgaaaattactacatcaagcttttgcttggatgatttggcttggagaaaacttgagaaggatgtccagtctttgctgcaacaaggtcttacagatagaacaaagatgatccgtgtcctgtggagaagcacaccttctgaatggaatataatggatggtttttcagaatttggtagcagtcctctgcttgttggcataatgcttagctcgttggagaagagtttccgtctagttgatattggtccaaaccctgagaatcgagatgaggctatcaaatttaggaaattttggggagagaaagctgaacttaggagatttaaagatggaactattgctgaaagcacagtgtgggaatctgaatcttgggagaagcacacgattatcaaaaaaattgctgatcatgtgcttaccaagcatttgtcgttgcagaaggaagacttgattcatgttgttgatcagttagacttttgcctcctggttggtggccaagatccggtctcgtcgtctggagctttgttcgaagcctttgattctttagcgaagaaattgcgcctattgggtgatgttcctcttaaaatatcaaccgtgcaacctctagatccagcttttagacacacgtctgtgtttcctcctgagcctcatcctttggcatatgaaaaaaggtcttctcagaggctgccaaattttacagctacttgcatgcaatcattagaagtaatgattcagctagagggatctggtaactggcccttggatcctatagccatggagaagacgaagtctgcatttcttttaaaaatgggtgaaagtctggaggatcaaggaatgtttgttactgccagtgaagatgaggtcaatgttcttacatctggatattcattcttgcttaagatatttcacgaaagaggtttgctgttacaaaaacgagatggagacggtaaagctcaaaatgttccatcagaagacaaggaactctttcttcggagccagcactcaagtatgatcaatggtctgcatggtcgttaccaggtgtatgggccggtagtaaggctagcaaaaagatggatttcggcacatctattttcttcatttatctcagaggaggcagttgaattgttggttgcatacctattcttgaagccatatccattcaacgtcccttcttcacgggttgctgggtttcttaggtttttgcgattactgtctagttttgactggaccttttcacctatgatcatagacataaacaatgacttcaacctgaaggatgagaaggagataaatgaaaactttatgctgtgtagaaaatcttatgaacaaaatcctcatgatatagagcctgcaatgtttcttgctacatcgtatgataaggcatctgaagcttggacgagacattcaccaagcaagccggttcttaaacggatggcttcttacgctaaaagcagtgcagagcttttaacaaatcttataatccaaggtcaatcaggccaatatacatgggagtgtgtcttccgaacacctttaagcaattatgatgctgttgttctcctccaccaagagaagctttgtcgtcctcaccaagtacttttccctgctgagacccctaatggcaagctggtaatttgtggcaaaccatgtaaagatttccacccttatatgccactcaataaaggagttgtgaaaagcttgcatgattcaagagagaaaattttggtaaattttgacccaaccacatactttctgcgggatttgaagagtgcatttcctaaaactttcaagctgtggtatgattcaatcggaggagacgcaatcggtcttacatgggagaactcaaagaagcgtggcagagacgaggccgatgaaaccatgctggatccagcttctatcctaaaggaggttggaaatgttggcaaaggtttggtaaggggcgtgtatctcctcaaagcaccaaagcttcagtaaactattgaaaactcgctgaaagttgtgtggaagagaggcttgtgctgtttgtgcaattaacacaacttctaaccgatattcttacactggcaagagcaagacggtggtttccatggcactgattggacatggtaagggatcaacatctggcaatgtactgattagaagtaagcaaggaatgttgtgtttagactcaagttgattagggtataaaagtttgtatccaaattttgattctgaggtacagaaaagtatagcaatgtaattttgatccttccatctgatgatatttttgctcaaa

SEQ ID NO: 233 - DNA, 749 bp, Oryza sativa
atcgaaacaccagtagttcccaccaccaccgcggcgactgctccggcgatctctccggcgagtgaccaggcgaacaagggcgccgtttccgtcgattcaggtagaggagatgagttccgcgggcggcggcggcgggagggggaagtcgaagggctccaagtcggtgtcgcggtcgtccaaggccggcctccagttccccgtcggccgcatcgccaggtacctcaaggccggcaagtacgccgagcgcgtcggcgccggcgcccccgtctacctctccgccgtcctcgagtacctcgccgccgaggtgctggagcttgcggggaacgcggcgagggacaacaagaagaaccggatcgtgccgaggcacatccagctggcggtgcgcaacgacgaggagctgagcaggttgctcggcgccgtcaccatcgccgccggcggcgtgctgcccaacatccaccagacgctgctccccaagaagggcggcaaggacaaggccgacatcggatccgcctcccaggagttctaggatcccctcttgggtccgctactcggaatcaagaaccttgttgctccctgttctttgatccgattcttttccccctcccatcttagtaatatccatcctttgtaggttgttaggttaggttttgatgaacggttggatgatggtgtgatgggtttggtgcttgagaaatcttgttggaatggaatggaatatatgaatgaatgctcgtttctacgccctgata

SEQ ID NO: 234 - DNA, 1761 bp, Oryza sativa
caaaatttccccatttccttcctctctctctctctctctctctctctctctctctctctctctctccccactcgctgcttccgccgccgccgccgccgccgccgcagcccatggcctcctcgtcggagaacgtggaggcgccgcgagacgagcagcgcgacccgccgccgtcaccgccgaaccctagcgaggaggccggggcgggcgaggagatggaggcggagggggagggggaggaggaggtgaaaaccctagagcgggcggaggagctgttcgagagggggtccaaggccatcgaggagggggacttcgtcgacgccgtcgactgcctcagccgcgccctcgagatcagggttgcacatcatggagaacttgctccggaatgtgttagcacatattttaagtatggatgtgccttgctatacaaagctcaggatgaggctgatcctttgggtaatgttcccaagagttcatctaataaggagtccatgaagagtactactaacaaggatgatagtggaagctcaaagacccccggtagcaatactgaggatgctccatccacggataaagctgatgctgaagaagggcaaaactcaactggaaaaggtcaagaggaggaaaacggtgacagtgacaaggatgatgatgagatggtgggagatgaagatgattctgatttggatcaggcctggaaaatgttggatattgcaagggctatagttgagaagagcccagatgacactttggagaaagcaaaaatcttttctgctctagctgaagtctccatggaaagagaggacattgataactcactcggtgactactttaaagctttagccatattggagaaattgtttgagcctgatcatcgtcgaattattgatctaaacttccgcatatgtttggtctatgagttggtgtcgaagatttcagatgcaattccatattgcgctaaggctatttcattatgcaagtcacgcatacaaagcctaaaaaatgacaaagatgctttgttggctggtaaagatgataacgcatcagctgctgatggaggctcagaaaagtccgctcctgagggtgagatagagcagctcagtggcattttgagtgaacttgagaagaagctggaagacttggaacaagcaatgtctaccccaagctctgttatggatgagattatgaagaggattgcctcaaaggcaggtggtgaacagaatgctactgacacaatgccagcggctgcttctttcaattcttcttcacagatggctggatcaagcaacggctttgattcgtcaactctgtctacggcagctacaaccggaagtactggaagcactgtaaccgatcttggggttgttggtagaggtatcaaacgtgctaatatcaagccaatctctgctgaacctcctcccaagagagctgcagctgattcgctctcagtaaaaggtgatagcagcaacaactcagatgttcataccccagcacaagagggcgatgattctgtatcaaagtaatgcattttaccctaggtagtaacttaatggaatctattcggtgccaaaatcctgtcttgcttaatatgtactgctgcatgtccattttctcagaagaactgccaatagggattgcatgaaccttttaccttttcagagctcaaaccgtgtcttaaattgatggttgacttgattgttgagtgagttcatggtggactaccatccaactcaattgtatctgatcatagtatttccccgtttg

SEQ ID NO: 235 - DNA, 3121 bp, Oryza sativa
aggctgccgtgccatcctcctcctcatttcctctctcacctctccgcgcgccgcctctcgccgccgcggacgaaaccctagctaaaaccctcctctccctctccctctccctctcaccgagccgcgcggcctcgccaaggaccggcagcgatggggaagagcagcagcaagaagaagaaggacaaggtgatcctgcccccgcagctgccgccggaggtggacgacgacgacgtggtggtctctgacgaggacgtcgagttcttcaggggcaacgagggccacgcccgcgcgctcgccacgctcgacaggaagtccatcgacagctacgtcaccagggtcgcccaccacgacgaggacgaggtcgagcgcctctacgaggagcgcgagcgcaggaggaaggcggtcgaggccctcaggcccaagaaccacgacgacgacgacttcgaggtcgaccgcgttgacgccctccccgtcaagaccctgcaaggggagctggtctacaacaacgccaagaaagcgagatttgatgacagttctaataatgttgaatctaaatctgaagacaaagtaggaaattccaaacaaactattcaaaagggagaacggaaggaaaaatccaaaagcaaaaagggagatggtaaattgcaaaatgtgcaagctcaaactgaagcttcaaatggaaaattacaatcaaaagtgctggaggaggtgaaggaggaactttcagctgaggaattatttgagaaaaagaaggcccagctggctgaaatagggatgtctatgcttgaagatcctgaatcacatattagatctctaaatgatatgttaaacatatgcaatgacaaagaccagaaggttgttaaacttagtctgatgtccttgcttgctgtgttcagggacattattcctagttaccgcattaggcagttgacagaaaaagagcttacggtagaggtttcaaaagatgtaaaaaagatgagatattatgaatacacacttcttcgctcctacaaggcatacctgcaaaagttaatctccttggagaagcaaccaaatttttccgctctggctgttcgttgcatgtgtactttactagatactgctccacatttcaacttccgtgaaagtatacttgccagcgtggcaagaaatttaagttctccagatgatgcagtgaggaaaatgtgttgtgaaacgataaggtctctatttgtagatgaaggaaagcatcgtggtgaggcaactgttgaagctgtgagattgattgctgatcatgtgaagctaaacgattgccagcttcatcctgatagcattgaggtcttcctatctttgagatttgatgatgatcttggaaaagatgacacagaggaagaaaagggaaaaccaaagaagaacaaacgacgacaaaaccaggaagtcccaaagcaattgccagtgagtgataataagaaagccaaacaggaattgatctcaaaggctagagaagaggttgatgctgaacttagatctgtttcctttactcttgatccaaaggaaaggagaaggatacagaaagaagcactctctgctctttttgagacttactttcggattttgaagcatagcatgagtatttcaaattccaggggcaaggtcattaatgtctccccagatggctcacacccactacttgctccatgtttggagggtttaggaaaattctcacacttaattgatttggatttcatgggtgaacttgtcgcgtgcctcaagaagctttctgggtataccgaccatcactctggcacagtacatgacaatacactgtctgtatcagaacgtctgcagtgctgcatagttgcatttaaagtctggaggagcaaccttgaagctctgaatgtagacctgcaagacttctttgtgcagctttttaacctcattctggagtatcggcctgacagagatcgtggtgaggtattggctgatgctctgaagacacttctctgggaaggcaaacagcaggatatgataagagcagctgctttcattaaacgcctagcaacctttgctttgtcctttggttctgcagaagccatggcagcattaatcacactgaagcatcttcttcaaaagaatagcaagtgcagaaacatgttggaaaatgattctggtggtggctccctgtcttgcttagttgcgaaatatgacccagaagctaaagatccttatctgagtggggcacttgcctcagtcctatgggagcttagccttcttcagaagcattacgattcctctgtttcctcaatggcctcaaatatcttgagcatggccaatttgaatcctacacagaatcctgttccaatttcaaatgcaaaccctctagaagcatatagagacttgtcaatggaacggaaattgtctaaaccagcgaataaattgttgccactaaactgcagaaagaagaggcgtggtaaggagtttgttgccctaagccctgcagcgctcgagggatcagattgcgttgcgggtggagatgaactcaaagagaagttaaaaaatcattttgcggtactaagaggtatctcagagaatgagagattgagagctgagctgaaccacacgttgtcatccatcaacttgtacaaggaatacaagaagcagaagaaaagcaggaaatcaaaggctgttaagaaaaaggtttcaagggcttaagttgtgctgcgtttgggggaaatttttgcacaccagggaccaaaggtgtgcagaatgaacaattttgccatacccactttgtagcttatcgtagcttttgggtgtaacacatttgcagttccaagcatttctttttaagctcgttctatttcctgacatgtccttttattcttgttgcctggacctaaccaggctaacaagtttgctgccgctgtacaagatataacagtggcatgcttgtgttatctatatatattgttatgcatgaacaatgccatcccctatgcaaaactacagattggtagtcgcaaggtgtagggtgctcgcgcagaaagggggaaaaatagtaggttttactgtccactagcaaaatatccatgttttgctatgttaaagtacacatttatttgaatatatgtttttcatattt

SEQ ID NO: 236 - DNA, 4105 bp, Oryza sativa
ccaaaatccccaaaccccaactccccgtcctcctcgccggccaccgccgcgtctctgctgctgcggcggctgccgcgcgggcgtcctcctcccggcggcgccagcttggtcggtctctcagagattacagtcccggtacatgcctcattcttgatccagctcgcgaggtcatcaagaaccaacattcaacaggttcgcatgtgttaattgttgccatggtggatgcaagggagaaatagcctcaccgttgggtccacctgccatgataaagccaagggtcaactggtcggatcatgcaaatgctgttcaaagctcctgtatcaaagatgaattcctgagttcaagttttttgttctctttaccaacacaaaggcctaatcaggaagcagattgtacgggaatgcttcctttaaggtctgctgcttgcagaattcaaggcctagagcgtcttcaagctccatccattgagaaggcctggcgttctctacgcaacactcaggttgcacggaagaattatttaagacctggtttatctggaaaagtgaaagattgtgatagtgaccatgctcatacttatgggacaagttcttcatataatgttaacaaaatggacagtgtgtccagaaataggaatcccacccaggaaagtatgcatcagacgactgaaagtggtactatggagaagaacagtagccatctgcctgcaggcaccaagtcctgtacaaggacttacctgaacaatcatgtggtgcaggcagataccattacaacaacaaatcaaagtcttgcaagaactggtcctgaattattcaagactgctccttttattgacaacatgtgtgatgatgctaaattagatgccatggatgaggatgagcttctagcgagtattgatgtggaccgaatagtcatggaacattatcaagcaacaaatacacccagagggtcatccaaatctccattagagaagtgcaacttcaatggatttgatgagaataatttaccacaagaactctctataatgtgtgaccacggtagcaagctagctttttgcccagaggcgaagtctcatttgcttgaaatgaaggataacttgcttgcaatatcccatgagcttattgacggtcaactcagccctcaacaatccgatgatcttcatcaaaagagagcactcctaaagaagcagattgagctgcttggggagtatacggcgaggttaacccaagatgaagagcgacagcaatctcattctatggcctccacaacagctcatcagggccatcaccccactagcatcctaagtagctcttttgtaaaggataccaatatattccaatcaccgatttacaccaggaatgaacctggggaaagtggtttatgcttttcttctgctccatattcctatatggatggtttaagcatgccattaccgtctgttcagagagattacactccaagggctattgatatcagttacactgaaggttctggtgataaacagtggagtagtacacactttgcatggactaaggaactcgaggccaacaacaaaagagtatttggaaaccgttcttttcgcccaaatcaacgagaaataatcaacgccacaatgagtgggaatgatgtttttgttttgatgccaactggtggtggaaaaagtttgacatatcagcttccagcactcatttgtaatggcgttacattggtagtttctcctctcgtatcgctcatccaagaccagatcatgcatttattgcaggcaaatatttctgcagcttaccttagcgccagcatggagtggtcagaacagcaggaaatattaagagaattaatgtctcctacatgcacgtacaagttactgtatgttacgcctgaaaagatagccaagagtgatgctctgttgagacaattggaaaatttatattcgcgaggccatctctctagaattgtcattgatgaagcccactgtgttagccagtggggtcatgatttccgacctgattaccagcatctaggcattttaaaacagaagttcccgcagacgccagtcctggccttgactgcaacagcaactgcaagtgtcaaggaagatgtcgtgcaagttctaggccttgcaaactgcattattttcagacaaagttttaatcgtccaaatctgaggtattttgtatggcccaagacaaagaagtgcctcgaggatatccataactttatacatgcaaatcataataaagaatgcggcatcatatattgcctttcgaggatggattgtgagaaagtggctgctaaattaagggaatatgggcacaaggcatcacattatcatggtagcatggatcctgaggatagagcaaatatccagaaacagtggagcaaggataggatcaacataatatgtgctacagttgcatttgggatgggtattaataaacctgatgtccgttttgttatccatcattccctgcccaaatcaattgaaggatatcatcaggagtgtggacgtgctggtcgtgacagtcagctttcatcttgtgtcctgttctacaattattctgattatattcgtctcaaacacatggttacccaaggatttgcggagcaaggaacatcagcaccacgaggaggttcttcgcaggaacaagcgcttgaaacgcataaggaaaatctcctgcgaatggttagttactgcgaaaatgatgtggactgcagacgtctactacagctgatccactttggagagatgtttaatccttcatgttgtgcaaaaacatgtgataattgcttgaaagagttgagatgggtcgaaaaagatgtgaccaacattgctagacaattggttgatctggtaatgatgacaaagcaaacatattcaactactcatattctcgaagtatacagaggttcagtaaaccaaaatgtcaagaagcaccgccatgatactttgagtcttcatggagctggaaagcatctagctaaaggtgaagcagcgagaatattgcgccatctagtaattgaggaaatactcattgaggatgtcaaaaagagcgaaaactatggatctgtatcatctgtcttaaagactaatcataagaaaagtggtgatcttctctctggcaagcacaacgttgtcctcaagttccccactcctgagaaggctcctaagatgggtgtactcgatgaatcgtcagttccacgaattaataagactaatcaacagagtcaagtggacgggagccttgcagccgagctttatgaagctttgcaatgccttaggactcagataatggatgaaaatccacaattattggcataccacatatttaaaaacgagacattgaaggaaatcagcaaccgagtgccaagaacgaaagaggaacttgtggagataaatggcatcggcaagaacaagctgaacaagtacggggaccgtgtgcttgcaaccatagaggatttcctcgccagatatccaaatgcgaccaggaaaaccagcagcggcggcagcaacgagcacagcgaggcggtcaagaagcgaagaggcttctccgtcaccaacacctctaccaactgtgacgactttgaggaacgcacggtccagtccaagaaacgcgctgcaaagacacgtacaaggcaggaaatatctgatgctgccagcatcgtccaggacgtccgctacatagatcttgagctagatggttgtgaacaagtcaatgaagtgccatacagtgtacaaaagcctatggcttctggtagggttttacctgcgtggcagtccgccagaatagcctagggttaacaccccctcgtagtttctaatttatgtgaagaatttatatgcattaagtaggatcctaggctaaccccattgagctttatgtaggccttgggccaactacttgtaagatggcaccaaccagaccacatgttaggttgcttctgaacatatatggtagtagtccttttcagtatagttcccgtagcgcatgtaactaacatgatattactatggcaaattttgatgtcaacagcttcaggaagtggacatcgaaaggtcctagtactgctgtaagttgattatttatagatgagccttacgcttgttttttta

SEQ ID NO: 237 - DNA, 1361 bp, Glycine max
aatccccaaacaagagattttgaatttgaaatactcccgctcccgtctccatatatttgcgaaccctttttctttgtgagagacccgttatcagagaatccagaaggcgaagaagaagaaacgacagagcaagaaggaaatggcgaccaacattgggatcatggatgcggcttacttcgtcggcagatctgagattctttcttggatcaactcaactctgcaactcaatctctccaaagtcgaagaggcatgttccggcgcggttcactgccagcttctcgatgccgctcatccagggatcgtgcctatgcacaaggtcaatttcgacgccaagagcgagtatgagatgattcagaactacaaggtccttcaagatgtcttcaataaactcaaaatcaccaagcacatcgaggtcagcaagctggtgaaaggaaggccactggataacctcgagttcatgcaatggatgaaacgatactgcgattctgtcaattccggccttcagcacaattataatcctctggagaggagagaggttagcaaaggtggaagagaaacgagcaagaaatctgcaaactcgcaagcctcaacgaagggttctactgcacagagacctcagtcttctcataattctcgaagaaatgaggtttctaatgctaaccctacaaatcaagctgcaaaggttgcgagagcagcaccttctgccggaaaccctgcctatgaagaaaagataacagagttgaagttgtcgattgatagccttgagaaggaacgggatttctactttgcaaagctgagagatattgagatactgtgccagactcctgagatagaacactcaccgattgttgctgcgatacagaagatattatatgctacagatgacaatggaacggctgtggctgaagctcaagctatgatttctgttggtcgtaaggaaatagagggattgagccccattgctgaggtttcggaggagaagagcagttcagaaactcacaagagaaagaatattgccaatattgattttgatgttgctgggcttgcaacgttgtctcccagacagaggctttctgatgtttcagatgttcattgtagcgagtcacctcttatgacttgttagggatcacgttctgttgttaattcaattagcaacttgttaaaactgtttttggtcacagtaattcctgtttcatgtgtgaattgaccgcgatattcataatgattaggggtttttagggagactattctgttataaagtatcagtatcagcccagaaaaatgtaaccagatatgttttgcctttatagaatttgctgctagtgctttgatttatttcattttcagcatttttaattata

SEQ ID NO: 238 - DNA, 3680 bp, Glycine max
aaggagggaagagtgagagcaaagaacgagtgagtgaaagtgtgagagaatgtctaaccctcaagaccagaaaccatggaaggcggaatacgcgaagtcgggaagatcgtcatgcaggacgtgcaagagccccattgccagcgaaacgctgcgtctcggaaagatggttcaatccaccaaattcgatggcctcatgcccatgtggaaccatgctgcttgcatattgaagaaagccaatcagataaaattacttgaagatgttgaaaacttagagtcacttcgttgggaagatcagcagaagatcagaaaatacatagagagtggcggcggcggcggcggcggtagcagcagcggcagcgcggcaaagtcagactccaagactgtcaaagatactaaatgtggtattgaagtgtcacaaaattctcgtgccacttgcaaggattgcggtcaaaaaattatcaaaggagaggttcgtatatctactaagcctggtggtcaaggtgctaaaggtttggcttggcaccatgccaagtgtctcatggaactatcaccatcaattgacgtgtataagttatctggatggaacaatctctcatcttctgatcaatcagctgtcagtgacttcgctaaaaagggtggtagtgatacaaaaattgagactgaggagggtaaagaatccacacaacaacaaacttccaaaggtgggataaaacgggggaaggatgttgatagtgagcggaaatcaaaagttgctaaggccaagggagatgtgtctgtgggcagcgcaatgttagtgaaatcaggggaagcatgtgatctggagaagaaaatggagacccagagcaaagaactctgggatttgaaggacgatctcaaaaagcacgttacaacaacagagttgcgtgaaatgctggaagccaatggtcaagattcatcaggatcagaaattgatttacgtgaccgctgtgctgatggaatgatgtttggagcacttggtctttgcccaatatgttctggctttctgcgttactctggaggaatgtaccggtgccatggctacatttccgagtggagtaaatgttcttactctacctgtgaaccaaaccgtattgaagggaagtggaaaatcccagaagaaacaaataatcagtaccttaaaaaatggttcaaatctcaaaaagggaagaaaccagttaggatattgcctcttccatcaccaaggaaatctgctgaaagtcaaatgattgctagtcagcatcatcattcatcaaatagtgaaaatttgcgagatttgaaagttgctatctgtggattacctaatgactcaattgcagaatggaaacgcaaaattgatggcataggtggggtgtttcatgcaaaagtaaataaagatactaactgcttggtggttgttggatcactcaatgatgaagctgagatgcggaaggcaaggaggatgaaaaaaccaatagtcagagaggactatttgattgactgcatagaaagaaagaaaagacttccatttgatatgtacaaggttgaaatgattggtgagacttctagcatggtcaccattaaagtgaagggacgtagtgctgttcatgaggcttctggcctacaggattccggccacatacttgaggaagggaaaagcatatataacacaactttgaatatgtctgatttgtctactggtactaacagctactacattctccagataatcgaggaagataaggggtccgattgctatgtgtttcgtaaatggggtcgagttggaaatgacaagattggaggaacaaagctggaggaaatgtcaaaatctgatgcaatatgtgaattcaaacgattattctatgagaagactggaaacccttgggaggcgtgggaacaaaagactatccagaagcaacctggaagattttttccattggatattgactatggagttaacaaacaggtcccaaaaaataaaaaaaatgatgctgacagcaaattacctcctccattaatagaattgatgaagatgctcttcaatgtggaaacatacagagctgccatgatggaatttgagattaatatgtctgaaatgccacttgggaaactgagcaaaagcaatatccaaaaggggtttgaagcattgacagagatacaaaatctgttaaaaattagcaatcctgatccatccgtcaaggaaagcttactcattaatgccagcaatcggttcttcaccatgatcccttctattcatccacatattattagggatgaggatgactttaagtccaaggtgaaaatgttagaagcccttcaagacattgaaatagcctcaagattagttggatttgatgctaacaatgatgattccattgatgataattataagaagcttcactgtgatatatctccacttcctcatgatagtgaagagttttgcttaattgaaaagtttctccagaatactcatgcccccacacatacggactggagtcttgagctagaagaagttttttcacttgaaagggaaggtgaatctgataagtttgctccttacagggataaacttggaaacagaatgctcctatggcatggttctaggttgacaaactttgtgggcattcttaaccaaggactcagaattgcacctcctgaagccccggctactggctatatgtttggcaaaggggtttactttgctgacctggtcagcaaaagtgctcagtattgcttcactgataagaaaaatcctgttggtctaatgcttttgagtgaagttgcgcttggaaatgtctatgagctcaagaaagctaagtatatggataaacctcccgaaggaaagcactctactaaaggactgggcaagaaaatgccacaggaatcggaatatgtaaagtggaggggcaatgtcactgttccttgtggcaaaccagtgccatcaaatgtcaagagttctgagctcatgtacaatgagtatattgtttataatactgctcaagttaagatgcaattcttattgaaggtgaggtttcatcacaagagatgaggactagagagaagtttcttgttctggggtgtcatctacactaagcagttttttgaccatgactagtacgtagtacatcttggattctctagaattatcttgataatgtctcattttgagttgactagagatatttcaacgggttttttgtagggcatgctagtgcagggatgtattagttgaaacccgtcacttagaccaaaaacatctcatccaatttgtgatctggttatctgtatagaactgctattttaatctcaaactttttattgagctcttcccttttaaatatgtgttgcatcagtataagtgcttttatcatatacaaacacaaatcagttaagggttttttttatcttaccagtctagtaaattttcaaataggtatgcataaatagaagagctatttcccttcctctgtgaaggaggtaccctgaagttgataggctttgttatgaggttttaaccaatattcagaaataagaatcaagtgcatagaaagagctagactggtatggccaaaaataaaaaataaataaataaaagctaccctggttatgtggctgttgcttgtggggacttttgttacacagtattatgtggtctgcatgtgtcatgtgaaaaggtgatgctatta

SEQ ID NO: 239 - DNA, 1981 bp, Glycine max
ttctcttcctctttccctcgttttctgctctctttctctctcccgcttttttcattttccgactcgccaaacgatcagatctccgccattccctcttccgattcccccaaattcccgcccccaaccctccgaccccctccgccgccgatcgccgcccggcgcatgtcggcctcgcgcgctccccccgccggcgccggcgcctctaaaccgccggaccagatcatgcactccatgaaacgccaactcccgttctcctctatgaaacctcccttcgtcgccgccggagactaccaccgctttgcccccgaccaacgccatgacgccgccgaagccatcgtcgtcaagactccccaactgaagcggaagagtgaagcggctgattttgaagctgattccggtgataggatgactcctggattcactgaagcagctaatagtccttttcagacacctgtatcaggaaagacggggaagggaggcaaatcctttaggctgacaaagggcaacagacttggaactcagaccccaggctcaaatattggttctccttcaggcaataatctcactcctgctggtccatgtcgttatgacagctctttaggtctgttgacaaagaagttcatcaatttgatcaaacaagctgaggatggtatccttgatctgaataaagctgctgacacattagaggtgcaaaagaggaggatatatgatataacaaatgttcttgaagggattggacttatagaaaagaaactcaagaaccgaattcaatggaagggactggatgtttcaagaccgggtgaggctgatgatagttttcctagtttacaggcagaagttgaaaatttaacaatgaaggagcgccagttagatgaacaaataagggagatgcaagaaagactgcgagatcttagtgaagatgaaaataatgacaagttgctttttgttactgaggaggatataaagaatttgccctgcttccagaatgaaaccttaatagctattaaagctcctcatggaaccacattggaggtccctgatcctgacgaggctgttgattatccgcagaggagatacaggatagtcctcagaagcacaatgggcccaatagatctttaccttgttagtcaatttgaagaaaagtttgaagagattaatggtgttgatgttgcacccaaacttccatccagtccagatggtactaaacatcaatcaacagtggtcccggaggatagagggaaggacatagaagtgcagggacaagaagctcctgggcctagttcagattttactacctcccaggattttgtgagtgggatcatgaagattgttccttctgatgttgctagtgaagctgattattggcttttatcagatgccgacgttagtataactgacatgtggagaacagaacctggagttgaatggaatgaactggaaccactccaagaagattattgcatgactcgcgagaacactgcgaccccaagtcatccttcaaatgtagatgaagtgtcttctgcacctaaatctactggaggttgaagcttccaaaggatgcattgtgaatacaaaattgaacgtggtgttccttttcctgctgagaacctatgacatccagccatctccctttcatatcctctctacatggtgccagaggttggattgaaggttccatgaagatgctttctcatgtttctccatgaagttcgatcgaggaactgagtggccaatcaactggctcattgtactgtaaatattacattacctctaagcgaccttagttcaagataaaagtcttgctgctttgctgaaccatctttgtatattacataaccctaagtcttggttttctagtgtacttagctcgatgtcttgtgtttggcaagcattaataaaaacacttaggcatgcaaattgaaagagttatgcacccaggcaatgttatcacctgtaactattcatccatttcaatagttgc

SEQ ID NO: 240 - DNA, 2209 bp, Glycine max
cccacatgtagatgtgccttccttttccaaagggagcagcaacaacttgtgtactcttcttgttgttttccacttctcagaaagagatgcctcaccacaactatttcccttgcttgttgaagcctagtatcattattgtctagttcttgctgtgcttttttgtgttctctctctctctctctctcttttatggatcttggggtagtgggtttggagggggtggtgggttcagaaagtggttgcgtgtttggttcctctcttgcttcagatcctgagacaaagcacaagtggtacggatctggtgtgctcaagcaagagagatctgccatagcaagtgaagatgatgagtggggaacttataaagtggccaaaattgatcatgacatgtcttctgcccctaaagcaatgatctttcagcaaagaaacaactctttgttgagatctaataatgctactcttttttctgacggccatcaccaatctcaaatgttgagtttctcttctccaaagtcagagactttgttggtagatacagcttcctcaaatgccacattgcctttttcttaccatcaattgtctagttacagcagaaatacaggttacagttcaggaagcataagcatgcatggggctttggctggtgtgagagggccattcactccatcacagtggatggagcttgaacaccaagccttgatctacaaatacatcactgcaaacatgcctgtgccaactcatcttctcatacccatcagaaaagcacttgattctgttggcttctgcaacttctcaactggactcctcagatccaactcattgggatggggaggtttccatctgggattctcgaacagcacggaccctgagccagggaggtgcaggagaacagatggaaagaaatggcgatgctcaagagatgccgtagtagatcagaagtattgtgagcggcacatgaacagaggacgccatcgttcaagaaagcctgtggaaggccaatcaggccatgccctcaccaccaccaccaccactactaacacacttaatgcttcctcaaactcaaccgtggtgcccggcaacaacacctttgcacacaacaaagtgcaccaccctcttccacctaattcctctccagccaataccatcaataggatgtttatgaataataaagagaataacagcacgagtgagaggatggaggattgctctgcccttcccatgctacctcccactcttgagctgaaaccgaaggagaaaaacaatttcatgattcataaacaccaagacccctatgatgaatcctcaaggaacaacaatgagtttggactcgtcacttctgattccttgcttaaccctacacagaaaagaagctttgattcttcttcttcacaaaaggatgattctgagtcccaacaacaacattccctcaggcacttcattgatgactctcccaaaccaccatctcataatcatcatcgttcgtcgtccatttggcccgaactcgacaacatacagtcagataggactcagttatcaatctccataccaatatcttcctcagacttcatgtcattcactacttcctcaccctccaacgagaaactcacgttgtcgccacttaggctttcgagggcgttagaccccattcaaatggggttgggagtgggaagcggtgcctccaatgaagcaaatcctaggcaagccaattggattccaatcacttgggagagttcaatgggtggccctcttggagaggttttgaaccttagcaataacagcaatgcaagtgatcaatgtggcaagaacaacacttcagctctcaacctcatgaaagatgatgatgatgatgggtgggacaatagtcctccactagggtcatcaccaactggggtgttgcaaaaaacagcatttggatcactctccaacagcagtgctgggagcagtccaaggggggcaccagagaacaacaaagaatagagatttctgattccttgttttcaagtttgaactggttttttgttgttcttcttcctcaaaagtttgtttgggaatggattggcgtttgtggaatgtggaccacacgagttgtagctggctagctactgtctctttcactcttaaggtttgatctttggtttcacggggttgtaatagtgtctgtttttatatttggaatggtttaacttaaaaaaattacttcgattttcatttt

SEQ ID NO: 241 - DNA, 2618 bp, Glycine max
cgaaaataaatgaacagtaagtgaatgctgatgtaactaagagtgcgttacatttaatttttggcaaaggattttaaatgaggggtggctcagatgtttcactcacgacagaggcatgaggatgaggaggaggacaagttcactgtagcattgctcgactgtgttgttgtgtttgtgtgtacctatgttaaaataacagcaacaacaactaagactgaaaccagagctccataataagtgattcttcttgttttttcttgtgtctatttccccgagacaaagggttaaaggaggttgaacttgaaagttgaaactcgaaactttcttctgttctgtctttaacacaaaaatatatagttataatttttctggctctttctgaggggctatttttagcgggttgaagttgaagctgtaaatgccgctgagatagatttacatggggaagaagggaagtggtagttcgtggttaaccgctgtcaaaagggcattcagatctcccaccaaagacagtgacaaaagaagtggcagaagaagagaagactgtgatcaagaagaagacgaagaaaagaagagggaaaagagaagatggattttcaggaagactcacatgagtcacgaaggagtgaacaacaacagcaaccacactactcaacaaaaggtgcagcatgatgtggcagcaagtgggggtggttcaaggacagaccaggatcagaagcatgcacttgctgtggccatggccaccgcagaagccgccatggccaccgctcaggcggcggcggaggtggcaaggttgtccaaacctgctagccatgccagggagcattttgctgctgttgtgatccaaactgctttcagagggtatcttgctagaagagcgcttcgtgcactgaaggggttggtgaagttgcaagctttggttaggggtcacaatgttaggaagcaggcaaagatgacccttaggtgcatgcaggctttggttagagttcaagcaagggttcttgaccaacgcataaggtcttcacttgaaggtagtagaaaatccactttcagtgacactgctagtgtttgggactcacggtatcttcaggacatttcagataggaaatcaatatcaagagagggaagcagcattgcagatgactgggatgaaaggcatcattcagttgaagaagtgaaggccatgttgatgcagaggaaggaagctgctgcaatgaagagggacaagaccttatctcaagccttttccgaacagatttggaggaatggtagaacatcatcaattggaaatgaagatgagttggaagagagaccaaaatggctagatcggtggatggccacaaagccatgggagaatagaggaagggcttcaactgatcaaagagaccccattaagactgtggaaattgacacatctcagccttattcatatctaggaaccaattacagaagatcacatccaaattatcaatacaacccaaaccatcaccaaccacaaaggcattccattgcttccccactccatagatctcaccaaaatggatcctcccttcaccaatcccctgccaccccttctcctgccaaatcaaggcctatccaagtccggtcggctagtccacgttgcgttagagacgacagaagctaccacacctcccaaacaccaagcttgaggtctaattaccactacacaggaaacttgtaccaaaatggaaggattgtttcaactggaactagtagtggtggtgctactgctacattgcctaattacatggcggcaactgagtctgcaaaggctcgaattcggtcgcaaagcgcgccgaggcagaggccatccacaccagagagggacagggttggatcagcaaagaaaaggctttcttttcctgctcctgacccttatggtgtgggagtgagttatggaaactatggacatagtttaaggagtccaagcttcaagagtgtgagtggatcacactttggagggttagagcaacaatcaaactactcctcttgctacactgagagtattggtggtggtggtggtgaggtttctccttcttcaactggtgaccttaggaggtggttgagatgatttgttgcactttaatgagaagaaacatgaccggacccattattaggccatggccataattcacttcatatttgatttttatttgggttttttgtgatgttagagttaattttagtttaaccctttctcaccacccccccctcccccccctcctcaaaagaaagtttatttatttacccccgagtgacctgaatctgatgttaggagccagagaagcaagcaagtacccttttcttgctaggaaactcagaacaatttaatgtgttcgtttatcattcgtctttcatacttttcttaagatgccaagataaaaaaaaatataaagaaaaaaaaggagccatatgtggtggcctacctcacttgggatgttgtgttgatgtttgaaagaattgcctagaccatctgaatagcttttaatggactgtcctgtcacaataacatgtaatttttcgtattctagcgattgcctttaattagcaaaaaatgtacaactttttttcctttcattgttctcttttaatcaaat

SEQ ID NO: 242 - DNA, 2249 bp, Glycine max
tgctttttcagttaaacattttcaatgttcaaactcaaactcagtccccattcttctttctttctttgactacatttactttaccctcagaaatttcaaaaaatttctcaacctttagtgatgatccatcaaaaaaccccttcttcaccatcttcaccatcttcaccttcgcatcagaaacctttcaccaacactgctgcttaaattgttgttagttgttactatgagagagcaaaacgttgagtcgttctacgctaagcttcgcgagtccgcgctatcttcttcctcttctccggttctgatttttccctcaacctccgacgtggactctctctgtgccctaaaaatcatcttccacatcctcgaatccgattccatccaatacgcgtgctacccagtgtcgtcttttcacgagatccacaagtacacgtcatcttcctcctcaaacgacgagcctctctccgtcgttttggttaattggggcaaccacagagacctcagcaaaaccctcaacctcgcccccaacgcccgcgttttcgtcgtcgacagccaccgccccatccacctccgcaacctcagcgatcaaaacgacgccgttctggtgctcttcactaaagacgacgagaaccaatccgatctcgcatccgacttcaacctcgccacgctcgccaacgccgcccccaccgtcgattcggattcccagtccgactccgaatctgaatccgattccgactccgactccggctccgaaagaaatggatctagaaagaggagaaagaagaaccctgaggatgatgatgaagatccaattaagctctaccggaagctgaagaaaggctattaccgattggggacgtttcacgggaagccctctgggtgtttgatgtatgaacttgctgacaagctcaggaagaacaccaacgagttgctctggctcgcatgcatttccctcacggatcaatttttgcacgatagattgagcgatgagaggtaccatgatggagtcatggagcttgagcagcacataaacagttctggtaatttggatgtggttactttggttactcttaaggatggcaccaagattcgtgccccgaatttgtcgcggattacttatgaggaccagccgaggctcatgctgttgcaggagtggagcctctttgactccatgatgtgctcctcgtacattgccaccaagttgaagacgtggagcgagaatgggatgaagaagctgaagcttctgtttgggacgatggggttcgctcttggtgattgccagcagaagtttcagcacatgaatgtggaggtgaagcgcaatatgaagaaggagtttgagaggtttttgcctgagtatgggctcactgatttttactacaggagtttcattaggactctcaagtatagttctaagatttctgctgcggatgtggtgtatggtgtcactgcattgcttgagtctttcgtgagatcagatggttcttgtgcttctaagcagtttggtgtggcctatgatgcgctttctttgaacaatattgacaacttgagaaccgggatgcagcatgctattaagattcagagagcaattttaaggcaaggcagtgctgcaattactaagattgggtgtataaggagtggaaggagtttccggtggctgaagctggaggattccaatgatgctatgctgttggggtacccacaggctttgactaagttctgtttatttatcatggatgctttgcgagagaaaggggccaaaatgaagcctttgatttgtgtttgtgtgtctcaggagcccgggaaggtgctgattgtgggggtttgtgggaggccgcgtttgggtggggctcaagcaaatgcatttgggattgcatttaggactgcggcagaggagattggaactgagttctttcatgagttatttgaatcatcgtggattgttctggatgcttcagctgtgaattctttcatggttaggttgaccaagaagctgtgatgctgctgaatttctgattagaattggttcttcaaggaagtgtctactctgaccacagtgccatgccttagatgttggaccaaaacatgactcttttcctagtcagttgtattgtgattcatagcatattcatttgacttttcttgttttcccaaatatgttagcttgacactttcatgtaaactaatgttttaattccaatttggaagtaacgttgaattgaaaaaaaatgagatcttcatggataaagttcaaa

SEQ ID NO: 243 - DNA, 3817 bp, Glycine max
gtgagaaggctagatggaacagcgtgctaacgtgactccaatatagaagaagagagccacacttccttttccaccattgacattctctgactatttcctcggcatttggcaacctctgcaaactccttctctctctttaactctgcaaagggtaaagtaaagacttcattcaatcacaaatcacaattgcatttccagagaaaacttgaaccttcttcacatgtcgtcggacataagctagattattagccaccctttttcttccttcctttaactcaaccttcttcaatcttcacacaccccttttagaatataacaaggtttatttgtcattcaatggctagttgcttgatttgttgttgtgtcattaagtctagtgttgcagttgtagcgttaagtgtggttgtgttttagtgagggaaaaaagaaagaaagttggaagctttggttggtggggtggtgggaattgtcatgggtgcggatcgtctgatactgccaacagttggaccgccattaaaacggcgagcagggttgcggaggaagcaggctggaagagggtcctacagagggagctaggtgtgagtgagtgagtgtgtttttggaggattcaaattctcgggggtgccttcggggtgttaaaagtttctgacttgttaggggggggacaacatgggtaccaacttgcaccaagtactcggaagcctctgtttgaatactcactggaactacgccatcttttggaagctcaaacatcgtgctcgaatgatcttgacatgggaggatgcatattataacaatcctgatgatttcgactcttcagaaaataaacactgccagaagaccttggaacagattggttgtgggaaattttcacacagtgcattagggttagcggtggctaagatgtcatatcatgcatattcattaggagaaggtattgttggacaggtagctgttactggaaaacataggtggatctgtgcagataatcaagttgcgagttctggcttgtcttttgagtttgctgatgggtggcagtctcagttttctgctggaatcaggactattgctgttgttgctgtagtccctcttggtgttgttcagcttggctctctaaataaagtgattgaagatatggggtttgtaactcatatcagaaatctttttttgtctactcaaaattactcaatccaatgtcctagtcaaatacagggtagtttgaagagttcatctcagctggacaaatcgaaggaaaatttttcttcagatattatgcgtacttgcttttacgatacacagaaatctatgaaaagtgaaacagcagatgttttaatgccccttcaatgttctgggactgggaggaactgtacacctccttctgcttgtgagaaaatgtctgataatgtggccaagcaagaggggcctgaattgtacaatgatgaaagttccattttgcttcagtcgatatccaatatgatgaatgtggactgtcaggaatttgaagagatgaaacctctatatgggacaaagtatgaaggaggaagtagtggctgcaaagatatgagattggaatcagaaaaaaatgtctcatcatttttaaatgattttgttacagataatgctagcttcaatgatgtaatatgtccatcagaaaaagtcagagttgattctgcatgctttccttcagtttttcttgatacagttgtttgtgaaagtgataaattgcattatgcagatattaaccaaaaaggggcagtgaattttgcccaaccttcagaagcaaactcccagcaacatattgaaaagtcaaagtttcatactgagccttgttacaaggatatcccagacttccaaactgaaccttgttacaaggatgcctcacacatattgaagttccctgctggctgtgagctacatgaagcacttggaccagcttttttgaaagggggtaaatgtttagattggccagcacagattaatcaagaaatgaaatctgttgaaatgtcagatgagattagcactagtcaattgacttctgaatcttgtccagaacatcttttagaagcaatgctggccaactttagccatagtaataatgatgttaatagtgaattatcattttgtaaatcaaagcaatctgcaattgtctctgcaaaaaatcatgaggcttctattcacaatgtgcatactattaattcagaaggctattcgatagatcagctctctcttgtcagagaggacaaacaccattctttgagttcatcatcagggatatgtggtgtgatgtcctcaaaaggtatttcatctacatttcatagttcaaatagtggacagcttgaaaggtcgtctgaaccatctaagaacagcaaaaaaagggccaggccaggggaaagttgtaggcctcggccaagggacaggcaactgatccaagatcgtatcaaagagttgagagagctggtgccaaatggagcaaagtgcagtattgattcactcctggagcgcacaataaagcacatgctctttctccaaagcataactaaacatgctgacaagttaactgacttttctgatacgaagtcaaagttgcatcataaggaagcagacattcttggatcatctagttatgagcagggctcaagctgggccatggaggtagggggtcatctgaaagttcattcaatattagtggagaatcttagcaagaatggacagatgcttgttgagatgctatgtgaggagtgcaaccattttcttgaaatagcagaagccataagaagtttgggccttaccattttgaagggtgcaacaaaagctcatggtgaaaagatgtggatatgctttgttgtcgagggtcaaaacaagagaaatgtacacagattggatatcctgtggccgcttgttcaaatactgcaatccaagagcaccgtgtattcacattaacttgttggttcttggaaactatggccactcattggcaagtgtaactcattcttgatctttgaaatgatgctcacctttatagtgtgttaagacataggttgtggtcgtgtttgtgtgttttcttaaatgattgaaatgtgtgattgtcgttgtttatgtttgacactgaaaatagcacaatacgttgaacatatactagtgttactctcttcacatctcagacttcttgtttatttaccagtaaggccgaagttatattattaatgatcagaatttaaatacaatacataggtaaacctattttgacatccctcaattctctgtaagtatccatgagttatacccatttgatgccacagtaatgccaccaattaagcgttgtttctttcattctatgtgcaatgtttggtggattcaaagatgtagtagtacactttttgttgttttgctaaaaatgcaaggaaatccacaatttgttccgagtggagggcattcttgttctcttctattcttggtggctaagatctgccacaagtaaaatgtgattagatttcaatcggttgaggtggaaggaggaaagagtggtggtgggcggcaaaagtgtaaaggagatgaactattaaggctatgtttgagttgtcttcaaccacattgaatgccaaagcttcctctcataaaagttgcattgaatgtgtcttggaatgcatgattcgtgtaaaacaaagtgcgcttgaattcacgtttgaagcttgttaaatagatattcacactctccaacgtagagaatgtgcgtgtttggtttgtactcctacgttggagaggaagcttgttaaatagatatttacactccaataaaatttggactaagctttttaaa

SEQ ID NO: 244 - DNA, 4279 bp, Glycine max
atatcaataatttttagaagaaataaaaagttaaaatatctatagaaaggtgataataaaaattgtctacagcatgacagtgccaaaagcataatggtcctcgcgtgtgctttggatccaatctacttccatgataaaatttgcatctccggtgaccaaaaccatcgaattgcttcaagaaccgctattgcctcaccttcatggacatagtccgtaggttagtaaaaaatcaaacaaagactgatggataaaatagtttcatttaaggattaataaacaaattaaatatcgtatcaatttgcaagcgtataaatgagaaatgttaataatatacttttgttttatatacgctaattaccattgaaattcaggaatcacattttttccaactttatatttaataagtcttttttattgagtttataatgtttaataaactttaatcaatgtattacatgacatattacgggcgctcctcgttataaaataataaaataaataaattaaggtgattttatggttttcttttctttaaaaaaaaaagaaattgttttttttaagcgagggaaaagaagtgaaaaccgattcaaaagaaggagaaatgatagtgattcctggaaatggcagagcagcaaagtagccgaatcagcgtctttttcagtgcttcgaagccccttcttcctagaaaaaggccttctgattcctctccccttcaccctcaccgaatcaagagtgccggtgatgttgcttcggtttctgttgcgaagagagttcctcttgcggaagtgccgctgaataggctcaatgcaattgggagtgttcatggtccgtcgcctgatgcaattcacagcagtttcagtgcaaggactgtgtctgttcctgcagttggttctgcggatgagaacctgtgtcgatctctttttgaaactccaaggagagaacctgaaggctctaaacctaaacagctggattgtttttcaacgactggtctccttgacgacgattttgatgactcttttttggagcaaattgacattctgtgtgagcagaaatctgcagagcagcaggcggatcgtagcagtgacgagaaactttcgagcaagagtaatgttgttggtgatgttaatctgagttcagaatctggtactgtttctgagggtataggaaacggtcacctgcttagctctgggattgagctagatagtagagaagaggaagtggattcaagctggcgagatttactcaatagcaccatgcctgaggaatatttgaaatacttaaagtctttaaatgacaggcaaagagaagcagcttgcactgatatttcaacccctttaatgattgtagctggtccaggaagtggcaagacatcaacgatggtagggcgtgtattgatgctgctcaatgagggcattagtccatcaaacattcttgcaatgacatttactacagcagctgcttctgaaatgagagaacgtataggagctatagctgggaaggcaacagctaaagaacttactatcagtacttttcattcattttccttgcagctttgtcgttcacatggagaaaagttaggtcgtacatctgaattcttaatatatggacaggggcaacagcgaaatgcaattattgaggccatccgattattagaaattggaaagagtgaaaataaagatggtgcattattaattggtgaattgtccaatagtctaaataatcctaaacagttcaaggataaggcaaagaaatggcaaaagtttgtggctcaggccaaagcttcgggaagaacttctgcagaatatcgcaaaatgggcaacgaaattggagccgcaattcttaagaattacaacaacatattaaaatcttgtaatgctctggattatcatgacttgatcagctgttctgtgaagctacttagtgattttcctgaagttttcaaagaatgtcaggattcatggaaagctattgttatagatgagttccaagatactagtgccatgcaatacaagtttctaaagatgcttgcatctcatcataaaataacaattgttggtgatgatgatcagtctatttacagtttcaatggagctgacatttctggatttatttcctttcgcaatgattttccaaactacaaagagattaggcttaacaaaaactaccgatccacacgttgcattgttgaggccgcatcttctcttattcaaaataattccaagcgatgtcagttgaagaatgttcttactgataactcttctggatccaagatagttatgaaggagtgtcacaatgaggatgcacaatgcgcatttgttgttgacaaaatcatagaaatttcatcaaattattctgcagctaactgttgttatggcaacattgcaattctctaccgtaggcagatatcaggtaaagccttccaaatggctttccgtgataggaaaataccatttaacattcatggtgtggctttttacagaaaaaaggtagtcagaactatcatggccatgcttcgaacagcactgcctggttgtgatgatgggtcatatagtcgtgtcttcaaggctttaatgcctttggagaaagataaaaaaaagaggataattgaccatatcaacaaaatatcaacaattagaagatgtagcttcttgtcagctgcctctgacatctttagtgcaaagatttctggtacctttaaaaggagtgagcttacccatggaaggaagattttaatgacactagagatgatatcaaaacttattcagagggaaaaatcgatctcagctatcatatcttctgtggcaaacatgatacccgagaaataccttcttgagcaacgagcagtcgttgatgttgatggagggacattgctgaatgaagactatgacatcagatctgttcttcaatacctgttagatgacgtctctgagtttctatccactaaattagttgaagtaaaagaggaaagggaaatatctgaagataagggctgcatttttgttctaaaagcattcattgattatttacttgagcgtgagaaagaaaattttggtgctcggaggaaggacaatgaaaactctgtgacgttgactaccattcatcaggcaaaaggtttagagtgggatgttgtcttcatagttaaggcaaatgactctgagatccctctattacatgatttcaagggcaccgtaaaggacactgcagccttacttgaggaagaaagacgattattatatgttgcaatgactcgtgctcgggagaagctttttattcttcatgttatgatggactcaaactggcagatgcttcaaccttcaagatttttgaaagaaatccctcgtcatcttacagaagttcagggtgaaataagttttcaagaactactgataaagcaagaagctcttcaaaaggaaactgcccattgtaccactgacttgttgataaaagagaaacaatctgaagcagatgtgatccctatgcctcatgaaatacttgataatcattctagtgagacttccaatgagcttgcacaatttgcagaggcaaacaatagaaatgatttcttaagaagatttagtgttgagaacaggtctattgtttcccatttattccatcagtgggccaaaaagaaagcatttcaagatccaaagagattgcttgacaaggttagttttgtaattgatgaacgcctcagacagaagagaaacaaaaacaaggatttgttgaatacattaaaatcttgtttaagctgtgatgaagcatttcagtatgctcaatatgttttgagatgggagcagattcctgctgataaacgtgctcatcttatgagagaaaaacaggaacatttcctgaaattaaagattgagaatgcaatgggttcggcaacaccaactgacaagcagatttcatatttgaaaaaactgggttgcaccgcaatccctacctcccgcctccatgcatctcatcttattgagcaattcaaatcattgtaagaatccagtgtgggaatcttctgtttctcctttccagtctctgtatattgaaggccaagttagtttgcaagcttgcatacaaatttggttaagcaaatagatatgaggacctgtatgaatttttattatctactaaagttaaaattttgcaactgttatgaatggcatttattttctgtagttatcacatttgttttctttgtaaatattcccttgaaatctatatatattaattgtaatgactgtatggttgtcataaaatttataaaagattattgaaaaaaatt

SEQ ID NO: 245 - DNA, 2383 bp, Solanum lycopersicum
aatttcattttccctctttcaccattcctcttcccccctaccggagatatcactccgccgtgtctcagcctctaccggtgccgtcgattcactcttaatgctatcgagggcaatagatgattcgaatatttaggttgctaggtttttgaacaatttgttttggttgtatttgctaaagttgaagtggaagaagatggctgcgaaggttgctgctgcgggtatggtacatcaatcaaatgcacttaattttggtggtggtagttctaaggtcactactaccacattgaaacgaaaaactccatcggagttgcggggagaacaattgaagaaaaagaatattgtggagcttgtggatgaatcaacagtccctaatggtggcccaatgagtggtcttttcccagggcccaagagatgcgatgtatcgaagaacccaagatatgttgatactcgtgtggacgagctatttcctgccagaaaaagtagcatcaggcttaaattggtttcaataaaagaaaatggcaaggaaaattttcaagcagagaatagtgataacactaaaaattgttctattccttcagctttccctactgagaatcaacagcgatctaaatgcccaaaattctctcttgcttcaagtgtaactggaaaagatcatgctactgaaacttgtagcacaagtgaaaggtgcagtgagaatactttccgcagtgtcactgagctgtcactgggtagtgtagatgtacatggcttgtctactgttgatatggataaagccttaagaggactggctactcatgagcatctaggtgctgctgctaaaattgctgaatcctttgaaactgatggtggtattaggtcaaaaaatttctgcccagaattccatgtcccatgcaagatgaccccattggatttgacgatgaaaactaacatacgagttgtatcctcatcttccattaattggtttcataggttgatcaattgtggcgctaacaatgtggtggcgaggtcctcagttaattgtttcacgaaactaaagatgaccagtttatctgaagtgacttctgtttcccaagcgattaatccaatgtcattgcattcctggatgtatcctcagtctcctctaccgccttcagttatatcagctttaaccttgtctgcttcagtgggagggcaactggactttttaagtgaaaggcagctagcatggcaggattcgtttcgaagtttatattacatgcttcggaagaatgtttgcagcatcttctacgtttgcactgctcagtttgtgatcatgttcaccagttcttattcagaggagaacaaatatgtttgtaatgcatatatttctcagtcaacccggggtttgaggtcattactcaaagaacatgatgtttcttattctatgccgctttgccactcaaagttggaggagcttaatacggaagaattggttgagctttcagagattgagaaacaaaatctgggccagactaggcgtcgaagtgcaatgtgcgatgtggataataggccagattctttgctggcattcactggaaataagaatgttcattctttatatgactttctgttgaactatcgatatttcttgacttctctaactggtgtggatgtccctgaattgtattcacctatcccatttgagaatgctgcactcactgctcctgaggtcaaatgcaaggaggtcaggagaattgatcaggcagcttttcaaggaatggagtcaaatgtgacttgtgagcctaatcaacaaccatcttctgggatgtgctatagtgttgaaattaagggccgataccttgccccatgggtaacctctgctatatgtgatgctttcagctctaacagcacaagttttgaggctagttttatcacagagccagcttcagttaacttgaatgccagtctcggcattactgggaaacattctgatcctcaagtttcagcaactgaagccttggacaaggataacctttgtttcggtatcccaaataccaaatcttgttcccagatgaattcaggtttcttaaaggggttgaagtacaatggtggttcttacactgcttttctttcaccggtttgacaccccctcgtctgcaacacattctgggtaaattataaactatcatctgttttttgctgcaatacatctttaccgttgtaaaaactgttcgtgtttcaacgaccttatgtcaaattccagttgtaaaattgttcagtaatcgttcgaccattatagctgtgcaggatttgcaaaatgttgatgatcaatacttttgatttctggtgtatggggtttttgctgtactgaaatatattgcacttgattgagcttattatgctgtcataaatctgcagattttgc

SEQ ID NO: 246 - DNA, 3641 bp, Solanum lycopersicum
gtccgcgtgctttgatggaaaaaataaactgaccccttttggatttatctttatattcttccttataatttgcaaaaattgaaaaaaaaagaaaaggagaaaggattttgctttgatggggtgttgatggagagtaaggcccacttagattgcagagagaaagactctttttgcagggtgggtgtttgttctttggttttggattatttgggcatgctctctgtgtccaattagattgttttcttgtataataacttagattctctctttgctcttttattctccaagaagatgttgtcatgttctgtagtatgttttcattcctcttaagaatcattcccttgacttgaaatgtgggttggcagttatgttagtttgaactaagaaagatgtcatcttgttgacttgctgattggtggttagagggagttctttttttttttttttggaaagatggggtctttggttttggttttggggttgatgtaaagggaatcacagaggtttttatgggttctgttgaagagaagaacaagccagggagtttggttagtggagcacatactctacttgaggaaatgaaattgttgaaggaaatgcaggatcatactgggggaggaagaaagctaattagttctgagttgtggcatgcttgtgctggcccacttgtaactttgcctcaggttggaagccttgtgtattacttcccacaggggcacagtgaacaggtggcggtttccacgaatagaacagcaacttcacagatacctaattatccaaatcttgcttctcagttgttgtgccaagttcacaatgttaccctgcatgcagataaggagacagatgagatctatgcgcaaatgagcctccaacctgtgaattctgagaaagatgtcttccccattccagattttgggctgaagcctaataagcatccaactgagttcttttgcaaaacgttgactgccagtgatacaagcacacatggaggattctctgttcctagaagagcagcagaaaagctgttcccgcccttggattattcaatgcaacctccaacgcaagagcttgttgtacgagacttgcatgataatacttggacattccgtcacatataccgcgggcagccaaagcgacatcttctcacaactggatggagcatgtttgttggagcaaaacgccttagagctggtgactctgttctatttatcagggatgagaaatcacagttgttgcttggagtcaggcgcgctaaccgtcagcaaacttcattgccctcttcagttctgtctgctgatagtatgcatattggagtacttgctgctgctgctcatgctgctgctaatagaagcacattcacaatattctacaatcctagggcatgcccttcagagtttgtcattcctttggccaaatatagaaaatctatttataacacacaactgtctgttggtatgagatttggaatgatgtttgaaactgaggaatcgggtaaacgcagatatatgggcactattagcggaattagtgatttggatccactgagatggcctagttccaagtggcggtgtcttcaggtagagtgggatgagcctggatgtggagacaagcagaatagagttagtccatgggaagttgagacaccagaaagtctcttcatatttccttccctgactgcaggcctcaaacgaccttaccagtctacctttttgggagcacaaactgagtgggacagtttgatgcagcaccgccctttcatgcgtgttcctgaaaatgtatatggggatcttcagagctcctctatctcaaacctatggtcagaacagctaatgaagatgctgataagacctcctcctggccttactggtcttcaatgcggtgttcccacagtacaagacattaaggttgcactacctcaggaagctaggaatgtagtacagccagcaggaaaccaaaaacctgagctaataactgtagaagctacacctgcacaaagtgaaacaaattcggaagttgtccttaatcaacctgttggtgttgtgaactctatttcttcacagcaagcaactctgcaggcgaagtctaaacctccggaaaaagtagaaactgacattattggaaaaaattccgagccaagaaaagaaactagtaattcatcagttaagttagatcagtttcagtgtaatgaagacaaagtggctatcaagcctgcaagtccccatgatcttccaactgatgcgagtgtgacagcttcccaccataacagcttttctcaattacaagctagtccatggctcattcctcataaccctcaaattgattctgctgcttccaacaatatccttcaatgcccaactaataatgagtggaatatgtcctctctccaatctgctgctggattgctcaaatatcctgtgtcgacctccactttgacaaagcatgataattcttttatgttgcctgatacaattggtcatggattagctccaataggccaggatttgtgggatcatcagttgaatgatgttaagtgcttttcccagacaaaccttcaggttccactagacataactaacatgcagttcctacctgattcttatggttttaaggacctgtcagaggagagccataaccaaagtgatatatatagctgtcttaactttgatagtaacagcgggagcacagtgattgataattctgtttcgagcacagtgttagatgagttctgcaatttgaagcatactgatttccagaatccttcagattttctattaggcaacatcagttctagtcaagatgttcaatctcaaattacatcagccagtctggcagattctcagaatttctctgtacaagaatttgctgacaactcgggtggtgcatcatcaagcaatgtaaattttgatgaatgcaatcttttgcagaatagctcatggcagcaagttgctccacgtgtgcggacatatacaaagattcaaaagacaggatctgtaggaagatcaattgatgtctctggtttcaaaaattatgaagagctgcggtctgaaattgaaagaatgtttggacttgaggggcttctgaatgacactcgaggctcgagctggaagttggtatatgtggattttgagaatgatgtcctccttgttggggatgatccttgggaggaatttgttggatgtgttcgatgcatcagaattttatcgcctactgaagtccagcaaatgggagaggaaggaatgcagctactgaactctgctggactgcaaggcatcaatggctcaacatcagaattcccaaactaagctcaatacaagtgatctatgagagctcacagtgattgatcactagagttgcatggagcaacatgcaaatgtaatgttgttgaacaacttaacaagaagatgattcactaggtttctgttatagtagtgttgtaatttatgagtgttgatgactctgtaagaaaacagctttagcatattaaactatgccttccacatattagagttgttttcagctgcatcttgtttgtcttacaaggctgtttcttaatggagaaagttgctatgacttggaaatgaaagtacaatatcttgcattttttgtaagacggtgatttcatagtttgaacttatgatcac

SEQ ID NO: 247 - DNA, 1898 bp, Solanum lycopersicum
aaccctaaacgagttctcttccgctacaattgagcaaacatcgggagagattgagaagtgaaattccatggcgctgtatctattgtatgagtcggcgtctgggtacggtttgtttttggctcacgggattgatgagatagggcagaacacggaggcggtccggaactcaatcgatgacctcaatcgctttgggaaagttgtaaagattgaagcttttaacccttttgagtccgctcttgatgccctaaatcaatgcaatgctgtttctgaaggtcaaatgactgaggagctacagaactttttggagcgtagtctcccaaaagtcaaggagggtaagaaagctaagttcagcttaggattggcagagcctaagcttgggtcacatatccatgaagttactaagattccttgccaaagtaacgagtttgttcttgagattttgcgtggagtacgattgcattttgagaaatttgttaaaaaccttaagcctggtgattcggagaaagcccaacttggtctgagtcatagttacagcagagcaaaggtcaaattcaatgtcaatcgtgttgacaatatggtcactcaggcaatagtcctacttgatactcttgataaagatataaatacctttgccatgagagtcagagagtggtactcttggcatttccccgagttggtcaagattgtcaatgacaactatctatatgccaaggttgcaaaatttgttgatgacaaatctcaattgtctgaagacaaaatttcagcattaactgaaatagtcggagatgaagataaagcaaaagaaatcgtagaagctgcaaaagcttccatgggccaggatttgtcaccagttgacttgattaatgtcaagctatttgcacagagggtaatggaccttgttgaatacaggaagaatctttatgattatcttgtcgccaaaatgcacgacatagcaccaaatttggctgctctgattggtgaagttgtgggtgctcgtttaatttctcatgctggtagtctcacaaatttggcgaagtgcccttcttctacccttcagatcctgggtgctgagaaggcactcttcagggccttgaaaaccaaaggaaatacaccaaaatatggactcatattccattcttctttcattggccgtgcctctgctcgtaataaaggtcgaatggctcgttatcttgcaaacaagtgttctattgcttctcgtctcgactgtttcttagataagagtactactacttttggagagaaactccgtgaacaagttgaggagcgtctagacttctatgacaagggggttgcaccacgaaaaaacctagatgtgatgaaagctgctattgaaaccgtcgaagataaagacacagaaatggacgtggatgagccttccacgaagaaaagcaagaaaaagaaatccaaagttgatgtggtggaatatgctcaacccatgatcgaggataaaccacttgaaacaaatggtgatgcctctgaagaacccaagtctgaaaagaaaaagaagaagaaagagaagcggaaatcagaagaggaggcagagcatgaagaggatcagactgttggtaatggtaatggcgtgcatgaggatggaacagcaaagaagaagaagaaaaagaagaacaaggaggacaatggagaggaactccaagctgctgttgaaattaaaaagaagaaaaagaagtccaaagttcaagatgatgaataaatgtacaattttttctaatcttggtcttgttattttgacggtttttggtcacctcttatagtgcctgtatgctcctaggttagatttttggctgtctttcaatttcgcgtgtatcaaacactcctcttatttactattatcaggatggtcttatcatgattcccttcct

SEQ ID NO: 248 - DNA, 3505 bp, Solanum lycopersicum
gtctcgattaaccggttaaaccccactgccggaaaaaaaagtctcaattctctaaaccctacttcaccggagcgacgttgaatgtaactgccggttaactcgtcgtcggtgactccataacttgtcggaaacctactacgattggttggtagtcttgaagataaattgaaattttgaaggagatattgctaattgcagatcacaaacatgtcagatatcaggaaatggttcatgaagcagcatgacaaaggcacgggtaatgggagcatgtccaagaatagtgcagcagaaaagccttctcccactagtccaaagccagaaaacctggtacaagaaggacaagagactgccaacagaaggaaaactagtaaatattttgctacagacaaggttaaggcaaaggaagaaaaagttgaggaagtgtcagcaaaaagaaaagctccaaatgctgctggaatttcatcagcaccagctgcaaaaagaattcataaagctgaggatgaagatgactttgtaccagtggtatcggcaatgggatccagagatgtcactcccagcaaaaagtcggtaagtggctctggaaggggatcggcgcagaaaaatgtgatcagtgatgatagtgatgatgatcttaagaacaaaaaatctgatctcaaatctgctggaagagggcggggtggacgggcagctaagaccagtggaaagggtgttcctcttgatgaaagtgaagatgatgcttcagctgtcaaggacaacaaatctggtggacgagggcgtggtggtaaaggaccatctgcagcaccaagcggtggacgaggtagaggtggtggaggacggggaggtttcatgaactttggtgaaagaaaagatcctcctcacaagggggaaaaggaagttcctgaaggtgccccagactgtttagctggtttgacttttgtaattagtggaactctcgacagtttagaaagagaagaagctgaggatttgattaaacgccatggtggtcgtgtcacaggatctgttagcaagaaaacaacttatcttttatgtgatgaagacgtcgagggacggaaatcctctaaagccaaggagctcggaactgcatttctcactgaggatggtttgtttgaattgatccggtcatcaaaaaaatcaaaatcagctacacaacccgagtcaaagaaatctgtggacaccattgtttcttctggaaagagaaattcacaaaaaacaagtgatggaacaggaagcactgccacaaagattctagctgccaaacaattggcacctagtgcatctcctgccaaaattagtggatctcctgctaaaagtagtgcatctcctgccaagaagaaaacccaagctaaagagtctttactaccatggacagaaaaatacagacccaaagctattgtagacataatagggaacaagtcactggtggagcagattcagcgttggctagagagctgggatgagcattttctaaaggcatctagtaagggtaaggggaaaaaacaggctgactctggtgctaaaaaagcagttctgttgagtggtatgccgggtatagggaagactacatcagcaaaagtggttagtcagttgctgggatttcaaacgatcgaggtaaatgctagtgatagtcgtggaaaggctgactcaaaaattgagaaaggaataggcggaagtactgctaattccataaaagaacttgttagcaatgaatctctaagcgccaatgttggcagatcacaccatcagaagactgttctgattatggacgaggttgatggcatgtctgctggagatagaggtggtgttgccgatcttattgctagcatcaagatctcgaaaattcctattatctgcatttgcaatgatcgctacagtcagaaattgaagagccttgtcaattattgcctaccaattgtcttccgtaaaccaactaagcagcagatggcaaagaggttaaatcaagtagcaaatgctgaaggcattcaagtcaatgagattgctcttgaggaattggcagaacgtgttggaggagatatgcgtatggctctaaatcaattgcaatacatgagtctctctaagtctgtcatccaatacgatgacataagacgccgccttctaagcagttcaaaggatgaagatatctcaccgttcaaagctgtagaaaagctgtttgattttaattccaagaacttgaaaatagatcaaagaattgacctaagtatgagcgacccagatcttgtcccacttcttgtccaggagaattatctcaactacaaaccaagttctgctggcaaagatgataatgatttaaagcggatgagcctaattgcgcatgctgctgactctattgcaaacagtgacttaataaatgtacagattcgaagataccagcaatggcaactttctccagctggttgcctttcgtcttgcataattcctgcttctttgttgcacggacagaggcagactcttgagcagggagagcgcaactttaacaggtttggcggctggctaggaaagaattctacaatgggaaagaattaccggattctggaggaattgcatgttcacctactcgcatctcgtgaatcttatctgggaagggcaaacctgagacttgactacttttctcttcttggaaagaagttgacagatccattaaaagtgctgcctaaggatgaagctgtagagaatgttgtggctttcatggattcttactctataagccaggaggacttcgataatattgtggagatatcaaaattcaagggacaaccgaatcttctggatggtgtacagcctgctgtgaaagcggcactgacaaaggcatacaacaaaggaagcaaatcacgtgttattcgcacagcagatttaattacccttcccggaattaaaaaagctcctaagaagcgcgttgcagcaatgctggagccactagatgaaggtgtagctgaagaaaatgatgaaacacttgctgaagatgaagagaattcatcagatacagaagacatagatgttgggaaaaaattgcagtcggatcttcagagtctcagttcgagagggatcgaagtaaacatggacttgaagggtgccgggagttcaggtagcaagaagacgtctgcagggagaggacgaggaagaggaagttctaatagcagtgcaaccgctgaatcctcaggtaagagaggtggtcggggttctggagctgctgccaagagaaagaggtgaaactggaaaacatctccttgacctaattctgtcggttacaatcatcggaagctgcagtttccctggtcttcttccttgggaaaaagaagcatttaggaaacttgtttttagctatttgtgtaaaaaaagagaagttcctaagttgatttatgtatattctacttgaaattgatgaatgctttttttgtgttaatagttttggtttgattctcaaattttggcttctattgccattgctttgttcattctgttttactat

SEQ ID NO: 249 - DNA, 3538 bp, Solanum lycopersicum
attttcagatcttcccaaaacccaaacggctaaactctctctctctctctctctctaacagtcactgaaaacccacaaaaaaacactcacaaacacctaaaacacacagtagctcgcacaaatatcattacaaacggagaagaataagttcggttcgttatttttctgtcaaacgcttagaaatacctaaaacacacagtggctcagtcaagtacacctaatagaagcataggttcaccctgtgttcaacgattgaagatgtcgaataaggagaaaggtgtaaacgttcaggttttgcttcgttgcaggccgtttagtaatgatgagttgcggagtaatgctccgcaagtggtaacttgcaatgagtttcagagagaggttgctgtttcacagaacattgctggaaaacacatagatagaatttttactttcgataaggtttttggcccctctgcacaacaaagggacctctatgatcaagcaattatccccattgtcaatgaagttttagaggggttcaattgtacgatttttgcttatggacaaactggtaccgggaagacatacactatggaaggtgaatgcaagaggtccaagagtgggcctaacggagagcttccacaaggagcaggtgttatacctagagccgtcaagcaaatttttgatacattagagagtcaaaatgcagaatacagtgtgaaagttacattcttagagttgtataatgaagaaatcactgacttgttagcccctgaggatttgtgtaaagtcgctttagaagacagacagaagaaacaattgccactcatggaagatgggaaaggtggagttctagttagagggcttgaagaagaaattgtgacaagtgccaatgagatattcaccttaattgaaaggggttcatcaaaacgccggactgcagaaaccttgctcaataagcaatcaagtcggtcacattctcttttttccatcacaatacacatcaaggaagcaacccccgaaggcgaagaactaataaaatgtggcaagttgaatttagttgatttggctggttcagagaatatttctcgctctggggctagggagggtcgtgcaagggaagctggagaaataaacaaaagtctactcacacttggacgagtgattaatgcccttgttgagcatcttgggcatattccttacagggatagcaaacttacacgtttgctacgtgattcattgggaggaagaaccaaaacatgtatcattgccacagtgtcacctgctgtgcactgtcttgaggagactctgagcacactagactatgcccacagagcaaaaaacataaggaataagcctgaggtgaatcaaaaaatgatgaaatcgaccctcatcaaggatttgtatggagaaattgagcggcttaaaggagaggtgtatgctgctcgtgagaagaatggtgtttatataccaaaagaacgatattatcaggaggagagcgagagaaaagcaatgtcagatcaaattgaacaaatgggcgttagcatagaaaaccaacagaagcaactcgaggagttacaaagtagacatgattgtcaggttcaacagtgctcagatttgacttgtaaacttgatgcaacacagaaacaattgaatcaaacaagcaaattgctagcctacactgaggaacagctgagacaaaatctatacactctcaaggagcgggattttatcatctctgaacaaaaaaaagctgaaaatgccctggctcaccaagcatgtgttttacgggctgacttagagaaatcaattcaagagaatgcttccttgtttcaaaaaattgctagagaggataaactgagtactgataaccggtcagtggtagacaactatcaaactgagcttgcaaagcaacttggtagtctttccagcactgtggcaacatctgtgtctcgacaaaacgaacacctccaccacgtcgagaaaatctgtcataattttcttgcatcacacgagaaggctgccttagacttgacgaataaaattaattcttcaaaggccttgtacatatctcactttgaggctatgcaaaatgtagtgaagctgcataaagccacttctaatgctgctctggaggaaatttcgactttggcttcttctaattcaatttccactaaagaatttttagatgcagagtctgttgaaacaaatttaatttttgatgaacttcagaacactctgtcaacccaccaaggagaaatggcaaattttgctagagagcttcgtcagagatttaatgacagtacagagcatttgacaaatatctctgagatcatacaaggattttttgacaaacttttagaagaatcaaaaagacttgaaagacattcaacaacagctgatgagattcaaacgaagtctattgctgaatttgagaaggcatatgaggagcaatcaagatcagatgcagaaaagcttattgctgaggtgacttccttggtctcgaatcacatgcgtcgccaaaaagaactggttggtgcaaggcttggtgatcttagagaaactgtttctggaaataagacattcttggatgggcatgtatcctctatggaaggtattacaacagatacaaaaagaaaatggcaggacttttatacgcaagcagaaggtgagaccaaagaaaatgctgatttctcagctgctaaacattgccgaatggagttactcatgcagaagtgtgtaagcacaagtgaaacaactgtgaaacggtggcaaagtactcatgaattggcaaaagacatgtgcaatcaacatgtttcaacaatgcattcagttgtcaggaacctatgcgatagcaatgagcaacatgttattgaattcgattccacaagggaagctgctgaagaagctgtgaaaaggaatagtgaagatatcattaaatctattgacggcttgtcaggggaagagagaggatctatatctggcattctggatactgccagtgcacactcggagaccctagatgaacttaagaaagatcattgcacacagtctacctccattgaacagaaggccattgaaacatttcagcagaagtttatggattatgagccaactggaacaacaccaattaggtctgaaccagatgtaccaagcaagggaacaattgagtcgttgcgagccatgccaatggagactctactagaggaatttcgagagaacaattcattggagtccttccaagtaaaggaactaaagccatcacttataccacgatctcctctctcactgattaacaattagcagattggtctcatcgttccctcgtgcatatgatcacttaatctgtatcggtattttccttgtatactgagtgaatactgcaaactgcagtatatattgtaggttgattggcacagtcttaaacaataaatcccaccttgggatttagaaaaatggctgtaaatgagtaactcttggtacatttatttagtaaaagatggtgctctctatgtatttgtgaaagtgttattttccttgaagagttgataattcaacc

SEQ ID NO: 250 - DNA, 1114 bp, Solanum lycopersicum
gtcgacttgggcatttgaaattcaaaatccaaaatctcagctttctatcaaaagggccttcaagaagaagaaaacgaagaagcaaatcgccattgaaacgccagaatgggaagacttggagtgaaaactgactatgaagaactccgaaacgctcaaatcatggaaaacaaggcgcgattagccagtcttggacttcaaaaggctgtggcagagctccgatcgatcagatctaaaccacaatctgagaagagaaaacacaacaaagttgactacttctcaacccctttgcgccgatctagtcgattgaaaggaaactcttctgaatcgaattcaagcggcactacgccgctagcgaaaaggaaattggggctttttgatgatgaagatgatgaagatgatattgagaagagaccagctaatgcacctctgttgagagtgaaagatggcttaacgctgcgtcttactccagaagctttagctcggcgttgcacaagcaaggacaggggaacgttatatgacccttatttgggtatttgctgtcacttttgcaggcaaaagaaattatgtggtgaggaagactgtaagcgatgtggtgattcagacatggatcaaccttgcataggcaagacagattgttcaagttgtcattctagccaaggtgttctttgccgaggctgtcttaaggttcgatatggtgaagaaatggaggatgtgagagcaaacaaagaatggatatgtcctcattgtactgaagaaaaaggcatcaatccatattggatatgtaatagctcattgtgcctaaagaagcgaaagatggctccaacggggatcgccatattcagagctagagagatgggatacaaatcagtggcacatctgttaatggatcagcttcagggagcagtgaggggttgatgataaacaaaatttagtgcattgttaacttcttgttggtgaagtaaaattagcttcagaatgtaaaaatgaatgttatgaagaccaatcactggttgtgtaatggcaaggatcctcattttgaaatttatgccaccctttcgtttgaggttataacggagcaaacacttgtgaaattacattgagtatgttgttgtcc

SEQ ID NO: 251 - DNA, 1002 bp, Phaseolus vulgaris
acggccgggatggtttttggaaggtttgatggctgagaaattaagggtagcgagatcgtggaagacgttcaagtaaagtctttgaagcggtacaggggagcattgagagaccgtggaaactcaaaacgacctaagaagacaccaacacaatcctgtactccataggcagttaagaggagttattatagggttcagggaaacatgttgaaacaagcaattggcagaatttgcagaaccagtgcttatgcttttgaaggaaacagagttttgccttggattcgtgtggcttcgtgctttttccacaatggacagacgcacatggcacctagaagcttttttggggtagaggatttccttgatgatgacaatagcagaccttacacataccaaaaagggaagaagtcaaagaatccacacaagcacatatctttcaaacaaagaacgattgcctacatggagccgtttacacttgatgtgtttatctcaaaacgctttgtatccgcttcactcactcacagaatgacaagcaaacaggttgcagttgctggtaccaactccaaggacataaaagctgttctcaggtctcgttcagacataccagcatgcatatccatcggtaagattttatctgaaagagcaagagaagctgatgtttacactgcttcctatactccaagggaaagggacaagtttgaagggaaaatcagagccgtagttcaatcgcttattgataatgggattgatgtcaaggtttatctggactgagttgagtcactcaagattttgtggctatcactttaatatcaattggtgattactggtttggtctcgtggctagttaaggtttatcagttaccatatattgttttaatggataggaagatagacaaacatgtttcttgttaatgaaactaagacaattcatgttgctatatttttgggctagtaatttgggaaaattataactaagaattatctttcaaatccatgcatgcaattgga

SEQ ID NO: 252 - DNA, 4671 bp, Phaseolus vulgaris
cttcagataacataaccccctaatttttgatttttgaaatcccccgcccgttgccaaacagtttctttctctctctttctctgtttcactctctcatgttcctcttcacaacgtttgaaatctgcgacgaataaccctagaaagatgaaccagtaccacatctacgaagccatcggtcgcggcagatactccaccgtttacaaaggcaggaagaagaagactatcgagtatttcgccatcaagagtgtcgataaatcgcagaaaactaaggttcttgaagaggtcaggattcttcacacgttggatcatataaatgtgctgaagtttcatgattggtacgaaacttctgctcacctatggttggttttggagtactgcgtcggaggggatctgctttccatattacgacaggatagtaaacttcccgaagactctgttcacgatcttgcgtatgatctagtgaaagctttgcagtttttacattcaaatggaataatttattgcgacctgaaaccatcaaatattctacttgatgaaaatggatgcgcaaagctatgtgattttggattggctaggaagttgaaagatatatcaaaatctccttcttcctcgttaccacgggcaaaacgtggaacaccctcttacatggctccggagctttttgaagatggtggagttcattcttatgcttctgacttctgggcactaggctgtgtactatatgaatgttatgctgggcggccaccctttgtgggaagagaattcactcagcttgtaaaatccatcatctcagatccgactccacctctccctggtaatccaagtcgaccttttgttaatttaattaattccctgttggtaaagaatccagctgaaagaatacagtggcctgagctttgtggacatgccttttggacgaccaaacttgctctggtgtctctgccttctcaacctgcatttgatgatatgatagagctacatactaaaccttgcttgtcagaacgaaatggagataaatcttctcataaccggacacctcccaaatatcgtgaaaaagatgtcaaaggggtgttgaagaaggacgagaactctgttttaggatctagaggcactgagacaccaacaagggcaacaccaaatggccctagaactcagataaaaggatcaagcagaacaaatgaggtaaagcagaaagaccattccaatgttaagaagggtgtgaatctattgagattgtcaagaatagcgaaaacaaatttacagagggaaaatgagaaagaaaactatcgacgccccttgcctaataattctgagaatgattctgaagttaaaattgagaacactgacatggaacttgattttaatgagaatactgaagatgatacacatgaagaaactgatggcaatgaacaaacaacttctgtgcccgatgagaagatagataatcattttctgaatcagggacaaacagaggagcttgaaaataatacacaccagttggataccccatctgctgttaaccctccagtctcagatgatccaaggtcatttgatcatgaatcaactcctgaccatcctgacatatctggtatttctcccagtgtgagccctcaggtgaaaaagcatagagctaaagaagacacaggatctggccttgactctgattcttcaaggttgtctaacaacctttccgaggttctttggcatccatctgatctctcagtcagacctgtaatgcctagcagaaaagttgataaagtctcagaagtcattccttcactcccttttgaggcattgcaagcgtctgattttgttaagatgcctaaagagcaattggaggcagtccacaaccgaatattaaccattttgaatggaaataccagcattggagagaaacaaaatgtgattaggtatcttgagatgttgagcattaatgctgatgcagctaatatcttgaccaatgggccaattatgctcatgcttgtaaaattgcttcggcaatccaaggcatcagctttgcgtgttcaacttgcttcactgattggtctgttgattaggcactccacttttgttgatgacagtttagctaattctggaattttaggtgcactgactgatggccttagagacaggcaggaaaaagtaaggaggttttccatggccgctttgggtgagttgctattttatatatccactcaaaatgcagactgcagggacaacaatcaacttgaatctccatcaaaggacaacagggcaacatatggctggcaggttccaaattcgttaatttcacttgtgtcatcaatgttgaggaagggcgaggatgatataactcaattgtatgcattgagaacaatagagaatatttgcagtcaaggagggttctgggtggggcgattgaccagtcaagatgtttttagtaatctctgttatatctatagggcggcagggaaacaagagagtatgaggctcactgcaggatcatgcttggtgcgccttgttcgttttaatcctactagcattcagtctgttgttgagaaactctcattcaaggacctagcttctgctcttgtaaagggcagtccacgagagcagcaaatcagcttaaatcttcttaacatagcaatgcttggaagtcacttgttcacaaatattggaagataccttgtacaacttgccgaggataaaaatctgatcccaagtcttttgtctcttgttgagcaaggtagtgaagttttaagaggaaaggcactagtttttgtggctctcctctgtaagcatggcaggaggtggcttccacacttcttttgtagtcaaaagttgctttctgtggtggatagactgggaaaagagaaagattcctatgtgagacagtgtttggatgcatttgtgcatattgtggcatccagtattccaggtttattggatataataacaggggaggtccagcaaatgatgggaggaaggcgccatggacacatctctgcccttaccagcagatcttcaaaagccaacattcatttgtttcctgttgtccttcatcttcttggaacttcaacttttaagcacaaagtcgtgacaccacaagtcgtacttcaattggcgaatctaattaaactcgtcgagacaccatttcagggaagagatgacttccaaataacccttcttcgaattttcgagtctctcacagaggaatctcctataattcttggcaatgctgacattttcatacgtgaaatcctccctagtttgacagttctctacaagggtaacaaggatggtgacgccaggtttttgtgccttaaaattctttttgatgtgatgatcattcttttgagtgaaccaattgacgaagagcaacgattaaaggatctgaaattcatatcaaatacccgttttcttcctctctacccaaccttgattgaagatgaagatcctattcctatttatgcccagaagcttcttgttatgctgctggagttcagttttattgcaattccagacattctacacatgaagacaatttcacaatgctttgagttcttgcttggtgatctctcgaatgcaaatgtgaataatgttaagctgtgtcttgctctagcttctgctcctgatatggagtccaaattactctctcatttaaaggtggttaggaggattggcaacttacttgagtttgtacacgcaaagggcatggaagatttgctggaaccaactcttgggttgtgtagggcttttatagcacgttcagtctgtacaaaaggcttgagcagcacaacagaaccaactctcttaggtgactgtcctcccgagttgagtggtggtgctgtggatccccagcaatgcataaaagatatcgctgactttggaagcaattttggtgtcttgctagagttgagtgcctctgcagaaaccagtattgctgatatagcttctgaatgtgttgttttactgttcaaggcttctcctagagaagccaccactggtatactaaccaatcttcccaaggtcactgtgatcctagagagctggaatagaggcattcctcacttgatggtgcagcgaatgcttcattctctaggttatgcttgcaagcaatacttactgcatgcaatgatattgtcaatatctaaaccggagatttcaagaattgaagttgttgtttctgaactcaaaagttcaggtgtaccagccttagctaaaactgctgcgctagcagccttggaattgcagcggttgcctcgctgcatttgaataattgcggccttgctaaattccagataaagttgagcgtgaattccactcaggctccactgtatttctatgtaaagtaccatggcacacatacttccaaagacagaaggactgtcagatgtgttagaaggtttatttaaataatgttcaagcgacaaaaaaaggtccagccctgcctcctttataaaaattacatctatcatgcaacatagtttcatggagacaatacatctcattcggtcatagaaaacgcaattttttttgaatcattatggttctttctttttgtttgccgggtatttttaaatcacctttgaaagatgaggcactatgattgtgaatttcgtaaagcacgactacagtccgttttcgtgtttgctataattaacaaattagctttaaggatcaacccaaaat

SEQ ID NO: 253 - DNA, 3393 bp, Phaseolus vulgaris
caaacacatttgtgaaccatgttgaggtggcgcactgcgcacccggcttatccaaaatcgtagcattataaaatcgcctcttaacaaatttgctttgtttcacaactgacaccatcttctccacaacaacctcgccggaaaattcatcgccgtttccggtcaccggcgatggcctctgcgacgtcgtttccgggtattgctcttcgtccctccgttccatttcgcagccacataagccacactcgattctcacagtttcaagtctcctttggctttcccgcgaacccaacttcgttgaagagtttgaattcggtgccgtcgaagaaaagagaagctttctcaaatgggtcttcgagaacgcgaagagacctatcgcagttctctgttcgctgctcagtttcatcaagtggaaaaattacacaacaggaattcacagaaatggcatggcaagctattgtctctgcaccagaagtggctaaagagaacaagcatcagattgtggagactgagcacttgatgaaagctttgttagagcaaaagaacggacttgctcgccggatcttttctaaggttgggattgataatactcagcttctagaggccactgataagcacattaagcggcaacccaaggttctaggggaatcagctggtacaatgttggggcgtgatttggaggcattggttcagagagctagggacttcaagaaagaatatggggactcatttgtgtcagttgagcactttgttcttggtttttcccaagataaacgatttgggaagatattgttcagagattttcaaatatccgagcaagctcttaaatctgccatagagtccataaggggacgccagtcagttattgaccaagatcctgaaggaaagtatgaagcattggaaaagtatgggaaagatttgacagcaatggctaaagcaggaaaacttgacccagtcataggaagagatgctgaaatacgcaggtgcattcaaattctctccaggagaacaaagaataatcctgtactaattggagagcctggtgttggaaaaacagcaatctcagaaggacttgctcaaagaattgttcaaggagatgttcctcaagctttgatgaatcgaaggctcatatcccttgatatgggtgcacttattgctggagcaaagtaccggggagaatttgaagatagactgaaagctgtcctcaaagaagtaacagaatctgatggtcagactatccttttcattgatgaaatccatacagttgttggggcaggtgctacaaatggtgctatggatgctggtaatctcttaaagcctatgcttggtcggggggagctgcgatgtattggtgcaacaacattagatgagtatcgaaagtatattgagaaggaccctgcacttgagcgtcgtttccagcaagtttttgttgaccaaccatcagttgaagataccatttcaatactgagggggctgcgggaaagatacgagctgcatcatggagttcgcatttctgacagtgcacttgtagatgctgcaattctctctgatagatacataagtgggaggtttctgcctgataaagctattgatctggtggatgaagcagctgctaaactaaaaatggaaattacttcaaaacctactgcacttgatgagattaatcggtcagtcttgaaactcgagatggagagactctctctcgtgaatgatactggcaaggattctaaagatagattaaatcgacttgagacagaactctctctcttaaaggagaaacaggatgaaatgactgggcaatgggagcatgaaaagtctgtcatgactcgtctgcaatctattaaagaggagatagacagggtaaatcttgagattcaacaggctgagcgagagtatgatcttaatcgcgcagctgaattaaagtatgggagtctaaactccttgcaacgacaacttgaaagtgtagaaaaggagttacacgaatatatgaactctggtaagtctatgttgagagaagaagttactggaaatgatattgctgacattgtaagcaagtggactggtattccaatttcaaaacttcaacaatcagagcgagagaagctgttgtacttagaggaagagcttcataagcgtgttgttggacaagatcctgctgttaaggcagtagctgaggctatccaacgttcaagagcaggcctttcagatccccatcgaccgattgctagcttcatgtttatgggaccgactggtgtaggaaagactgagctagccaaggcccttgcttcgtatttgttcaacacagaagatgcacttgtacgaattgacatgagtgagtacatggaaaagcacacagtctcgagattgattggggctccacctggatatgttgggtatgaagagggagggcaactaacagagacagttcgccgcagaccttatgctgtcattttgtttgatgagattgagaaggcacactcagatgttttcaatgtattccttcaaatcctggatgatggaagagtaactgattcacagggcaggacagtaagttttaccaacacggttatcattatgacctcaaatgttggatcacagtacattctcaacactgataatgacactgtgcccaaagagtcagcatacgaaaccataaagcagagggttatggacgcagcaagatcaatctttcgccctgagttcatgaatagagttgatgagtatattgttttccagcctctggaccgcgaccaaatcagtagtattgtcaggttacagttggagagggtgcaaaagagaattgcagatcgcaagatgaaaatccaagtgacagaagctgcaatccaactccttggaagtttggggtatgatccaaactatggtgctaggccggtgaagcgagtgattcagcagaatgttgagaatgaacttgccaagggtattcttagaggagagttgaaggaagaagacacaattttagttgacacagaagtcacagcattttccaatggtcaacttccccagcaaaagctagtttttaggagggttggaactgattcagaatccagttctactgttaaagacagccgggaaggttttccacagattctgtgaatgctctttgttactccacatgcaaggttccacaacaaattttagtatagttctccttcttacacttctgcaacttcgatgatcctgttcataccatgagataatttttagtttttcatataataacttttgttgatcaatacaaatatcatgctaaagaagtgtttactttatgaaaatcttttttagtgtcaagctggagcagtagtttcaaataacaaatccatacttgtgtgtggtttatggatggattaggagtaaaattttggcattcctgtgata

SEQ ID NO: 254 - DNA, 1484 bp, Zea mays
agcagcgtccgctccaaaacgcaacggtcgaatctcctcgaattcgaattgcagccggtgccacccacctcacatggcggcggcggaagagatgatggcggtgctggacaaggagacgctggcgctgatgggtctgggcaacgccgccgccgcggtggttgccgagtgcgagaagttcaaggagaacgcgaggccgctcaagcgcgggcgcgacgtgtccaaactcaaccacgcgctcaaggcacacgccgatcccgcccagcgcgccactcttctcgaagcccgaaagaagctgattgaggcaatctacgagtaccaaggcgaggatccgctccaaccgtggctggactgcatcaagtgggtgcaggagtattttccgaccggcggcgagtgctcagggttggtggtgttgtacgagcagtgcgtgcggaccttattggacgacgagcgctacaaggacgacctccgcttcctcaaagtgtggctggaatacgcggggaactgtgctgatgctgaggtaatatacaggttcctggaggccaaccagattgggcagggccatgcgatctactacatgtcttacgcatcgttgctggagtcaaagaacaagttgaggaaagctaatgagatctttgaccttggtatagctagaaaagcgaagcctctggagaagttggaagctgtatacagggcatttcttcgaagatcaatcaaaaagagggaacaagaggatgatacagtagatgatgatctgccaaaacgcagtttcgggaataacttgaaacgagatgaaaacagaaatcagcaagcagggaactcccacctggggagaccaagggcactgcagaggccgctttcagtttacaaagatgaaagtccattaccaaatcagggccttgacagagtgaggagcaaagaaaataacacaagttggcgcgtcctcggaacacgagcagaacggaacaaggaaaataacatgatgcctgctaaatggacgtctcacaagattccacagaagttaggagcaagaggagcggttcaatcaacccgagccagttgttccattgaagtcttcgtcgaggaagactgcacacaggaacctgctcggccggtgccaaagagcccaaatccttctgttctgaagctcaggcaaacaacaagcaaaagccttaagaaggagactgaattgctcaaggagaacccgctgcgcaacttccccctgagcaggcttaggtaatcagcatcttgctggttctgagaaacatctcgtacgttatgatttggtcgtatgtatggttgctgtgaggtgttgtgcccaaaaaaggctttattagcctctaaagcttagacgagcaatgtatgcctatggcattatccaagtgatgtaaggctgtgcattatattgacacggcgtgcttattatgaatagacctgcagatctcgtgcgtgcctatgtgaatctagcctcgcaaaataatctgctt

SEQ ID NO: 255 - DNA, 583 bp, Medicago truncatula
cgtcgctcaatttttagggtttagctctcatcgtctctccaaaccttcaccgtccgctcaccctcaccagctgccatggcgagcaccaaagttcagagggttatgacccaacccattaacttgatcttcagatttcttcaaagcaaagcgcggattcagatttggctttttgagcagaaggatttgagaattgaaggaagaatcattggttttgacgagtacatgaatttggttttggacgatgctgaagaagtaaacgtcaagaagaagagcaaaaaaacattagggaggatccttcttaaaggagacaacataactttgatgatgaacacgggtaaatgatgatgatgatctcattggtacggtggttccgttcaacaaggccgatttatctttaccctttcagtttaattactatatctcttgtcaacatgttgaatacgctgcgtgaaaaaagttatgttgacaatatgaaatttttatgcaccaaacaaatactaggtttgttggtccttgtagttatgtcttgttgcttgtattaaagtccaaactccagaatgtaaaccaagctgtggtgattcag

SEQ ID NO: 256 - DNA, 572 bp, Medicago truncatula
aaggtagggtttacacgcagtcgcagaagaattcaacaatggtcaaggttcatgagttgaggcagaaaaacaaaactgatctgttggctcagctcaaagatctcaaagctgaactttctttgctccgagttgctaaggtcactggtggtgcacccaacaagctctccaaaattaaggtggtgaggttgtcgattgctcaggtgttgacagtgatttctcagaagcagaaggctgctttgagggaagtatacaagaacaagaagtatttgccacttgatcttcgcccaaagaagaccagggccattcgcagaaggctcaccaagcaccagtcttcgttgaagaccgagagggagaagaaaaaggagacatatttcccaatgaggaaatatgctatcaaggcataattgttgacaagttttgaatttctacccctgtattttctttattctgtttttctttatcagactcgtggtttccttcctgaagctactagggtttttgcattttgttagtttgtccttaaggaaccatactcattgcggattgttagtctcttcaatgtttaaacttgg

SEQ ID NO: 257 - DNA, 1287 bp, Medicago truncatula
ctctaagatgtgttgggacaatttgacataaaattcaaacgttattttgtttttcccttccaacccattcctgaatgttaccgttacaccactaacgtctctttccatttctattacatcttattcaattttttcatttcaaatcttcaacacaaaaacctcaacaaatcaaaatcaaattcttccattctattacattgatcgaacaaaaatcattctcaaacaacaacaatggcacttagacctattgacaacgctcttccaacaataacccaagaaagacccaaaaaacaacctaaaatcgctctctcaacccaaaaaccacaacattcttccaacgatgaaaatcaaatcccattggaacccaccattgattatatttcatctgataaccttaaacccatgtcagatcctgaagctcagattcaaagtttgattgaagatttggactcaaaaaactgggtcaaggtttgcgagtcgttgaacgatgttaggcgatttgcattgttcaattcgtctcttctattacccattttggataaaattgtgttggtggtggtgaaggcaatgaagaatcctcgtagtgctttatgcaaaacctctattatggctgcttctgatattttcaatgcttttggtgataaattgtttgatccttccatttctgaggcatttgatggcttgctgttgcagctgctgctgaaatcttctcaggataaaaaatttgtgtgtgaagaagctgatagggcacttggatcaatggtggaatccatgacacctcttccattgcttcagaaactaaggttatctgtgagtcacaaaaaccttaggatcagggctaaagctgctgtttctctatccaaatgtgtctccaaaatgggaattgaggaaatggaggagtttgggatggaaaagttgattgaagttgcagctgatttagtgaatgatagactcccagaggcaagagatgcagcaagaagtattgcaacttcagtgtacgaggcaatcattaaggatgtggaagaggaacagaagatggaggtgtggcagagtttctgccactctaagctaacactaattaatgctctttcaattttgaagatagttaaactttagaattggcaaagtatttattttgtgtacgtttgctcatacttgaggcatatttagaagtttagcctttatttgtggcagtgctcatggttctacatgagcagccattggcaaataagatttcattttgtttgatgtagctacattgcttttatatatagttattttataatt

SEQ ID NO: 258 - DNA, 1503 bp, Medicago truncatula
ctaatttcacttcacaaaccctcatttctctacactgcctctcatttctttgaatctttgccgcaaaacccatttcttcctcattcttcactcccttcatcttcatttctcaactgaacatcaaggattgaacaagtgaggcaccatgtcggatgatgaaagggaggagaaggagttggatctcacttcacctgatgttgtaaccaaatacaaaactgcagctgagatcgttaacaaggctctgaagttagttatttcggaatgtaaaccaaaggccaaggttgtcgacatttgcgagaaaggagattcatttattagagagcaaactagtaacgtgtacaagaatgtgaagaagaagatagagagaggtgttgctttcccgacctgtatttctgttaacaacacaatctgccatttctctcctctagccagtgatgagacagtgttggatgaaggcgatatagtcaaaattgatttggcttgtcatatagatgggttcattgctgctgtagctcacactcatgttcttcaggaaggtccggttactggacgggcagcagatgtcattgcggctgcaaacactgctgctgaggttgccttaaggcttgtaaggccaggaaagaagaacaaggatgtatctgatgcaattcaaaaggttgctgctgcctatgattgtaaaattgtggagggtgttctaagccaccaattgaagcagtttgtgattgacggtaacaaggttgtacttagtatctctaatccggatacaagggttgatgatgcagagtttgaggaaaatgaagtttatgcaattgatatagtgacaagtaccggagaaggcaagcctaagttattggatgagaagcagacaactatttataagagggctgttgacaagagttatcacttgaagatgaaagcatctcggttcattttcagtgaaataagccaaaaatttccaatcatgccattttctgctagggctttggaggagaaaagagctcgccttggtttagtggaatgtatgaatcatgagctattgcagccatatcctgttctgcatgaaaagcctggtgattttgttgcacacatcaaattcacggtcttgttaatgccaaatggatcggaccgcgtcacatctcatccactccaagaattgcagcccacaaaaacgatagatgatccagagatcaaggcatggctagccttgggcacaaagacaaagaagaaaggtggcggaaagaagaaaaaaggtaagaaagaggacaaggctgatgagacagcagaagctgagccagtggactcaacaaatgaggccacatctcaggaatgaattgacaccccctcaccctcaatcccaaaaaagaaatgtttttcatttcatttttctgacacccctttcagttttggtacattgttcactaaattatacctttttcgatatgaattttggtatagtgtttagacatcgattctaatagcagttttcagtctcaaatatcaact

SEQ ID NO: 259 - DNA, 699 bp, Medicago truncatula
tgcaaaatgaagattttatacctcctagttagcatcttggctttggcatcctctattgcctttgcttatgaccccagccctctccaagacttttgtgttgcaatcaaagaccccaaagatggtgtatttgtgaatgggaaattctgtaaagaccctgcgcttgttaaagctaaagattttttcaaacatgttgaagctgggaatgcctctaatgccttgggctctcaagtgactccagtcaccgtagaccaactattcggacttaacacacttggtatatctttggctcgcgttgattttgcccctaagggtttaaacccacctcacatccaccctagaggaacagagatccttatagtactcgaaggcactctttatgttggatttgtcacgtccaatcaagacaacaatcgtctcttcaccaaagtgctcaacaagggtgatgtgtttgtgttcccgattggtcttattcattttcagctgaatgtgggatatggcaacgctgttgctattgctggacttagcagtcaaaacccaggagttatcactgtagcaaatgctttgtttaaatcgaatccgcttatttccgacgaagttcttaccaaagcatttcaagtggataagagcataattgattatcttcaaaagcagtcttggtacgacaacaactagttggagaacatgaatataatagtccat

SEQ ID NO: 260 - DNA, 2334 bp, Oryza sativa
cccaccgtctccgagcccaatccaatggcttcctctctcctccgcgcctcgccgctctccctcctctcccgcctaaagccgctcaaccctagccccaccgcctcgcacctccgccgcctcctactgctctccaccgcctcctccacctcgtcggcctcgtgctcgccgtctccgctccgaaccctagcggccaccgacgcggcgaccccgccgccggaggaggaagcggcggcgcccgcggccgaggcgaagcgcgagaggctgcagccgctgcagtggcctgcgagggacgcgctgtgcggcgagctcggcgccggtgacgccggccgccgcgtgcgcctctgcggctgggtcgctctccaccgcgcccacgccggcctcaccttcctcacccttcgtgaccgatccggcacggtccaggtgacaactttgccagaatatccagaagtttatgctgtggtgaacaaactaagagtagagtcagtggttgcggtcgagggggttgttcggtcacgcccaacagaagccatcaacacagatatgaagactggggctatagaggttgctgcagataatatatatgtgctgaactcagtaactcgttcattgccttttccaatcaccactgctgatactgtaaaagagaagtttccagaagaaattagactgagattccgggtgctggacttacgccgaccacaaatgcagtcaaacttgaggttgcgccataatgttgtcaagcatattcgtcgatacttggaggatagacatgattttgttgagattgagactccagttttatctaagtctacaccagaaggtgctcgggactatcttgtcccatcgagagttcagccaggaatgttctatgctcttcctcaaagccctcagctgttcaagcaaatgttgatggtctctggctttgaaaaatattatcagattgcaaggtgtttccgagatgaagatctgcgtgcagataggcaaccagagtttacacaacttgatatggagattgcatttacatcaatggaagatatgttgaagttgaacgaagaattaatgagacatattttccaagaggttggtgatatcaagctgccaaatccttttccaaggctaacctatacggaggcaatgaatcgctatggaacagataggcctgaccttcgttttgattggcagctgaaagatgttagtgatgcatttttgggcagtagcttcaagatttttgcagatacattagaaaacgggggtgtcatcaaggcattatgtgttcctggtggtgccaaagaattttcaaatactgacctaaagaaaggaactgtctacactgaagcttccaaagctggagccaagggcctgccttttctcaaagttatggacaatggagagcttgaaggaattggtccactcgtggcaagtctgaaacctgaaaagaaagagcagttgttgaaacatctagatgcaaaatcaggtgatcttatcctgtttgcactgggtgagcaatcagcggctaatcgaattcttggcagattaagattatttattgctcataagctggaagtgatagatacatcagcacattcaattctttgggtgacggattttccaatgtttgaatggaacagtgatgagcagagatacgaggcactacaccatcctttcactgcaccaaatcctgaagatatgaatgatctaccatcagctcgagccttggcttatgacatgatttacaatggagtggagattggaggaggcagtttgaggatatacaaaagtgatgtacaacaaaggatttttgagatcatcggtatctcacccgagcaggcagaggaaaaatttggctatcttttagaatgttttgacatgggtgctcctcctcatggaggaattgcctatgggttagatcgtttggtgatgcttttggctggtgaaaattcaatccgggatgtgattgctttcccaaagactacaactgctcaatgttcactcaccaaagcgccatctcctgtagatccacagcaattgaaggatcttggcttccgtacgtgaagtgagtgcactgcttgtaacaaggtttgagttatataggaacatccattgtctacaccgggcacccaacctgtcacagcacattcaccttttgcgaatgtgcttctgctcttgagaaattttgaccatggataggctggttgtccatctcatgaatccaataaaaagtttaaagcagatcaatctcttcgtgactattgtcggatagcttgtcaagtgcccaagctatttggctgttgagttacgctgataaacagtagaaaaatttgtatgaggcaatta

SEQ ID NO: 261 - DNA, 1562 bp, Oryza sativa
acttctcgaaccttctccgcctctcctctcttcctccccacctccgtctcctctcttccgcaccggcgaatccccaggcgagccttctagaaccttcgattgctcgggcgggcctcctcctccgcgagccgcagccatggcgaccgtcatgcagaagatcaaggacatcgaggacgagatggcaaggacgcagaagaacaaggccactgcacaccatcttggtcttctgaaggctaaacttgcaaaattacgccgtgagttgctgactcctacatccaaaggtggtggtggcggtgctggcgagggatttgatgtgacaaaaagtggagatgcacgtgttggtttggtgggctttccttcagttggaaaatcaacattgttgaacaagctgacaggaacattttcagaggttgcagcctacgaattcacaactttaacatgtattcctggagttataatgtacaaaggggctaaaatccagcttttagatcttccaggaatcattgagggtgctaaagatggaaagggtagaggaaggcaggttatcagcacagcaaggacatgcaatgtcattctgattgttcttgatgccattaagccaataacccacaagcggcttattgagaaggagcttgagggatttggcattaggttgaacaagacaccccccaatttgacatttagaagaaaggacaagggtggcatcaattttacatcaactgtgacgaacacaaacttggatcttgaaacagtaaaagcaatctgcagtgagtacaggatacacaatgctgatgtctcccttagatatgatgcaacagcagatgatctcatagatgtgattgagggaagcagaatttacatgccttgcatctatgttgttaataagattgatcagataacacttgaagagctggaaatcttggataaacttccccactactgcccaattagtgctcatcttgagtggaatctcgatggtcttctagagatgatctgggaatacctggatttggttaggatatacacaaaaccgaaaggtttaaacccagattatgaggaccctgtaatcgtatcctctaagaagaaaacagtggaagacttctgcaacagaatccacaaggacatggtgaaacaatttaaatatgcattggtgtggggttctagcgtgaagcataagcctcagagagttggcaaggaacatgagcttgaggatgaggacgttgtccagatcatcaagaaagtttaggtatattgtagtggtcacgttctgcaaacctggaaggaggtatgagctatgagaattttgagaagcagtcacttttactgcgtgttattttgctagctatgatgcccatagatgattggctgttcccatgaacgtttcaatgcaatcaaaatgtagacggacagattttccttctgtcaagttagccttgtaattgtgatctttgtctgatcttcctgttgctatatatatggtgagtcaccgatgaacacagcagttgaacacatggaaagatgctttgcttatcttcagaaagatgaaagatgattcacatgct

SEQ ID NO: 262 - DNA, 3113 bp, Oryza sativa
gccgccataaaccctaaccgcagcgacgcactccacctcctcctccaccacgccgccggcggccgggcgccatggtaaaggcctacctccggtacgagccggcgatctccttcggcgtggtcgcctccccggagtccaacgtcgcgtacgacccctccggccgcctcctcctcgccgccgccctcgaccgcttcgccgcctgggacctcaagcgcggcctcccctccctctccttcgccaccgccgccccgtccccctccctcgccgtctcctgcctcgccaccttcccctccgccgcctccgcctccgcctcctcgattgcgagtgggcacgccgatgggagcatcaggctatgggacacggagaccggctcctgtgaggcgaccctccatggccaccgctctgcggcttccgccctcgtattcggcccctctggcgccatcatcgcctctggcagtaaggactgtgacattatcctttgggatgtagttgcacaggccggcctttatcgactccgtggccaccgtgatcaggtcacgggtttggtgtttctggattcagggaagaaactagtgagctgctccaaggataagttaatccgggtttgggaccttgacacgcagcactgccttcagattgttggtggccaccgcagtgaaatatggtcgattgatgtggatcccagcgagaggtttttggtgtctgggtcggccgatcaagagctgcgggtgtttacggtccggaaatctgctgaggagggtgaggattggagcaagtgggatatgctgaagctatttggtgagattccaaggcaaagcaaggaaagggtagcgactgttaagttcaataagaacggtaatcttgtggcatgccaggtggctgggaagacggtggatatttatagggttcttgatgaaacagaggcagcacggaaggccaagaggaggatgcacagaaagaaggagaaggctttggccaaatccatggctgctgaagggaatggtactgttatagatcctttgtcggctcaagacttgcagaatcccactcctgttgtcaccgatatatttaagcttctccatgttttgcgggttaacaagaaaatttgctctgtcgcattttctccaaacaatccaccaaaaggttgccttgccaccttgtctctatctctgaataataacatgcttgagacatactcagtggataatgagaatgtgtcgaatatgtattccattgagatgcatggacaccgttctgatattaggagtcttgcacttaactcagaggacaacctcctgatgtcaacaagtcacaatgctgttaagatatggaatcctagtactggcgactgtctccggacaattgattctgattatggattgtgcagtgcatttgttcctggaaatcggtatgcccttgtaggcacaaagagtggtactttggagattatagatattaatagtggaagctctattgaggttatagaagctcatgctggttccatacgatcaattgtactcattccaaacgaggatggaactgctggtgcatggggttttgtcactggaagtgctgatcatgatgtcaagttctgggaataccaattgatgcagaaatctgataatgactctaagcagctgagcgtaacaaatgtcaaaactttgaaaatgaatgacgatgtccttgcagtaaccatcagtccaactgggaatcatattgctgttgctctcttggatggcgcagtcaaggtcttcactatggactcactgaagtttgcccttaccctttatggccacaaacttccagttctctgcatggatatatcatccgatggagttctaatagttactggttctgcagacaaaaatttgaaaatttggggtatggattttggtgactgccataagtctatatttgcccacacggacagtgtgatggatgttaagtttgtttctaaaacacattatatgttcagtgttgggaaagaccgcactgtaaagtactgggatgctgataaattcgagttgttgttaacactggaaggacaccatgctgaagtttggtgtcttgccatcagcagtcgtggtgattttattgtaacaggttctcatgaccgctctattcggcgttgggatcgtactgaagaacaactcttcattgaggaagagcaagagaaaaggttggaggaaactttcgaggctgatttagatagtgctatggaccacaagtatgggcaaaaagatggtgctcctgatgagggttctgtaggtgttcctggtaggaaaaccaaagagacagtaactgctgctgatgcaattattgatgcacttgacactgccgaggaagaagtaaaacgccttgatcagcaccaggaaggacaaaataatgggaatggaactacatttcaacccaatgttataatgcaagggcagtcaccatcggattatgttttgaatgtagtttcaaatgttcgtccaaatgacttggaacaggctctcctttcattgccattctcagatgcacttaagatcatgtcttacttaaaggagtggtctatggttcctttgaaggttgagcttgtttgtagggtttgcctagtgctgcttcaaacacaccacagccaattaactacgacaccatctgcaagatcgatacttacagaactgaaaggcattctttacagtagagtaaaggaatgcaaggatgctataggtttcaaccttgctgcaatggatcatataaaagaattgttggccatgagatcagatgctcccttccgagatgcaagagcgaagctgatggagatcaggcaggaacaatcaagacgatcggataggtcagatggggctgaaaaaaggaaaaagaaaaagcgaagaacatccggtgagagctgagctttgtgggcgaggcaaagtagttttttttttgtcgtagcatacaaacgatatatcggcgtgctcatattgtgtctacatgagcacgacagaattttggcatatcgagtgtaaaatcaaaacgcgcgttgcgccaaatcttttagatgtaatagcagaatgtgcatttgctcaatcctacgtactccctccgggttaataatatttatcgttttagac

SEQ ID NO: 263 - DNA, 2935 bp, Oryza sativa
ccgccacctagcttaaacccatcctctgtctcgcgccgccgccgccgccgcagcaaaaccctagcctccgccgccgtcgttccctcccgccgcctcgcgatggcttcgtcgcagggcctcaagaagaactaccgctgcgaccgctcgctgcagcagttctacacgggcgggccgttcgccgtcgggagctctcccggaggcggcgaaggcgaagtcgaaggaggcgaggccgaggccgaggcgttcctcgcgtgcgcctgcggcggggaggtgcgcctggtgtccgccgccgacgcgtccgccatcggggagccgatcgagggcgaaaacgaggccgtcacggcgctcgcgctgtcccccgactcccgcctcctcttcaccgcggggcacagtaggcttattcgagtctgggacctcgcgtcccgcacttgcacacgcagctggaaggggcacgatggtcctattagggccatggcctgccatgcttctggtgggttgcttgcaactgctggagcagacaaaaaggtgtgcgtttgggatgttgatggtgggttttgcacacatttctttagaggccacgcaggtgttgtgacgactgttatgttccacaaagatccgaagcgccttctgctattttctggaagtgaagatgccactgtgagagtttggaaccttgaaagcaaaaagtgtgtcgctgtgctgaaagagcatttttcagctgtgacatcattagccttatctgaagatggacaaacattgcttagtgctgggcgggataagattgtgaatgtgtgggatgttcgtaagtacaactcaaagaagacaataccagcatttgaaatgatagaagatgtttccttcattggaccaggaagtaatttattgtcttgtttgggtgaaccggcaaatataaaacgcaaaacagatggttattttcttacggttggtgaacgtggagtagttcgcatctggtgcttggaaagtgctcagtgtatatatgagcagcaatcatccgatgtaaccgttaacacagagaatgaggagtctagaaggggttttacttctgctgttatgttgtcagatgatcaaggactgctatgtgccactgccgatcagcagtttttgttctactgtcccacgagaactgacggaggggacttccagctgaacttatataaacgcctagtaggttataatgatgagattcttgatttgaagtttgttggggaggatgaacaatatcttgctgtagctactaacttggagcaggtccgtgtttatgacgttgcatcgatgtcatgttcttatgtgctgtctggccacactgaaattgttgtttgcatcgacacttgtatttcttcttctgggaagacacttgttgtgactgggagcaaagatagcactgtgagactctgggatatggaaaggagaagctgcattggtattggtaaaggtcatctgggagctattggttccgttgcattctcaaagaaatctaagaatttttttgttagtggaagcagtgatcggaccatcaagatatggagctgggatgatacacttgatgatgttggcagtgaagttcctctcaaagcaaaagctgttgtagctgcacatgacaaagatattaattctctttctgtctcgcctaatgacggtcttgtttgcagtggttctgaggaccgtactgcatgcatatggaaacttccaaacttagtgccctctgttgtccttaaagggcataaaaggggcatttggtcagtcgagttttctcctgtggagcagtgtgtcattacatcatctggtgacagaacagtcaaaatatgggctgttgctgatggttcatgcttgaagacatttgagggccatacatctagtgttttacgagcctcattcctttcacacgggacccaatttgtttcttgtggaagcgatggccttgttaagctatggaccatcaaaacaaatgaatgcattgctactttcgataagcatgatgggaaggtttgggcactggctgttggcaagaaaactgaaatgcttgctactggcggaactgatgctgttcttaacctttggcatgactgtaccatggaagataaacaggaagattttcgtaaaaaggaggaggaactgttgagaggtcaggaattagaaaatgcagtatcagattatgactatgcaaaagcaatacaacttgcatttgagcttagaagaccccacaggcttcttgagttattcacacagctttgcagggagtctgatctggaggacccaatagaaaaagcccttattggtcttccaaaggaagggcttcgcgtacttcttgagtatatccgggaatggaacacaaaacctaagctttgtcatgttgcacagtttgtgctttttcgggtattgaggagcttgcctcccactgatatcctggagataaagggcatcagtgagctccttgagggacttattccatattcacagaggcatttcagcagagttgatagactagtacgaagcacatttttattggattacaccttgacccggatgtctgttgtagatccggacatagatgagggcacaaccagagatgacgcaaatggctcatcagtagagaattgtgaaattgcacaggcgaagcctgatgcattggtagcagaagagaacttgcaaaagtcggtaaagaaaagaaaatcaagcaaatcaagcaaaaaaggcggtaagaaggtgaagattgcgtccacggggggcagtaaggatgttcctattgaggcttaaatagttgacaaaccgcagttatatgttattcgcaccaccaattttgtagctgctgttttatctggtatgttgcagcatgaatcacatgttttaccttttgacccactgtacagaatgcattctttgcttgagttagaaagatctggtggctttcagttct

SEQ ID NO: 264 - DNA, 1996 bp, Oryza sativa
taccgcacagtgaggccacgtcgtagggtttttgcttgcttctcccggctgcaaagcggagccgcggcgcggcccggggacgaggagggaggggagccatggagatcgggcagcatccggcgagcggctactccaaggagcaccagaagacctaccaggagtggttcgccttcgccgactcagatggcgacgggcgcatcacggggcccgacgccatcaagttcttcgccatgtccaagctcccccgcgccgacctcaagcaggtttgggcaatcgcggactccaagcggcaggggtacttaggtttcagcgaattcgtcacggcaatgcagcttgtctctctggcgcaagcgggggatgagatcactcaagacagccttaagcgcgatgacttgggcagcctgaatcctccaacgatggatggtttggatgctctacttgtgaaatcaaagcatcatgctaagagagttgatccagatatcgatggatttcctcaggctcaatctcctgcaacgagccaatggttcagctcaaagtcctcaaagaagatacccctgaatgctgttacttctgtcattgatgggttaaaaaaactatacatcgaaaaattaaagcctttggaagttacatacaaattcaatgattttgtatctccattactgacaaatagtgattttgatgcaaagccaatggttatgcttttaggtcaatattctacagggaaaacaacttttataaaacatctgctcagaacaagctatccaggtgcccatattggaccagagccaacaactgacagatttgttgttgtcatgtcaggaccagatgaaaggactattcctgggaataccatagctgtgcaagcagacatgcctttcagtggtcttacaacatttggaactgcttttttatccaagttcgaatgctctcagatgccacatccactactagagcatatcacctttgtcgacacacctggtgttctctcaggcgagaagcaacggacgcaacgtagctatgatttcactggtgtcacatcatggtttgcggccaagtgtgatcttattcttcttctgtttgatccacataagcttgatatcagtgatgagttcaaacgtgtcattggatctttacgcggacatgatgacaaaatacgtgtagtgctaaacaaggcagaccaagttgacactcagcagcttatgagagtctatggtgcattgatgtggtctcttgggaaagtattgaatacccctgaggttgcacgtgtttatattggatcatttaatgacaaaccagtaaatgaatcagctgttggtccaattggaaaggaactatttgagagagagcaagatgatctactttctgatctgaaagatataccgaagaaagcttgtgaccgtcgaatcaatgaatttgttaaacgtgcaagagcagccaagattcatgcccatataattggtcatttgaagaaggagatgcctgcgatgatgggcaaagccaaagctcagcagcgacttatagacaatttggagaatgagttcgcaaaggtccaaagggaacaacatcttccagctggagatttcccttatgtggagcatttcagagatgtcctgggtgggtatagcattgacaagtttgagaaaatcaagcccaagatggtgcaggcggtggatgatatgcttggatacgacattccagaactcctcaagaacttcaggaacccatacgagtgaatgaacacctttaaattatgaccatggttttcaactttttatcatgatgagagactagtcatattcggagggaatagggatgcgctgcattccatagttttgcaactgtcagaaatctgggattgctgaggtttaggtcttgtaactcttgtagggcgtttattgtggcatactttaccttgttgtataactgcatgcataagaatctgagagccattgctcaattcttttcaacgaagatgtgaactgttggaaggcaatgt

SEQ ID NO: 265 - DNA, 1459 bp, Glycine max
tcggaagctgagggcgccaaacgaaacttttcccggcaaactgcgcgggcgcgaatattcaaaaggtggcgataatccatcatctactatttctttcccacaatctcctccctcattttcccgccatttctcccttcaaaatgcaaacgccaaaatcgacttagcgtcgcgtttgggattcaaacctcaaaatggacgtttccgagctcgccaagaagctcggtctctccgattccaaactcgttgtacggaaagctgccgagctccgtcgcctctgcgaagtccagttcgattcctccgtcattggagtcggcgaggttgcaaaatctatcatatgcttggaaatcgccgccatgagactcagcattctcttcgaccgatcctctgcggcgaggctgagcggaatgtccgaaagagcttacatcagatcctacaattcactccacaacggccttggcgtcaagatgaagttagatgtgagggaattggcgattcagtttggttgcgttcgcattattactctagttcgcgacggtcttaaattatataaggatcggtttgtttcgtcgttgccggcttctcgtcgtgcaagcgctgatttcacgcgtccagtgttcactgctgtcgctttttatctatgtgctaagaaacacaagcttaaagtggacaaacttaagttaattgagctctgtggtacatctgaatctgagttttctagtgtttctgctactatgaaggatttgtgccatgatgtttttggggttgcgaaggaaaagaaggatcctaagcaagtgcagtcaaatcgagatttgcttgatgttttgccaagtaaaaggaaagctgaggatggtggttattcatccgatgatggtccagagctttcaagttataaaaaagccaagaaaatggaaaaacgtgattttgagaaatggaaatcttctgtgcttgcatccaatgaacaaaacaagaaagcgccttgcaagcgaaccagacagactagtctcaactttctcaacaaagcttccgataatcaagagttggaggcaatgtgagatggtattgctgtgttttatggtcaaatatgattttggtggaagttcagctcattgggaaaaaagaaagaatgaagaaagatgacatcaactgatattgaaggtcgcgttctgacgtcttggacaaggtttcagagttgagtatttgacccctggatcaccttaaactcgttcaaaatattctgttgtcacttgggagcccccggaaaaacaaacaactatgggcgtctcggtttataaatttctagaagttatgttttgtagctgtgtccggatctaatacctgtaatttcttttctcaatcatctttttaatttttattcttatttttgtgtgttaatcctcattttataaagagaacgagaacatggttaatttatagtttgatcgcaagctaaataaaattt

SEQ ID NO: 266 - DNA, 5055 bp, Glycine max
cccaaatcttctgaaatcctaaactaagtttctgtgctaagtgctaaccctaattcgttatggcagatggagcggtagcaagagggaggtgacggacgcttttcggagacgcaaattgaggagtagccgcaaagcccagaaaacgccctgaaccctaattcgtggaagacatgggttcagcttctcttctaaatccttctcaaccaggcgttaagaagaatgacaagagcaaacagaaatcggtcgtttccaaaactgaagaggaagttatgtttaaagataaacaaaagaaacggagtttgtcggagagcagtgagcagactgctgctatgcgcaaaatgccaaaacgtgctgcggcatgtaaaaatttgaaggagaaatcctttttgatatatgagaagtcctgcctcattgaaacagagaaggatcatattgtagaagaagaaagtctggctgtccgcatgacagctggacaggataatggttgtccaaataggcgcattacagagtttatccttcatgatgaaactggtaaatcccagccacttgaggtgctggaggttgatgatttgtttatcactggacttgtattgccacttgaagccagctctggcaagaaaaaagagaaaggtgttaagtgtgaaggctttggtcgaattgaatcatgggatatatctggttatgaagatggctctccagtgatatggctttctactgaagttgctgattatgattgccagaaacctgctgctagttacaaaaaagtttacgatcttttccttgaaaaggcccgtgcatgtgtagaagtatacaagaaacttgcaaagtcctctggtggtgaccctgatataagtcttgatgagttacttgctggcatggtgcggtctatgagtggtagcaaatgcttttctggagctgcatctataaaggattttgttatttcacagggtgagttcatttataagcaacttgttggtttggatatgacatccaaggcaaatgacaggatgtttgcagatattcctgctcttattgctcttagagatgagagtaagaaacaagtacatgcacaggtaatgccctcaaatgggagtttaaggattgattcaggagttggagatgaagaaaacaagaatcagatggattcagtagcttctgtaaacgaggaagatgaggatgcaaagctggcacggctgttgcaggaagaagagtattggcaatctatgaaccagaagaaaaactccagatcagcctctgcatcgaacaaatactatatcaaaattaatgaagatgagattgccaatgattatcctctacctgtttattataaaacctcccttcaagaaacagatgagtttatagtttttgataatgactatgacatatatgacactcaagatctccctcgaagcatgctgcataattggtctttatacaactcagatgcaagattggtttccttggaacttctgcctatgaaaccttgttcagatatcgatgttgcaatctttggatcaggtataatgacttcagatgatggaagtgggtttcatcttgatactgaggctggcaaatcttcttccgttggttctggagcacaggttgctgatggaatgccaatttatctgagtgccataaaggaatggatgattgaatttggatcatctatgattttcatatccatccgaactgatttggcctggtatagacttggcaaaccagcaaagcagtatgctccttggtatgacacagtattgaaaactgcaaggcttgctataagcattatcaccttgctgaaggagcagagccgagtatcacgactttcctttggagatgtcatcaggaaagtatctgagtttgataagaaagacggttcttacatttcttctgatccattgactgttgagagatatgttgttgtccatggacagataattctgcaactgtttgcagaatttcctgatgataagatcagaaagtctgcatttgtgacgggtcttacaaacaaaatggaagagcgccaccataccaaatggttggtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaggatgcaaaagagggaattgctagtgagttaaaggatgaggatgaagtggaggaacaagaagaaaatgaagatgatgacaatgaggagacaatacttttggagggaaccccaaaggcacattcagcttcaaagcaaaccaaaaaattttctgctgaaacagaaataaggtgggaaggggaacctgaagggaagactagttctggatatcctgtttataaacaggcaattattcgtggggaagttatttctgtaggaagatctgtgttggtggaggttgatgaaacagatgaatttccagacatatattatgttgaatatatgtttgaatcaaagatcggaagaaaaatgttccatggtaggatgatgcagcgtggttgtcagactgttcttggcaatgctgctaatgagagagaggtgtttttgactaatgagtgcagggatttgggactgcatgatgtcaatcagacagttgttgtaaatattcaaaataggccttggggacatcagcatcgaaaggataatatcattgcagatagagttgacagggctcaagcagaagaaaggaagaagaaaggactacctactgaatattactgtaaaagcctgtactggcctgaaagaggtgctttctttagccttccacttgatactttggggctagggtctggtgtttgcccatcttgcaaaatacaggatgctgaaaaggagaaggatgttttcaaagtaaattcctccaagtctggtttcctattgaaaggaactgagtattctcttaatgattatatttatgtaagtcccttcgaatttgaggaaatgatagagcaaggaactcataagagtgggaggaatgtggggttgaaagcttatgttgtgtgccaagtgcttgagattgttgtcaaaaaggaaattaaagaagctgaaataaagtctacacaagtcaaaatcaggaggttcttccgaccagaagatgtatcaaatgagaaggcatactgttctgatatacaagaggtgtattacagtgatgaaacacatataatctctgtagaatccatagaagggaaatgtcaagtcagaaaaaagaatgatattcccgaatgcagtgcccttggcagaatgttccaaaatgtttttttctgcgagctcttgtatgatcctgccactgggtcactgaagaagttgccggctcatgtaaaagtaaaatattcaagtggacaaacatctgatgctgcagctagaaagaggaaaggaaaatgtatagagggagatgatgttttagagtccccaaatgaaggaaaaacattaaatgaaaaacgtttagcaaccttggacatttttgcaggttgtggtggcttatcagaggggttgcagcagtcaggagtttcatcaactaaatgggctattgagtatgaagaacctgctggggatgcatttaaagctaatcatcctgaggcattggtgtttattaacaattgcaatgttattcttagggctgtaatggagaagtgtggggacacagatgattgtatctcaacatccgaagctgcagaattggctgcaaagcttgatgagaaggaaataagtagtttaccaatgcctggacaagttgatttcatcaatggtggtcctccatgtcagggtttctctgggatgaataggtttaaccagagcagttggagtaaagtccagtgtgagatgatattggcattcttatcctttgccgattatttccggccaaggtatttcttgttggagaatgtgaggaactttgtgtctttcaataaagggcagacattccgtttaactttggcttcacttcttgagatgggctatcaggtgaggtttggtatccttgaggctggagcatatggggtttcccagtcaagaaaaagggcattcatatgggcagcctctcctgaggatgtgcttcctgaatggcctgaaccaatgcatgtcttttcggcccctgagttgaagattacattatcagaaaatgtccagtatgctgctgtccgcagtactgcaaatggtgctccattacgttcaataactgttcaagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaatgaattgaacttgattcgatgccagaaaattcccaagagaccaggcgctgattggcgtgaccttccagaagaaaagataaaattgtctactggacaagttgttgatttgataccatggtgcttgccaaacacggctaagcggcacaatcagtggaagggactgtttggcaggttggattggcaagggaatttcccaacttccattactgaccctcagccaatggggaaggttggaatgtgcttccaccctgaccaagataggattcttactgttcgtgaatgtgctcggtctcaaggcttcccagatagctatcaatttgctggcaatatcatacacaagcaccggcagattggtaatgctgtgcctcctcctctggcatctgcattggggagaaagctcaaggaagcagtggacagtaagagctccacttagaagatggggcttctacattttttgaaatatcatgcttattgtattcatatcagtcaccaagatattgcaaatcattattcagggttccagaaactagaaacccttgtatatagtgatatccattggtcatttgttttgaggctaattccttgtttaactttcctcaaccaaggaattgtatggatgatgttatgatgttcattttctatcaactagtattttcttgatt

SEQ ID NO: 267 - DNA, 1231 bp, Glycine max
acttaaaagcaaaacaatctttcagagaaaatgaagccaaataagcttaaatgtataactacattttttatcctatatttgttcaatcaaaatgctcattctgagctgcaggttgggtattacagctattcatgtagcatggctgagttcattgtgaaggatgaagtcagaaaaggtgttactaataatcctggaattgcagctgggctagtaagaatgcattttcatgattgctttattagagggtgtgatgcatcagtgcttcttgattccactcccttaaacactgcagagaaagactctcccgcaaataaaccaagtctccgaggatatgaagtcattgataatgccaaggctaaactagaagcagtatgcccaggaattgtttcatgcgctgacattgttgcatttgcagcaagggacagtgtggagtttgctcgagggcttggttatgatgttccagcaggaagaagagatggcagaatctcactagcttcagatacaagaacagagttacctcctccaactttcaatgtaaaccaactcactcaactctttgcaagaaagggattaacacaagatgaaatggtcaccctttcaggagcacacaccatcggtcgctctcattgctcggctttcagcagcagattatacaacttcagtaccacttcaagccaggatccaagtttagatccctcatatgcagcacttctgaagcggcaatgtccacaaggcagcacaaaccaaaacttggtggttccaatggacccttcaagtcctggaattgctgatgtggggtactatgttgatatattagcaaaccgaggcctcttcacatctgaccaaactctcttaactaatgctgaaacagccagccaggtgaaacaaaatgccagggatccctatttatgggcaagtcaatttgcagatgcaatggtgaagatgggtcaaatcattgtcttaaaaggtaatgctggagagattagaacaaattgcagggtggtcaatagttagcaatagtggtgaaggactcaagtgcctgcagcaaagaagatttacaaattctaagtcatgtttcttctgagttttttttttcttttcctgcttgattacagagcaagtaactttgcttcttttttgtgtgtatgtgtgtgttaacgtaactgacattcatctgtcggtgaatcaaagttctttctgtttgccctgaaatagatagcttgtcatgtgc

SEQ ID NO: 268 - DNA, 2445 bp, Glycine max
tccgtttctcccaaatctctgtctctgtgattctgacgttctcacttccgagccaacacaaaccctatcaccgttctgcaaagcaaattcctcccatggcggaaaccctaagccccaatcccgcgatgggtcggaagcagagactccgcatccagtctccgaccagccccttcgtcttgggctccaacaacgaccagctcgaacgcgcccgggcacgagacgcacgcgccgccgccaaccgccgcaagagcctcgccctcaaccagcccctccaggccaattcccatcctggcctcaacaaacagcagatcctcgacttgttccaaaactgcatcaaactcgccagcgaaaacaaaattaatcagaaaaacacgtgggagttgaacctgattgaccatcttactgatatcatcaaggccgaagaagagcatgatgcggagactaattttcaaaaggcaagctgcactcttgaggctggagtcaaaatttattcattaagggtggattcagtgcattctgaggcatataaagttcttggtgggatgaatagagcaggccaagaagctgaggaagacactaccctggatggtgttaatattgaaagtagacaagaagaaagcaggaaagaaacgagcaaaaagttgtcacctttgtcaacattggaatcatcttttgaggcacttaatgtaaagaagtttgatgctgcatttgtcgtggatcctctctatcgccaaacaacagcaaaattcgatgaaggtggagccaagggtcttttaatgaataatcttggtgtatatggtggctgtagggtgctctttgattcacaagaagtgcctgctaagtgtatggcaagccaaaatcaatctgatatttcagatactattgatctttcttttctcaaagattgtattgatcagatggtgttggacatgcgtgtaaaggatgaaatttctccaagtctcaggactatagtaaaccaatttgatgaaagtaacagaaggcccactgatattcaacttcaaggcccgagttcagctgaagatcttgacaatgctgataataatgaaaatggttttgatagagaagaatacgagaactgcacggcctggagtgatgatcatgatgaccaaacagttgttgccgatcttgactataatgatgcagatccaagtttttccagttaccctcaggacaatgctgagcaatttccttccccagaaactgatatggatgacagatttgaaaatgttgaggggtatttatttttgagtctgggttttagttcaaaacaaaacgcatgggcagggcctgatcattggaagtatcgaaaatccaaagtctcagaggttcatcctacttctgaagatgggtcgaccctaaaaagtaggcagccaaagagtaagagacaaacagaagttgatttaaatttcacagattctcttgagaaaaaagtgctagatacgttttctcctcccaagaatcccaaattgttactgcttcccgaaagcagattgccttgcaatacaaagcttcctgaggactgccactatcagccagaggatcttgtcaagttatttcttctgtctaatgtgaagtgtctcgggaggaaggcaaacaggttctcagatggatctagagaacaatccaacgaatatgaatcattcccttcgtgggataatggaagtgtttgtggggatgacgctggtgactacggaggtgatcttcatagtgacatggaggactccaacactctaattactcagcctcgtcaggtcaataaaattgaagtccagtatgacaagacttccaaacaagttgatgttcatgcactgaaaattactctttgggaccatgttcaagaatctgttaaacttcctttagagggtcaaaaagatactttatctttcaagaatatattagccaactttcctagcgaatgcaatgctgctgcaacaattagcgacatctctcctcatttgtgcttcatatgtctattgcatttggcaaatgagaaaggattgagcattcaaaactcctccaacttggatgatcttgccatacggcttccacaagttgctgattctataaggggaacagtttagattcctcttcactcaattattcttcagctcaggaatcaaaaaatgatggggactgtttcactgttgagtaacaagtccaagaaagcattgaagtgagtaacaagtccgtctttgtggttggagtttacaaatatcagtttgcttatggtggtttgaacactcggttaaggaaatgtcagactaatcatgatgtcttgttattctgtacatgaaagtattcaaagcatgcattagtgctctaatttcgttttccactccagcccgtttcatgtgtgtctaatgcttaggcttaggcttttacgagaatggctagtgttggtataaataaaagcatagattgatg

SEQ ID NO: 269 - DNA, 1925 bp, Glycine max
acatttattttgctctagggtttcacttctgccttccctcacagtcacattgttcttcccaactcctcagaagttgaatgtagtttggtgatacggagagaggttgccctgtcctgtcggtggctctgatctatgtaaatgctcaatgccctccttgttttctgcggttccatcttggatttttggtatgacatttccacgatgctatatgcttgcttcgccatttcatcactagtgtcttcttgtcttggaagttgctatggaatctaggggttcaacaagctaaataaaaggtgataaagcatggagtttttgaaaatcaagaagttcagaaaatctcagaaagcagatggagaaaaggatttggcagacaaggcagtgcctgagcctgaggaaccaaagctgaacaccgactgtcctgatcagtgtaaatcagaaaacgcagattctgcaggtgaagctgaggatgatgatgattttattactaatgaggttaagaggaggctgaaagaattgagaagaaacagttttatggtgttgattcctgaagaagattcctgcccggaggaaggggaggaggaagaggaagagggagagacgagctcaaatgaatggagggatgtggaggcagaaggtcagcaatggtggcgtggttttgatgctgtgtttgaaaagtactgtgaaagaatgttattctttgatcggatgggcactcaacagcttagtgaagttggcaaaggttcacagtatacttcaactccatctccaagatctgcttcaaagaagctggtttctccccttcgttgtctttccttgaaaaaatttgaagaacctgatgatgagactgaacatcttcaacagcctgagcatgacccctacctggatattgaaacagcatatgtaggtcaaatttgcttgacttgggaggcacttcattgtcagtactctcatatgagtcagaagatatcttggcaacatgataatcctacctgttacaaccacagtgcacaagagtttcaacagttccaggttctattacaaaggtttattgaaaatgaaccttttgagcagggccgtcgagctgaaatttatgctcgcacaaggaacaatttgcctaaactgcttcagattcctaatatacgaggttcagatcatgaattgactgatgattcagagacgagagttcttgctcctgatcttatcaggataattgaaagttctatccttacattccaccttttcatgaaaagggacaagaaaaagtcaagtggtgccaccagtcagaaccagcttgcaactcctctacaacagattcagtcgactcttgaaaagaaagtggcgaagctgaaggaactgcgcagaaagaaaaaaagttggaagaagaattcttggccccaaaagcatgaggacattcatcttttgcttggccttattgacgtgaaaatcctggcaagggttctgaggatgacgaggatgactagagagcaactgttttggtgtgaagaaaagatgaaaaaactggatttatcaaatagtaggttagaaagggatccatgtcccatcctcttcccttgctagggatcagtgttgtatatctgatagatagctgctaattatgtagcatcaactttagttctttgtccttgggggtcgataattgttgctaatacaactgctggttttgaagacgtcatcaaatgggcttctagtatcatcgccctacagctgtttagttttcttggggaagaattcgggctgctgtatgacaatgagaggacaagaatgtttttctgttatctaaaatgtattcttgttctgtcaaaattgtgagtttccaagttgctttgtgaaacctccaatataacattgttgtcgcgaattattcttgttggttcctagactcgatctaatgtttacatcaatgc

SEQ ID NO: 270 - DNA, 3209 bp, Glycine max
cttccattcatttatatcaccatcgccacacacacagcgattgttctcccaaccttaattttcaggttcgagtttcgacgcacgctcttctcttctcttctttcttctcctgagtctgagttgaagaaattactcaactaacgttgataagatgactgtgaaaacacctggaacaccagcttcgaatatagataggactccagtatcaaccccgggaggggcaagagctaaggaagagaagattgtggtcacagtgaggctaaggcctttgaacagaagggagcaattggctaaagatcaggtggcatgggactgcatcaatgattatactattgtgtataaaccaccggcacatgaacgcgcttctcaaccagcatcatttacttttgataaagtttttggtcctgcttcagtaactgaggcagtgtatgaagaaggagtgaagaaaattgcattatctgcattaaccggcattaatgctacagtttttgcttatggacaaactagcagtggaaagacatacacaatgagaggaataacagagaaggctgtcaatgatatctacgagcatattatgaatagccctgaaagggatttcactataaaaatatctggactagagatatacaacgagaatgtaagggacttgttaaattcagaatctggtcgcagtttgaagcttcttgatgatcccgagaaaggtactgttgttgagaaattagtggaagaaacagcaaaagatgacaggcatttgagacatttaatctctatttgtgaagctcaaaggcaggttggtgaaactgctctaaatgataacagttcgcggtctcaccaaataataagactgacaattcaaagtactcttcgtgaaaattctgattgtgtgaaatcttttgttgcaaccttgaactttgttgatctagctggaagtgagagggctgcacagacacatgcggatggcactaggctgaaagaaggttgccatattaaccttagcttgatgactcttacaactgttatcaggaagctcagtgttggaaaaagaagtggtcatataccttacagagattcaaagctcacacgtatattgcaacattcccttggtgggaatgcacgcactgcaattgtttgtactttgagtccagcactaagccatgtagagcaatcacgaaacactctcctgtttgctacaagggcaaaggaagtaacaaataacgctcatgttaacatggttgtatcagacaagcagcttgttaaacatttacaaaaagaagttgcaaggctggaggcagtgttgcgcactcctgatccatctaaagaaaaggattggaaaattcaacagatggaaatggaaattgaagagctgagacgccagagagatcttgcacaaactcaggtggatgaattacgcagaaagcttcaggatgaccagaaggtctcaaacccagttgaatcaccgcatcagccagtcaagaagtgcctgtcattcactggtgcactatcatcactaaaaccagagctaggatgtgagagagtaagaagctcaatattaagacagtcgatgaggcaatcctctactgctccttttacccttatgcatgaaattcgcaaacttgagcacctccaagagcagctgggcgaagaagccaatagagctttggaagtattacaaaaggaagtggcatgtcatagactaggtaaccaagatgcagctgagacaattgcaaagctgcaagcagaaataagggaaatgcgtgctgttaggtcaataacacccaagaatgttggagttggaagcatggtttctatcaacaagagtgtcagtgctaatctcaaggaagagattacccgacttcattcacaaggaagcaccattgcaaatcttgaacagcagcttgaaaatgttcaaaggtccatagacaagttggtgatgtctctcccgaacaacttccaacactcacccaatgaagcatcccctaagaataaaaaggaacacaaaaggaaaaagttgcttcctttgtcttcaagcaatgctgccaatcgccaaaacttcctaagatctccctgctcaccattatctgctacgcagcaagttttggaatctgatgttgaaaatagagcccctgagaatgatgatattgtttcaactgatactcttcctgagtccgagaaggagactccatcaaagagtgaagaagctggagatgtttcatcaaaggaaaataccccagtttatcgacgctctagttcagttaacatgaagaaaatgcagaaaatgtttcagaatgcagcagaggagaatgtaagaagtataagagcatatgtgacagaattgaaagaacgtgtagccaaactgcagtaccaaaagcagttacttgtttgccaggtgcttgaacttgaagcaaacgaagcaaatggccacaacatagacaatgaagagtactcatgtgaaccggaggagccccagatttcgtggcaaatagcatttaaagagcagcggcagcagattcttgaattatgggatctatgttatgtctccattattcacaggacccagttttatttgttattcaagggagacccagccgatcaaatatacatggaagtagaactaaggcgtttgacatggttgcagcaacacctagcagaacttgggaatgcaagcccagctcctcatgttggagaagaacctactatctcattgtcttcaagcattagagctttgaaacgagaaagggaatttctagccaagagactgacatcacgtttgtcgctggaggagagggaggcgttgtatatgaaatgggatgtccctcttgatgggaagcagaggaagatgcagtttatcagcaagctttggactgatcctcatgaccaaatccatgtacaggagagtgcagagatagttgcaaagcttgtgagtttcaggacaggaggcaacatgtcaaaggagatgtttgagctgaactttgtgcttccatctgacaataggccatggttgatgggctggaatcacttgacaaacttgcttaatttgtaatggatttatgtttgtaaagtaccattaaaatcttgtacatgctcattattttggcgcttttctctattcaaaattattgttttggactattttttttccccataagctaatccaattcattggattcccattaggcaaatttccccagatgggacacttttaaaaacta

SEQ ID NO: 271 - DNA, 781 bp, Glycine max
aaacccaatttacgatcacaatctcaaacacctcaacttcatttctctgctccaaagtctcaatcttttatccaaaaactcaaatgggcatggccacaatcacaatgggaggaaaccacaattcctccatcactccacgccactacaacacccacaaggtgttccttttctgcaactacattctcttgggtgcagcttctagctgcatcttcctcaccctctctctgcgcctcattccctctctctgcggcttcttcttcatccttcttcaggtctttacgattgcgggcgcggtctccgggtgcgccgccgtggggactaacaggtggtactctgcacacatggtggccactgttctaacggctatctttcagggttctgtttcggtgttggtgtttacgaggaccggcgattttctgggtcaattgaagtcttatgttagggaggaggatggtgctgtgattctcaaattggctggtggactcaccattttgatcttttgcttggagtgggtggttttgacacttgcatttttcttgaagtattatgcttgtgttgaggggaatagtggggctgttgtgcctgtgaggagtgggaaggtgcagcaggatgaggacttgaaggattggccttggccttttcaagtttgattcttgtgatgacaagaagaaacacaagaataacaatgacatgttccttttgaagttgttgcagctgttttgatgataatctttcaaatatgttgattcgttggagaattggatgcttttttctcctgata

SEQ ID NO: 272 - DNA, 1807 bp, Glycine max
gacccgcatctcattcccgtccccggcgactgagtcgcggtctcttcccaactcggaactcagtccattccgcatttctcttcaaaccaaatttcttctgaagaaggagatttgaattcagaattgagtgagaagaagagaatagaaatgggctccgaattgattttcagaggccacgaggctcagcccgtggacgactcgtactcgccgaagccccacaagccctggttcaccgtgactcgcccgattcactacatgctccgcgagcagcgactcgtcttcgtcctcgtcggcgtcatcatagcaaccctcttcttcacactcgtcccttcctcatcctcttcaagcgttccgtacgagtctctcccgatctcgtacttcgagcgcgagtcaaagattccggcgtaccaccaccgcgtcgctgcggcggtgcactcggtggggaaggtgccgttgggaattaagaggaaggggctccggatcgtggtgaccggcggcgcggggttcgttgggtcgcacctggtggatcggttgattgcgagaggggacagcgtgatcgtggtggacaatttcttcacgggaagaaaagagaacgtgatgcatcattttggaaaccctagattcgagctcattcgacacgacgtcgttgagcctctccttctcgaggtcgatcagatctaccatctggcttgccctgcttcccctgtccactacaagttcaatcccgtcaagactatcaagaccaatgtggtggggaccttgaacatgcttggtctagctaagcgagtgggagcgaggttcttgttgacgagtaccagtgaggtttatggagatcctctgcagcaccctcagaaggagacttactggggaaacgtcaacccaattggtgtccgaagctgctacgacgagggaaagcgtacggccgagacgttgaccatggactaccaccgaggtgccggcgttgaggttagaattgctagaatctttaacacctacgggcctagaatgtgcttagatgatggccgtgttgttagtaacttcgttgctcaggcactaaggaaggagcctttgaccgtttatggagatgggaaacagacaagaagtttccaatatgtctctgatttggtggagggtctaatccgccttatggaaggagaacacgtgggacctttcaatcttggaaatcccggagaatttaccatgcttgaacttgccaaggtggttcaagaaacaatagaccctgatgctaggatagagtacaggcccaacacagaggatgacccgcacaagagaaagcctgatataagtagggctaaggatcaacttggctgggaacccaaggttgacctgcgcaagggcctcccactaatggtttctgacttccggcaacgcatttttggtgaccagaaggaaaaggcatccgtagcctaattctagcatgtcatgtatcttagagccagaaagagaaaaaataatagttcgaggataaccctggcccgcaaaggcccattagtcgtcacagcgttacatgagctctactaaaatgtcccttttgtcgtttgttctccgtcaatctttacatgcgggttatttaccctctttcaagattgacaacccccacccatgatttcatttttcaaattcctgccatctatattctatttctattttttttttttgatgtaattggtacgtgcaagaggctacacttatagtttatttcaacattttaccttcacttgttctatttttattcgaacttcattacttcaccacttatttgcaatttcatctctgaatttgtaga

SEQ ID NO: 273 - DNA, 2519 bp, Glycine max
cgttcatcttcttcctcctctaaccttacatttagcctttctttcttttctatgttctctctatctctcattctcatctcactttcttttctttttcttttcttttcccgaatctgaatttttccctacaaaatccactcactgtcctcaaagacagatccgaaagtggatgccaaatctatcacccctcgtcgcccgagattatcgtacccattagattcttcttccctcttccttctacactttcccaaattttcacactattcgcggctatagagcacaatttagtttatctactcactgttactgcgatttttgtcctacccttttcactattttagctatttctccgatgaagaggaaaagtggtttctttgagtgaccccagaatcgcgattgtgcttcgattcgccgagcaatgggtgttttgtagattctagtttttgatcttattttcgctgatcaaaagttttcttttttgttggtttttgaagtattgggggttagtatagcctgaattttttagttgttaaatacaccttcggatctctgtgttagtggtaaatctcggtggatctgagattgtgctgtaaataaagatgaatcgtttatgagatactcggataaggcaaaaaaaaattttaaaaaaaaaattgaggtgtgtagttgagtgcttttgtaattagttaaggatcaagagattgggcttgtatcatggatcatgttattggtggaaaattcaagcttgggaggaagattgggagtggatcgtttggagagctttacttaggtgttaatgtgcaaagtggggaggaagtggctgtcaagctggaatctgtgaaaaccaagcacccacagcttcactatgagtctaaactgtatatgcttcttcaagggggaactggtataccccatctaaaatggtttggagttgagggtgactacaatgtcatggttattgacctccttgggccaagtcttgaagacttgtttaactattgcaatagaaaattatccctgaaaacagttctgatgctggcagatcagctaataaacagagttgagtacatgcactctcggggttttctgcatcgtgatataaagcctgacaactttttaatgggcttaggccgcaaggcaaatcaggtatacataattgattatggcctggcaaaaaagtatcgggatcttcaaactcacaagcatattccatacagggaaaacaaaaatctcactggaactgctcggtatgcaagtgttaatactcatctgggagttgaacaaagcagaagagatgatctagaatctctcggatatgtgctcatgtattttttgagaggaagtctcccatggcaaggcttgagagctggcaccaaaaagcaaaaatatgacaagataagtgagaagaagatgcttactccaatagaggtcttatgcaagtcatatccattggaattcacatcatacttccactactgccgatcattgcggtttgaagataagcctgattattcttatcttaagagactctttcgggacctatttatccgagaaggttatcagtttgattatgtatttgattggactatgctgaagtatcctcaaattggatccagttctagagcccgaccaagtgggaaaccagtcataaacccaggacaatcaggggagagaatagaacggccttcaggtgcagttgaggcatttgcaaggaggaatggctctggacttgttctacatagtgagctttctaggcataagtcttcagatgatgtgccatcttccaaagacgtgcaagctaattctgagaggcctcgcagctcttctcgtaatggcagttcttcaaaaaagcctgtcttgtctagcagccggccaagctcttctggtgagcctagtgaaagccgttctagccgactggtcttaagcagtggccgactatcaacaactcagagacttcaacctggttttgaatccaaaacatctttatcacgggcttcagcaacaagaggtggtcgtgatgatacactcaggagctttgaactcctgtcacttggttcaggaaaaaggaaatgaagaactgtgtggtcagcagatttcttgtttcaagggtcttagttctgccctgatacctttcctttgagatgtctacacatgttgattacatttgtatatttccatccaatgttgggtcctttcaaggctaaaaagctcattgaaacttgttcctgaagatttgacagactcttctatacctcttcagatgttcttccatgattatttcagcatggacccattcatgaagagatactatgttacttaaggaatttgttaatatatggctacttgtaataaatacatcctctatttttctgttgaaggaaaggaaaagaatctgcaaaaatgcttttggatgttttgcaccctttctatgcatattttatacccaccccgtctatttggttccaatgtacatttgagggaatgaaattgtcaattgttggctctggttatggatagga

SEQ ID NO: 274 - DNA, 3426 bp, Glycine max
tggctcaccattaaatgcaattgcaccatctcaataccctcagcaataactcatcgctgccacatttttctccatccgttccttctttctcctcccttttctttactccttcaattcctttgtctctgtcctctcgtcttctttcttctttctcccttcccagtttctcccttcaaactaagccttttctcatcacaacaacacacacacacacacatcaagcttttttcatggttgccatatgtaagcaactttatttccatatcttcctcagcctttttctatcctatgaatccttgaaaagggtcccttttttggcaacaagcttagccccaaagcagatctaaatactcatcttcttctctagctagctatatatcttctgcagaaactaccaccgactgattctgagaagaaacagatcctgagaagttttttcaacctaaaagggtctcagaaaacacaacactggacacgagagagaactgaaggagacggatcgaaattctctagagtgtgaaatatgccagctggtattatgattccagcaagaaacatgccctcgatgattggaagaaacggaaccgttggtggctttggattatcttcagggctctctcttggccatattgaaaaccataaggcttcggaatctcaaagatctgtagaaatgttccagccaaacctgatggaagctggtcagctccacccactggacatgcctcagaacacttcagagagcgatgtccctagaatccgtgaagatgactttgacagtgccaccaagtcaggtagtgaaaatctagaaggtgcttccggtgaagaccaagaccctcgtcccaacaagaagaaacgctaccaccgccacactcagcaccagatccaggagatggaagcgttctttaaggagtgtccgcaccctgatgacaagcaaaggaaggagctgagtcgagagttagggttagagccattgcaggttaagttttggttccagaacaagcgcactcagatgaagacccaacatgaacgtcatgagaacacacagctgagaactgaaaacgagaagcttcgagcagataacatgaggttcagggaagctctcggcaatgcctcgtgtcctaactgtggtggaccaaccgctataggggaaatgtcattcgatgaacatcacttgaggctcgaaaatgctcgcctgagagaagagattgataggatatctgccattgctgcaaagtatgttgggaagcctgtggtgagctatccacttgtttctccttcatctgttcctcctcgtccactagaacttggggttagtggtggttttggtggccaacctggaggcattggaggggacatgtatggtggagctgcaggagatcttctaaggtcaataagtggacctactgaagctgataagccaatcataatagagcttgctgttgcagccatggaggagctcattggaatggcgcaaatgggtgagcctctttggttgactaccctggatggcaccactgtgctcaacgaggatgagtacatcaggtcttttcctcgagggattggtcctaaacccgttggtttcaagtgtgaagcttcgagggaaactgctgttgttatcatgaaccatgttaaccttgttgagatcctcatggacgtgaatcaatggtccacggtgttctctggcattgtctcaagagcaatgactttggaagtgctatcaacaggggtggcggggaattacaacggtgcattgcaagtgatgacagcagaagtgcaagtaccttcacctctggtgccaactcgagagagctattttgtaaggtattgtaagcagcacggtgacggaacttgggcagtagtggacgtgtccttggataatttgcgtcctagtccttcagccagatgtagaagaaggccctcaggttgcttaattcaagaaatgcccaatggctactctaaggtcatatgggttgagcacgtagaagtggatgacagaggtgtccataatctatacaagcagcttgttagctcggggcatgcatttggtgcaaaacgttggattgcaaacttggatcgacaatgtgaaaggcttgctagtgccatggcaacaaacattcccacagtagatgttggagtaataacaaacccagatgggaggaagagcatgttgaaactggctgagagaatggtcataagcttttgtgctggagtgagtgcatctactgcacacacatggacaacactttctggaactggtgccgatgatgtaagggtcatgacacgtaagagtgtagatgacccaggaaggcctcctggcatcgttctcagtgctgcaacttctttttggcttcctgtgtcaccaaaaagggtttttgaattcctccgcgatgagaactccagaagtgagtgggatattctttccaacggtggagttgttcaagaaatggcacacattgccaatggccgagacactggaaattgtgtctctctacttcgggtgaatagtgcgaattcaagccaaagcaacatgttgatattacaagagagttgcgcggactcaacgggatcttttgtgatatatgctcctgtagatattgtggcaatgaatgtggttctgaatggaggggacccggactacgtggcccttctcccttcaggatttgctatactcccagatgggaccactgcacatggaggtggcattggtgacattggacatggtggttctctcttgactgtggcatttcaaatattggttgattcggttccaacggcaaagctttctcttggatcagttgctactgttaacaatctcattgcctgcactgttgagagaattaaggctgctttatctggtgaagttgcttgacctaatggattatagtttagaagaaggataaaggggtgcattgcattttggacaaatgggaggtgttgggaacttcggcttataccaaaaaggatgagaattgagaagtcaagagcgcaccttgcatgatcctttcttagcacccaacacagtgctgaaaggattaaggttcgggaattgacttccctgaaaatcgtaaatgctaagagcttaaatcaagaccttagtaccttctctcttcaccttcaaagactacatatttatagttagtgttagctttttctatgattattaggttggagctgtgacttaacctcttatgttctttcttctaatgtttttttgtattttataagatcaagcgcgctagccttatagctagtaaatgggaagcttgcaccgttagtgtagtggttaagttctcactacactaccatgtttgaccctttttaaggttttcaaatgaatgttccttccaatttgcccaatctcattcaacaattcaagtctcgtggtttattattttgtgtttgttatttctaccataaatattgttg

SEQ ID NO: 275 - DNA, 1135 bp, Glycine max
ctgaaagtcccaattttccctccacaatttaaatctccctctaaaccaaatcaaatcaaagccacgctcctaatctcaaaatccctccataaatattgaatattgtcttcccttttctcataccaaacacgcctttccgcattcaaactatggcctcttcttcgtccctctcattggacacagccaaagacctttcgaactcatctggtgaggttcatgtcatcgtcggtcccatgttcgctggcaagaccactgcccttctttgtcgcatcgaatccgaactcaacgctgccaagaatgtggtgttgttaaaatcgagcaaggatacaagatatgcaattgactcggttgtgacgcacgatgggattaaatttccttgcagggcgttaccggatctgttgtcgttcagggaaaaacacggcgatgatgcttatcagaagttggatgtgattggcatagacgaggctcaattttttgaggacctatacgagttttgctgcaaggctgctgatgaagatggcaaaaccgtaattgttgcaggcctggatggtgattacttaaggagaagctttggctctgtgcttcacataattccacttgctgattctgtgaccaaactaacagcacgttgtgaactgtgtggcaaacgtgcttttttcaccttgaggaagacagagcagagagagactgaactaattggtggggctgatttgtatatgccggtttgtcgcctgcactacctgaacagccaagttgctgagaggagtgttctcgaatctcaaaattttaaaaccgattgattcccttcttgaggcagctgaagatgtttaagggttattgggaaattggcttgtatgtagcccaccatgtttaattgttcgactgatacatgtttttatctatttgtttttatcacccttttgtataggtacttgagtttcttaatgctcatttcttatgttacatgtttttccttgccttgtaggaaaatttggtggctctattattgtctattctttctttgacgcattcatctacttgaagccatgaaactgctaaacaatatttaaatgcgagtcaaaaacagtcgttaaaatattgattttttaattggtttatgaatctcatgttcaat

SEQ ID NO: 276 - DNA, 1164 bp, Glycine max
ggcgggtgcgaaagttgaaagttgaaaccctaaacggcgggaaaaagagaaacgcccctggcgggaatcaacataaaaaacgacacccacttcgcatgaccaacacttccaattctctttctttctccctctctagggtttcgaagatgttctcgggatcccaattcgacgccaccaccgccttctccggaggcggtttcacgtcctcccagccgtctaccctcaacgattcttctcccgcgccgtcaaacagccgcgaaactccgggtttggtgccggtgacagtgaagcagataagcgaggcctctcaatccggtgatgaaaagtcgaatttcgtgatcaacggtgtagatctgaacaatgtaacactggttgggatgatgtttgagaaagttgagagaaatactgatgtcagttttgttttggatgatggaacaggacgaatcaaatgtcgaagatggattaatgaggcttttgacacaaaggaaatggaggcagtgatgaatgatatgtacgttcgtgtttatgggcatttgaaaagctttcaaggtgttaagcaacttgttgccttctctgtcaggcctgtgacaaattttgatgagatcccttttcactttattgattgcatccataaccatcttcgctccaaaataaaggtggaaggaatcacttctgcaaatccttcatctggctcatctttggaaactcctgtcaaaagtgcaccaaatagatctcaggcatcaaatccagtatgtgcacaacatagcgtggatggacttaagggtattgataaattggttatggactacctggagcagcattcagataggtcagatggacgtggaatacatgttgatgaactatcacgggagctcaagcttccaattgaaaagatcaagttgtcgctgaagactcttgcagatgatggtgaaatatactccaccatagatgacgaccattacaaaaaagcctgatattttatgtaatctgaggaatatagctaaggattgagctggatactataggacatgaaccatgatctattttgatttcaagtttcgagatatgtagatatgtttctggatgaattgatattttatgctcaaactaaaagaatcacttctgttaacgcttaatgatgttataggttgctttgagaaaaaa

SEQ ID NO: 277 - DNA, 1361 bp, Glycine max
tttttttaaattgcactgccccttcgacctctttgccgagcttcagcgctttggtttcggagggaaaactctaaaacctcaaaattttcagtctcaatcaacttaacatctgtgattccaatcgatcacattcaataccacccttcaggattaggtattaattctgttcccttaaataaataacatgagcaccacagtgcaaagaactccaagatccagtaggcagtctttatttttccaggatttggcttcacctgtttctgcccgtagaggaaaattttcgagtcccagtcaggcagctgcagtatcttcactatggcgtgagaactttggtagttcagaccttcctccgcctcctgttttcaccttggaagacagatcagacttttctcctgaatcaggcatactagattatcaaatatcccctgagactaagtcagacactagaactcccatccaaacttcaaataaggagttttctactccagtgaaaagcaaatctgaggccagcacatcttatgctttgagaggggtacaacaaaaccaacagggctcgccaggtttgagttggtggtcacctacaactgcaaagagtggtggggaacaagatgagaggggaagaagttcgccagttgagggtgtggttcagcctggtgctctgataactcttcctccaccgctggaagtggcaaggcctgaggttcaaagaaattctttgccagcagggaatctcaatgaggaagaatgggtaactgtgtacggattttccccaggtgatactaacatggttttaagggaatttgaaaaatgcggtgaaattttgaaacatgttcctggtcctagagatgctaactggatgcacattttgtatcagaatcgatctgatgcacataaagctctcaacaagaatggaatgcaaatcaatggagtgctaattgttggtgtgaaactgttggatcccatgcaacgtcaagctttaaatgaaaggcttaagaatcagggatttatgcccttacctctaccctctgccagaaactcagaagtgagctcattgaaagctccttctcgcccttattatctgcagaatggcaactcaactgcacggcagactggaggaaccattgcttccccaacaaaatcattggtgtccaagatcatggacttgatgtttggagtctaaattagctgttctgctgaatcaaactaatattgttctgtttgttgtaagcaatgattttattctctcgattattcatacttttgaagtgttcggcatgtcttgttcatttaattgagttggaatgtttaaactatggatctcaattgtcagaatttatggcattttaacataccaatcttat

SEQ ID NO: 278 - DNA, 1880 bp, Glycine max
tcttccctcacactcttcagttcattaacaatgcaggcaacagacattattctgctgggcctgggcttgctcttcgtccgctggtggtggcggcgctggtccaccaccggcggcggcccgaagaacctccctccaggccctcccgggtggcccatcgttggtaacctcttccaagtgatcctgcagcgccgtcacttcatttacgtgatccgcgatttacgtaaaaaatacggcccaatcttcagcatgcagatgggccagcgcacgctgatcatcgtgagcagcgcggagctaatccacgaggcactgatccagcgaggcccattgttcgcgagcaggcccagagactcccccatccggctgatcttcagcatggggaagtgcgccatcaactccgccgagtacggccctctctggcgcaccctgaggaagaacttcgtgaccgagatgatcacccccctgaggataaaacagtgcagctggatacgaaaatgggccatggaggcccacatgaaaaggatccaacaagaggcccgcgagcaagggttcgtccaagtgatgagcaactgcaggctcaccatatgcagcatcctcatctgcatctgcttcggcgccaagatcgaggagaaaagaatcaaaagcatagagagcattctgaaggatgtcatgctcatcacgcttcccaagcttcccgattttttaccggttttcactccgttgttccggcgtcaggtgaaggaagctaaggagttaaggaggaggcaggtggagctgctggcgccgttgataaggagcagaaaggctttcgtggaggggaatttgttggagctgggaaatcattatgacatggcgagtcccgttggtgctgcttacgtggactccctgtttaatttggaggtgcctggacgaggacgcttgggggaggaggagctcgtgacgctcgtgtcggagattatcagcgccggcaccgacaccagcgccaccgcggtagagtgggcgctgcttcatttggtgatggatcaagacattcaagagaggttgtataaggagatagtggagtgtgtggggaaggatggtgtggttacggagagtcacgtggagaagatgccttatttgagcgccgtcgtgaaggagactttccggcgacacccaccgagccactttgtgttgtcgcatgccgccacggaggagacggagctgggtgggtatacggttccgaaggaggcgagcgtggagttttacacggcgtggttgacggagaatccggatatgtgggaggatccgaatgagttcagaccagagaggtttatgagtggggatggggttgaggttgacgtgacggggaccaaaggggtgaggatgatgccatttggtgtagggaggaggatttgtccagcgtggactctggggattttgcatataaatttgttgctggccaagatggtgcaggctttccactggttgcccaatcccaacgctccacccgacccgactgagaccttcgctttcactgttgtcatgaaaaaccctctcaagccacttattgtgcctcgatccatttaacacttagttatgtgtgaaaaataacatttgagcagaagggatatatgaggtagatttatttttacagggtattttaatttggatgatatgtcattggtctgctagctcattgcagttagttgccatggaattccaaccttctatgtatctatcattattatttacttacatataggctttatcgcataaaatattgcacaattttattgtagaggagcggaattcgttccaatttgcgtccctactatataatataagtgaaggtgctaatgtgctgtgctatctatataatatagtatcaaatttttatatttgca

SEQ ID NO: 279 - DNA, 949 bp, Glycine max
gaaacctaaattaaaccctagctagataaaagggtttaaagctttgaactttcaagcttctttcttcttcgccaattcagatcgcagacagacacagagagtgagagagggagatggggagcgacagcgaggcagagaagtcggtgcagaaagagaaggagaagaagaagatgttggccctggctcccattgctaaacctcttgctgggaagaagctttgcaagcgaaccctaaaacttgttcgtagagctgccgaacacaaatgcttgaaaagaggagtgaaggaggtcgttaaaagtataaggagaggtcataaaggattgtgtgtgattgctgggaacatatcaccgattgatgtcatcactcatgttcctattctttgtgaagagtctgacattccttatatttatgtcccatctaaagaagatcttgcaggcgcaggagcaacaaagaggcctacttgctgtgttctggtacagacaaagcctgcaaagggtgaaatagagcaaggggaacaagagaaactaaagtcagattatgatcaagttgtagcggaagttactgagcttacaacttcactcttttgaattaagcacacatgtatctactgtttgtttcagctggattaacatgtggtattagtgtgccttacaatcaattgatgtatgaattttattatttttctatcttgcttattattttcttgtcatatagtctaccactgccttatcatttgcataatttgccttgtccaccttcatgattttcccatgaggatgcccgaagcaatcttgatttgaatttggaatcttctctttggtcatagttctctacaatttacagggtttaggattttgatctttttctttccttgattcgtgaatcgcatctagagtaaatgtttctgaaagaagcttattggatgtgtgatgaattcagaaagactggc

SEQ ID NO: 280 - DNA, 2169 bp, Glycine max
tccacgcacgatttggaacttctgaaaacacgctgaaatagatttttttttttgggtataatattgattgtagtagtatttattttatcttctgatattatatttccaattttgctgtcaaaacattattagcgatcaatttgaaattgatacagagctgagagcatcaaggaatcgaagaatagaagattcatttttttttctttttgatatggaagctgatgtttctattatttttgttgcgttttcaaaaccctaaattggagaaatcccaatttctccttctgtctttctgctttggatgtttttcaaccaaaaaattgtgcttttcaaatcttttgctctgatgggtacttcaaatcttctcttgtttttctctctgatgagcctgtgtgctatggcggcttccaaggtggtgcttattgggaataatatcactctctcctttgatgatattgaagctaattttgccccagcagtcaaaggttctggaaaatatggggtcttatatttggcagaaccactggatgcgtgtgcagaattgacaaataaagttgaacaacttcccaatgcgagttcaccttttgctttggtggttagagggggatgtagctttgaggaaaaagtcagaatagcacaaaaggctggcttcaaagctgtaattgtctatgacaatgaagagggtggcatcttggttgcgatggcaggaaattctgctggtataagaatacacgctgtatttgtatctaaagcttcgggtgaaatactaaagaaatatgctgggttgactaatgtggaaatatggctcattccaacttttgaaaactcagcatggtctatcatggcaatttcatttatttccctgctagctatgtctgctgtcctggccacttgtttcttcgtccgcaagcatcgcataagaagagaaaggcctcgagcttctcttgttcgtgaatttcatggtatgagtagtcgcctagtgaaagcaatgccgagtttggtatttacttctgttttggaagataactgtacatcaagaacatgtgctatatgccttgaagactattgtgttggtgagaagctcaggattctgccctgctgtcacaagtttcatgctgcctgtgtggattcgtggcttacttcatggagaaccttttgtccagtttgcaagcgtgatgctagaaccggcttaactgatccaccaccttcagagtccacacccttgctctcatcaaccccagcatctatggcatcctctgtcttatcttctgcaagatcatcactagcttcatcttcagcaatacaaattgcccggacagcatctatggcatcctctgccttaccttctgcgagatcatctctagcttcatcttcagcaatacaaattgcccggacagcatctatggcatcctctgccttacattctgcgagatcatcactagcttcatcttcagcaatacaaatttcccgggcagcttcacagaccccatctgtttcccgtaaccactccatagccagtacaccttatgttcagccatctcttaggtcctcctaccatcaatccccctccctaagcatcagccgaagctccgtagatcttaggaatgcatcccaaagatctctagcttctcacttgaattcaccatgttccatgggatacccatctttgtcatctcttaactcaaggtacatgtctccacacattccaagtccaagcaatgcttcagtaagctatatgggttcatccagtcatcaacaacatcctctccgttatagtgagtcggctgcaagcttctccccatttgcatcgacacactcccttccagaatgttaaattgttcaattgattatatcatatgattgagacgtccacgcagttgaactagtaattgccaagtcttgaactaaaaggtggccatgtgatgaccggtggtctagttgaatagtcctatgtgatgcttggggcattccctacctctgtcatttgacttccgtcttggcacctggtgtacattgtagcttctctctggtgttagtttcgtttacatgtgctggttgaggttcttacatttataggttggagagcttgcatacagtaacttgtgcgtattgtttgtactttgaatgttgacgttttcatggccttgatgtccaagtatagtcaactgc

SEQ ID NO: 281 - DNA, 1980 bp, Glycine max
cggcagtagaaacatgcaaggccaaaatcgtttaaaaccccaaacaaaaccctgcgacgccgcttctcgtcatctctccttttccctctctccggtgctccgccgccacttccgtcgtccaacgagaccgaagccgtgtctctgacaacatgggtgagattcaagagagcaaggctcttgcaaagagcaagccttccactgaacaggacgttactgatgagctagacctaagaatgaagaagtatctcagaggagaaggtgctaatttggagggtttgaaggataaaaagctgaagggtcaactagctgttaaggaagacttatatggaaaatctgcaaaagctgctgctaaggctgagaagtggcttatgcccagtgaaggaggctatctggaggccgaaggcttggagaagacatggaggatcaaacaggaggcaatagctcgtgaagtagatatctcaagctcaggaaaacaatatgatattattttaccagaacttggtccatacactctggattttacttcaagtggtcggtatatggctgtgagtggtcgtaagggccatctggggattgtggacatgataaatctgagcctaatcagagagtttcaggtaagggaaacagtgcgtgatgtcgcattcttgcataatgagctcttttttgttgctgctcagaaaaagtatccatacatctacaatcgagaaggcacagaacttcactgtctcaaggaacatggtccagtgttaaggcttcagtttctggaaaaccattttctcttggcttcaatcaacaagtttggacaacttcgttatcaggatgttacaatgggttccatggttggtaattttcgaactggcttaggacgtacaaatgtaatgcaagtgaaccccttcaatggggttgtttctttaggtcactcaggtggtactgttaccatgtggaagccaaccagtgcttctcctcttgtcaagatgttatgtcatcatgggcctgtctcagcactggcatttcattcaaatggccacttgatggccactgctgggaaagataaaaaaattaagctttgggacttaaggaaatttgaggttcttcaaaccttaccaggtcatgcaactactctggattttagtcaaaaaggcttgcttgcatgcggtaatggttcattgatccaggttctgcgtgatgtttctggcacacaaaattattctaagtatatgactcattccatggtgaaaggttaccagataggaaaattggtatttcgaccatatgaagatgttctaggcatcgggcattccatgggctggtctagtattcttattccaggagcaggagaacccaactttgactcatgggttgcaaacccatttgaaacttctaaacagaggagagaaaaggaaatacggtctcttcttgataagcttccacctgagactatcatgctggatcccagcaagattggtacggtgaaaccaagaagagagaagccaacaaagcaagagagggaggctgaaatagaagctgacgttgaagcggctaagggcaagaaactgaagaagaagacaaaaggaagaaacaagccaggtaaaagggtacagaaaaagcaagaggcagttgctagagtgaagaggccctacttggagcagaaaattcaagaagaggaaagcatatcaagaaagaagcagaagactagggagggtgttgaactaccaaaatctctacagcggtttgttcgtaaaaaggcttcatcatgatttaactgtccaatagagtcttgtattcgtctttactttccccccctattgatgttaagctcttgtttgtatttttttgttgcatttcatatttgtagcctttttagcctttgatgtgatgtttttagcctttaaagtaaaggcatatccaaattttgctttacagaccccttgattagaatttttttttttaatattataagaatcttctttaccttcacaa

SEQ ID NO: 282 - DNA, 1432 bp, Solanum lycopersicum
agctacattgcatgaccaacatatgaggatccaagaaaccttattttattcaaaacaaaatagagccgttacacagaagatcctccaacggctatctttctccttaatctcactcccatgcctcaatcttcctctttatagtcaattgattctccttaaccattttcaatcactgctaaattctctctgttttgtccaaattccctaccttttcttcatttttctgcaaatctctctcaaaaaaaaaaacaattcaagatgaatgatttgatgacaaaatccttcacaagctacattgatctgaagaaagccgccatgaaagatgttgaagctagtccagatttggaaatgggtatgacccaaatggatcaaaatctcactgctttcttagaagaagcagaaaaagtgaaattggagatgaattcaatcaaggagattcttcgtcggttacaggacactaatgaagaaagcaagtcgctgcacaaacccgaagctttgaaatcgatgcgtgatcgcataaattcagatatcgtagcggtgttgaagaaggctagagctattagatctcagctggaagagatggaccgatccaatgcgattaacaggcggctttctgggtgtaaagaagggacgctggtcgataggactcgatctgctgtgactaatgggctgaggaagaagcttaaggaactgatgatggattttcagggactgaggcagaggatgatgactgagtataaggaaactgttggaagaagatattttactgttactggtgaacacccagatgaagaagttattgataagatcatttctagtggaaatggtcaaggtggtgaagaatttctttctagagcaattcaggagcatggtagggggaaagtgttggaaacagtggtggagatacaggaccgtcatgacgcagcaaaggagatcgaaaagagcttgcttgagcttcaccagatattcttggacatggcagtgatggttgaggcacaaggagagaaaatggatgatattgaacatcatgtagtgaatgcagctcagtatgttaatgatggagctaagaacctcaagactgcaaagaagtatcaaaagagcagcaggagatgtatgtgcattggagctataattctccttattctcatcctggtagtcattatccccattgccaccagtttcaccaaatcttgaatatagatagcccccaccacccatactgagcttttgtttcattctttatattcattttagcagttacttttgatcactctcgtgagaaatttcatgtatgtttgctattctatttttcactagtccttttgataggactctaaagtgagtaatgaaccttaatagatttgttgttacaaaacttgaaacatgtctcagtctatagagatttactggcattatatatagaattcatgtt

SEQ ID NO: 283 - DNA, 1647 bp, Solanum lycopersicum
gatgatgaaatatgccaaaatctaatagaaagaaaaaaaagattagctagtactgtactacaattcctcaaatcaactccctttaagactacatagaaatttcagtgtaaattgtgacaaagaaattatagtatggaggcaattaatgctgtaagattgacacctctatctgttctttctgataggaaaaatgaggccaagaaaatcccatcacaccccatttctttcccattcaagaatctttgttcagttgagaatttatcaagaaatgttcaagggggtttagtacttgtatcatcagttctaaatacaggcttagctaaagcattaacatatgaggagacaattgaacaatccgaaacaatcccaggtgctgagtttgatgcaactgcagttgtggaaactgtgaccacttttgcatcagagaatcctattattatagctggtggatttgctgctttggctttgccaattgttctgtttcaggttcttggaaagcctcctaagtcatggggtgttgagtctgccaaaacagcttatgcaaaattggcagatgatgcaggtgcacagttgcttgatataagagcaactgcagaattgagggaagtagggactcctgatattaggggtttgaagaaaaagccagttactgttgtttataaggctgaagataagactggtttcttaaaaaaactgtctttgaagttcaaggagcctgagaatactacattgttcattctagacaaatttgatgggaactctgaactggttgcggagttagtcacagaaaatggatttaaagctgcttatgcaattaaagatggtgctgaaggaccccggggatggctgaacagcagccttccttggattcttcctaagaaaacattgggtcttgatctgagcaatctgtctgatgctcttgatggtgttcttggggaaggttctgatgctgttactgtaggcttaggtgttgctgcagctactggtctggggattttagccttctcagaggtagaaacaattctccaacttttgggttcagctgcacttgtccaactggttagcaagaaactcctgtttgcagaggacagaaagaaaactctgcaacaagttgatgagttcctcaccactaaggttgctccaaaggagctggtagatgagattaagcaaatagggaaggctcttcttccagactcggtgagtagcaatgctctacctgcaccagtagaggcaagccctgctgcagccaccagcactgttgaggaaactgaatcagttcctaaggaggatattgcaccgcctaaagtagaagcaatttccccgcctactccagaagtcagttcagtccctaacgctgaagtcaaagctgatgcactacctgaaagttcaaggccactctcgccttatcctaattatcctgatctcaagcctccaacatcgccgatgccttcacaaccatagaactggacatgcacaggctgccatatagcctaggtaacaacaagcatagctagctatagcctagtttggaatggaagctcctactctgtgaaattttgaatattacataacatttgaagaaaatttctctagtgccagtagagatcatagttctcaacactttaatatgtcttgtattccatcttt

SEQ ID NO: 284 - DNA, 716 bp, Solanum lycopersicum
ataagacacgtggcactaatctctctcatcaccaaaactacaacactctctttttccccaaatcttttcaaaaaacacaaatcaatggcttctccaaccctaatcaccccatctacatcaacccccaaatccctcatcaccccaatccgatcaaaactcatcacctccgtaaccaccaccaccatcaccctccgccgccgcgaattcctctctctgtccgccggaatcctatctccatcccttctccttcccgccacgtcagcattcgcagctaccgacgaggaatacgtgaaggaagcatcggaagtgatacagaaagtgagatctacgttgaatatggataaaggagatccgaatatagctgattcagttgctgagttaagagaagcgtcgaattactgggttgcaaagtatagaagagagaaagctttgttgggtcgggcttcgtttcgtgatatatattcggcactcaacgctgtttcgggccattatgttagtttcgggccgactactccgattccggcgaagagaaaggtgagaatcttagaagaaatggataccgctgaaaaggctttaaagagaggaagataaaacaaaagccaatttttttttttggaattatttaaatttttctatatttaattttctgactatgaaaattatataattatatcatgaagatgaggaagttgaatgaaaagtctaaatttaatttt

SEQ ID NO: 285 - DNA, 747 bp, Solanum lycopersicum
aaaatttatcaaacaaattattcatctcttgctctcaattttcccttttcgaaaccttcgtaatcaatcgaaaaaaattgtttttgagcttaattaacttcatttcatactcaatggctgttttttcaagaaatgtgtttgtaatggcaattctgtttttcagtctattaagcttcacagaagcaagagatcatttggttggtggaaaaactaattcttggaaaatcccgtcttctgaatcggattccctcaatcgttgggctgagaaaacacgattcctcgttggagattctcttgtgtggaagtatgatggggcaaaagattcagtgttggaagtgagtaagaaggattatgtgacatgtaacacatcaagtccaattgcaatgcataatgatgggaacacaaagatagtgttggaacattttggggcatattattttataagtggtgtaaaagggagttgtgaacaaggacaaaaattggttgtggttacgttgtctaagaggagatacgcagatgcaccagtaccgtctccggttgaatttgatggtccagctatagcacctactagcaatggttttagtttgaaggctagtttggttgtggcttttggggttttagtagggttttgggtttgaactgatttttttatttttttttaattattgggaatggtcattatattcttttatttaatttgttgtttactttgccttaatgtttaaataaaaagtttttttttttgtt

SEQ ID NO: 286 - DNA, 1540 bp, Solanum lycopersicum
aaagataaggagagcagagggagtctaccttctccctcaatcaaatggctatggctttttctccattaacaacaagtgggtgtagtagttattgcaatcttggattaagctggaaatcatcgagcttgtttgtggaattagggtttgtttcaaatgggtcaaaaggggtttctgctaaacccgcaaagctcaatgctagtaaagtttttcgggcatgtgcttcttcttctaactctgatcctcttttggtgaaggctgcaagaagagaacgggtgagtcgcccacccgcttggatgatgcgtcaagcgggaaggtatatggctgtttaccgaaagcttgcggagaaacatccatccttcagagagagatcagagacaactgatctcattgtggaaatttctttgcagccctgggaagcttttcatccagatggtgtaatcatcttttcggacatacttaccccgctacctgcatttggtgtccaatttgacattgaagatgtaagaggcccagtcattcagtctcccattcgttctgaagagggattgaaagcattgcactccattgacttggagaaactacaatttgtgggagactcacttagtattttgaggaaggaggttggagaacaagctgcaattttgggttttgtcggagcgccttggacaattgctacctacatagttgaaggaggtacaactcgtacatatacgaagattaaggacatgtgccataccgctcctcatgttttgagagctttgttatctcatttatcaaaagcaattgctgagtatattgtgtatcaagtggagtctggagctcattgcatccagatatttgattcatggggtggacaactcccacctcatatgtgggactgctggtcaaagccttatattgatgagatagttggtataattaaaagaaagtgcccacaaacacctcttgtgctctacattaacggaaatggtggacttcttgaacggatgaaaacaactggagttgatgtaattggacttgactggacagttgatatggcagatggaaggcggcgactaggaacagatattggtatacaggggaatgtggatcccgctaccttgttttgtcctcttcctgcattgacagatgaaattaaaagggttgtcaagagtgcagggagtagtggtcacatcctcaatcttggccacggtgtgctcgtgggtacgcctgaagaagccgtagctcacttctttgatgttgctaagagtttcgattttgacaaggttgaggatcatgtatctgaggcagataaagttgtagcttgaagacaacaattttgtaatgcaggctggaagcctaggatgcttggtttcaccttaggtcctttgagttggttgaggagactaatgcttgtgaataaactagcatctttattttatcttctttttttcgaaatatcgagcaaatttgttatattattagttattctatcagaagggaagttatctctgtgtgacatgtaagtcacggattcaagttatagaatcaatcactttgt

SEQ ID NO: 287 - DNA, 2294 bp, Solanum lycopersicum
acctaaaacgttcttgaaaaactcaaaccgtcaaacgtgtccaatccttatcttttctttttttcaagaattcaattgggtatttgtaaaacaacccaagactggattttttttcattgagtaagaatttggttttgatctgagagtaagagagatggagggtgtagattatttggctgatgagaggaagaaagctggatttgatgtggatgagatgaagattgtttgggctggttctcgtcatgattttgaacttacagatcgtatctctaagcttgttgctaatgatcctggcttcagtaaggagggaagaaccatgctacctaggaaagagctattcaagaacactctaaggaaggcagcatatgcatggaaacggatcattgaacttcgtctatctcaagaggaagccactatgttaaggcgttatgtagatgagcctgcttttactgatcttcattggggaatgtttatacctgccataaaaggacagggcacagataaacagcaggaaaagtggctgccgttggcttacaagatgcaaataattggctgttatgctcaaactgaacttggtcatgggtccaatgtgcaaggccttgagaccactgccacatttgatcctcaaacagatgaatttgttattcatagtccaacattgacatcaagcaagtggtggcctggtggattgggtaaagtgtctacccatgctgttgtgtatgctcgtcttataacagatggtaaagactatggggttaatggttttattgtccaactacggagcttggaggaccacaaacctcttccaggtgttactgttggagacattggaatgaaatttgggaacggagcatacaattccatggataatggggtgttaagctttgatcacgtgcgcattccaagagatcaaatgttgatgagggtttcacaagttacaaaggaaggaaaatatgttcagtctgatattcctcgacaactcctttatgggaccatggtatatgtacggcaatcaattgtagcagatgcttcccttgcaatgtctcgggctgtgtgtattgcaaccagatacagtgccgttcgtagacaatttggctctcagaatggtggacaagaaactcaggtgattgactacaaaactcagcaaaacaggctcttccccttgttggcttctgcatatgccttcagatttgttggtgagtggctgaaatggttgtacactgatgttacccaaagacttgcagcaaatgatttctcaacattgcctgaggcacatgcatgtaccgcaggattgaagtctttgaccaccagtgccactgctgatggaattgaagaatgccgaaagttatgtggaggtcatggttatctttgtagcagtgggcttccagaattatttgccgtttatgtccctgcctgtacttacgaaggagataatgtcgtgctacagctacaggttgcaaggtttcttatgaagaccatttcacaactgggcactggaaagaagccagtaggtaccgtatcttatatgggaagaatcgaacacttgatgcagtgtcgttctgatgtgaaacaagccgaggactggctgaaacctagtgcagtattggaagcatttgaagcaaggtctgccaggatgtctattgcctgcgctaagaatcttagcaagtttgagaatcaagaagaaggctttgcagaactagcagctgatttagttgaagcagcagttgctcattgtcaattaattgttgtgtccaagtatattgagaagttgcaacaaaacattcccggtaaaggggttaagcaacagctggaggtgctttgtggcatctattcactgttccttcttcacaaacatcaaggagattttctcgggactggctacatcacctcaaagcaggggtcgcttgctaacgaccagctcagagccttgtattcccagcttcgtccaaatgctgtatcactggttgatgcatttaactataccgatcactaccttggttcaattcttggacgttatgatggaaacgtgtatccaaaactgtatgaggctgcatggaaggatcctctcaacaaatcagacatagcagatggcttccacgaatatattaggccactactcaagcagcaactacgaactgctaagctgtgaagcgcgagagctgcagcaaactgttgttctgtgctgtgccaataaattagattttgaaatagcaacatcctttatgactattaagttgtgactgatagtattttgttctgaataatattattgaacttttgtaaggaaactgtta

SEQ ID NO: 288 - DNA, 976 bp, Solanum lycopersicum
atttgggttatacccaaacaggcctttacccgttgttcctttacattatctattactcaatcttcgaaagaagatagatagatagagagtcgaaaatggcgatttccgtggcttctcttgcttcatcttttgcttccctttcattttcttctcagatttctcaaaaaccctatgctgtatcccttgctcattcgaagcaattctctttctctctcgcttccaaaatctctacgcttgtagtgtcagcttctgttgctgaagcaccggagacggaggaattggaaaccagagagaatcttttgaagcttgtgaaaagtagacttcctggaggtttcgctgcacagcctatttttggaactggtagacgtaaaagtgcaagtgctcgtgttgttcttcaggaaggttctggaaaaatcatcatcaactatcgtgatgctaaggaatatcttcaaggaaatccattatggattcaatatgtcaaaactccactggccactttaggatatgaggctagttatgacatttttgtcaaggtggaaggcggtggtctttctgggcaggctcaagcaatttcccttggcattgctcgtgcactcctaaaggttagtgagagccatagaaaaccattgagggaggagggtctgttaactagagatgccagagttgttgagcggaagaaagttggtctcaagaaggctcgcaagcgtccacaattttccaagcgttgaggttggtacttactcactgtggcagcatttggtagaaagatttggtggtttattgacccagattgggaaaaaagagcatatcaatgatctgttttgactgttgaagatgagaaaatgtttctgaattatcatcctcaattgcttctttgtaaaaattttgtattagtccctactcagaattacaatttgttctgttgatggtattttttgagtttagtttcttgttcaatgtttaatataattctgga

SEQ ID NO: 289 - DNA, 1403 bp, Solanum lycopersicum
atagtccattctcccagctgtgctgtgcccatacaagtgaattaatagactgctccaaacccatcgcgtgtaacactccaagattcaatctttagatctatacgcttctttatttatatataaaattatcgtgttctcttgtttctgccactcaaacatggagtcttgcatctaccatcagctcaaatcccagcctgtatggcttcttttgcttctttctttaggtttcttgaaagtcttgtgcttttcagtcatctttctcaaatgggtctatgtcaatttcctcagacctgctaagaatcttaagaaatatgggtcatgggcacttgttactggacctacagatggtattgggaagggctttgcttttgaattagctcgaaaagggcttaatctagttcttgtgggtcgtaaccctgataaacttaaggatgtttctgaatcgattaaagctaaatatggacagacccagatcaaaacagtcgtcgttgatttctctggtgatttggatgaaggggttaagaagattaaggagacaattgaaggattggatattggggttttgattaataatgttggggtttcgtatccttatgctagatttttccatgaagtggatgataagctgttggcagatttgattaaagttaatgtggaagggactacaaaggttactcaagctgttttgcctggtatgattcagaggaaaagaggagcaattgttaatattggttctggtgcggctattgttatcccctctgatcctctgtatgctgtttatgccgcaactaaagcatacattgaccagttctccagatgcctctatgtagagtacaagaagagtgggattgatgtgcaatgccaggtgccgttatatgtggcaacaaaaatggcgtcaatcaaaagatcttcattttttgttccctcgactgatggttatgctcgggctgccctgcgatggattggtcatgagccaaggtgcacaccttactggccccattctcttctgtggggtgttctatgttcattgccagagtcgatggttgatgcttggcgtctgaacttctgcattggaattcgaaggagagggcagctgaaggattccaggaagaaagaatagaaagcatctcctttacctcattccatatcttaaaagtttgattagtagacaattaatttccgtctctatttccaattgggtaatgctagttactgtaatgcaactagaagcttgattctgttcttactcattaaacaaggcctagtgttatttttgcaattttagttgtaggctgatcgaatcaagagcgttctaaaagaaattccaactcttaagatactgtttgtatttattctttgagtttgatgttgcagaatgaattttctgtatggtgtttatttca

SEQ ID NO: 290 - DNA, 1225 bp, Solanum lycopersicum
actgtcattgataaagcgataaaattttgtggatcacaagtgaaaacgagtggctctcttcttgacccattaatagtaagtatcagaagaaaccatggccccagattttgcctaccatgaaggcagcagcagcaatggtgaacactgtcactctctctaactcaacattttggcacaaaccaatttcaagaatcaaccagaattttaaaattagagcatcaatttccacctcaggcaacatggttgctcctgctatcatagttggaggtggacgtgtgggaagagctttacaagatttgggtaatggagatgatgttttggttaaaaggggtgaaccagtacctattgattttgtaggtccaatattggtttgcactaggaatgatgatcttgaagctgttcttgaagctacccctaaatctcgttggagcgatttggtatttttccagaatgggatgctagagccttggttccaaagtaaaggccttggtgatgcagaccaagttttggcatattttgctgtatcaaagcttggtgaacccccaactgatgggaaaactgatacaaatccagaaggattgactgcggcttatgggaaatgggcatctgcagtggctgcaagattgcagaatggaggactctcttgcaaggtacttgataaggagccttttcagaagcaaatgctggagaagcttatatggatatgtgctttcatgcttgttggagctcgccatcctggagcaacagtaggagcagttgaaaaagagtaccgctctgaggtgtcaaaactaattgctgagcttgcggctgcagcagctgcagagaaaggtcttgtttttgaggacgccatggaggacaggctctgcgcttactcacgagcagttgcacactttccaacggctgtcaaggagttcaaatggagaaacggatggttctattcactctctgagaaggcaattgcagaagggaaaccagatccatgcccattgcatactgcatggcttaaagaactaaaaatagtctaggataataaccgttatttgatatatattatgattgttgaggtccaaaattttttttggaggatgtatatgataagagctgatgtatcaattcaatttaatgttaaaatcgtactcctatttcatatcataactgctgctaaattgtttcataaaattatgtgtgctatgaataaatcagcatatgagctagacttacacta

SEQ ID NO: 291 - DNA, 934 bp, Medicago truncatula
tttacataagaagaatattaaagagtagtactgagttacaaaaatgaagattatatacttccttgttagcatcttggctttggcatcctctcttgcctttgcttatgatcccagccctctccaagacttttgtgttgcaatcaaagaccccaaagatggtgtatttgtgaatggaaaattctgtaaagaccccgcacttgttaaagctgaagatttcttcaaacatgttgaagctgggaatgcatctaacgcactaggctctcaagtgactcctgtcactgtagaccaactattcggacttaacacacttgggatatctttggctcgcgttgattttgcgcctaagggtttaaacccacctcacatccaccctagaggaacagagatccttatagtacttgaaggcactctttatgttggatttgtcacatcaaatcaagacaacaatcgtctctttaccaaggtgctcaacaagggtgatgtgtttgtgttcccaattggtcttattcattttcaactgaatgtgggatatggcaacgctgttgctattgctggacttagcagtcaaaatccaggagttatcactgttgcaaatgctttgtttaaatcagatcctcttatttccgacgaagttcttaccaaagcttttcaagtggataagagcataattgattatcttcaaaaacagtcttggtatgacaacaactagtcggagaacatgatcagtcgactgtttactctaaattgataggtgtctttaggtttcgaatcaccttgtgcaagcaaccctctctgcttattattattgtaataaataaagttcacatttgttatttgactatatagttgttttgttttcagttgaatttggtttgataatagattgttgtaaaaaacattggatttgtgtaaaataataatttttctatactcc

SEQ ID NO: 292 - DNA, 2178 bp, Sorghum bicolor
ttcctcccttgctctccatcgttcgttcattcatccatctctggtgctgactagcagcaagctcagtcagcacgaaagcattctctttcaaccattgctttgctggatcatatcattacgatacgatagtcagattgtgctgtgcggctgtgccgctctgtcagtctcggctgtgagcctgcctgacccagacacacacacacacacacacacacacacacgagggagagggagagggagagggagagggagagggagggccggccagcgacaccacagcatggcggcggccatcctagcgcccaagccgcctccttcgctgcctacaagcgcctttccttcctccttcccctccccctcgcggctctgcctctccccgcggcatcccctgacaagattgctcctccgccccattccgtgcgcctcatcgccgtcctcctccgtcttgatgccggacccggacccggacctcgagcctgagcctgcccacgatagagatagagcccaagacgaggcgccggagtccaggccccgccgcatcgccctcttcgtcgagccttcgcccttcgcctacgtctccggctacaagaaccgcttccagaacttcatcaagtacctccgggagatgggcgacgaggtgattgtggtcaccacgcacgagggcgtgcctcaggaattccacggggccaagctaattggctcatggagcttcccttgcccctggtatcaaaaggttccgctgtcgctggccctcagtcctcgaatcatcggagaagttgctagattcaagcctgacattattcatgcctcttcccctgggataatggtatttggcgcgcttatcatagcaaagttgctctgcgtccctctggtaatgtcataccacacccacgttccaatttatatacccagatatacattcagctggcttgtcaagcccatgtggctaattataaaattcttgcaccgagctgcggacctcacgctggtaccatccgttgctatcggcagggatcttcaagctgcccatgttacagcagccaataaaatacgcctttggaacaagggtgttgactcagaaagcttccatcctcgttttcgcgatatggaaatgcgttcaaggctaacaaatggcaaaccagaaaagccacttatattttatgttgggcgcttaggagttgagaaaagcttggattttcttaagagagtcatggaccgacttccaggagcaaggatcgcatttattggagatggcccattcagggctgagcttgagcagatgttctcaggtatgccggcggtgttcacgggcacgttgcaaggggaagagctatcacaggcctatgccagcggggatgtgtttgtgatgccttccgagtcagagacgctgggttttgtggtgctggaggccatgtcatcgggaattccggtagtgggggctcgcgctggaggaattcctgatatcatacctgaggatcaggaggggaagaccagctttctgtacacaccaggggatgtggatgactgtgttggcaagatcgggcagcttctgtcaagcgaggagctgagggaggccatggggagggctgccaggaaggagatggagaagtttgactggcgagcagcaacgaggaagatccggaacgagcagtacagtgctgcgatctggttctggcgcaagaagagggcacagctgctgcgacccctccagtgggcgctgcggctgctgaggccgacaacgtctggggctgccattgccgatgccatggcgaagcaatcataggaggcggctattatggttgatggtcccttttccttgtataaaatgggcgaagggcgctatgggcagaggggaggaagctcaagcttcagcattccgattcactgaagatgtaatgaacagtttaggattgttagatttgtaaatcgtccgtgtcaatgtaatgcttcttcttggcttgctacactatatagtagtagcattgatcctttagtaggaaattggtctgcagttgacaatgataataataaatagttgttttttttttgtattcattcagtcagcttgctttctctttctagtagcaaagaaggtgaaacgaactgtaaactgtttcaaacttgtactaggagagtgactgcaaaataaatttcctgcttttgtggtgaaggaagttt

SEQ ID NO: 293 - DNA, 2972 bp, Helianthus annuus
gcaccaccacccaccaccatcaaacgccaccatggtgtcatctcatttgacacccattttatacctcacattgttacttgttacattttcatgtgtatgttctaagactagtaaaccaccggttgcacccaccaagatcggtaatgggtaccggttggtctcacttcaagaatcaccggatggtgggcttgttggtcatcttcaggttaacaagcaaaacaagatttatgggccggatatccctcatttgcaattgtacatcaagcatgaaactgacgaccgtttaagggtacacataaccgacgcacaaaaccaacgatgggaagtaccatacaacctcttaccaagaacacaaccaccaacaccatcacaacaacctttcacccggaccttaaaaaacccgataaccgtatccgaatcctccggaaacgaactaatattcagctacatctccaacccattctcattcgccgtcagaagaaaatccaacggccaaacaatcttcaactcatcatccgacggatccaactcactagtcttcaaagaccaatacattgaaatctcaacaacattacccaaaacggcgtcgttgtatggtcttggtgagaactcacagccacatgggattaaactctacccgaatgacccgtatactttatggactacggatcaatcagctattaatttgaatatggatctttacgggtcgcacccggtttatatggatatgaggaatgtgggtggggacccgtatgcccatggggttttgttgttgaatagtaatgggatggatgttttctataggggtgattctttaacgtataaagttattgggggtgttttggacttttacttctttgcggggcccacgccgttagcggttgtggatcagtatactcagctaattggtcggcctgctgctatgccttactggtctctaggatttcaccaatgtcggtggggttaccacaatctttcagtggtggaagacgtggtagaaaattacaaaaaagccaacatcccattagacgttatttggaacgatgatgatcacatggatggacacaaagacttcactctaaaccccaatgcataccctagagacaaactacttgatttcctacaaagaatacacgcccgtggcatgaagtacattgtcattatcgaccccgggatcggtgtcaacacgtcttacggaacctaccaacgaggtctcgctaaagacgtgtttattaaatacgaggggaagccgtatttggctcaagtgtggcctggggcagttaactttccggatttccttaaccccgccacggttgcgtggtggggagatgaagtccggaggtttcatgagctcgtccccgtcgatgggttgtggatcgacatgaacgaggcttctaatttttgttctgggttgtgcacgcttcctgaaggtaagcagtgtccaaccggaactgggcccggttggatatgttgtttggattgtaagaatatcacaaagacaagatgggatgatcctccttataagattaacgcgtccgggacgcatgttcctatcgggtacaagacgattgctacgagtgcggttcattataatggcgttcgagagtatgatgctcatagtatttacgggttttctcatgctattgcgactcacaaggcgcttcaggggcttgaagggaagcgcccatttatcttatcccgatccacatttgttggatcgggtcattacactgctcattggaccggtgacaaccaaggtacttggaacgatattaagtactcgatatataccatgttgaatttcgggatttttggaattcctatggtcgggtcggatatttgcgggttttacccgcaaccaaccgaagagctatgtaaccgttggatagagttgggtgctttttacccgttttcaagagaccatgcaaattactattctccaagacaagagctttaccaatgggaaacagttgcaacatccgctcgtaacgctttaggtatgcggtacaagctgcttccttacttgtacactttgacttacgaggcgcacaccactggcgcacccatcgctcgccctctctttttctcattcccaaccatccaagaactgtatggattgagcacacagttcttacttggtgagagtctgatggtctcaccagttcttgaccagggtcgaaccaacgtgtcagctgtgttccctcctggaacatggtacagtctgttcgaccccagtcaagcaatcgtttcaaaagatacccaaactttcaccttggatgctcctttgcacgtgatcaatgtccatttatatcaaaataccattcttccaatgcaaaggggaggaatgatatccaaagaagcaagaatgacaccttttacccttatagtaactttcccagcgggggccacggatgccaaagcgaaaggaaagcttttcctcgacaatgacgagcttcccgagatgcaactcgggaacggtcaatcaacttatgttgagtttagcgcgtccacgtctaaagaaatggtgaaagtgtggtcggatgtgcaagagagtaagtttgcgcttgacaaaggttgggttattgagaagatttgcgtgttgggattaagtggcgtcggaagtgcgtttagcgtcgaggtcgagggtaattcagacattttggacgtgtcgaatgtggagttggcgcaaaccgagcataagtttatatacggagcggaggacatgaagagtgtgatggtagaagttggagggttggatctaccagttggtaaaaagtttacaatgtcatggaaaatgggaattagttagttcttaaggggcttgtttgcaaattacatgttcttttgtaccgtttagattgttgtgtacttggtagttggtagggtgcttgaggagaatagaggggccaaaatcaagtgcttcctcttttttttagcttcattttagtggaataaaataatttctctttttt

SEQ ID NO: 294 - DNA, 4260 bp, Hordeum vulgare
aaaaggaagaaactcaaaacactagtaaaaccctagcccaccggagggagcgccgaaaaaaggccggctagtcggagagcttgaggtggctgcagcacagctcgtccgccgccaaagatgttctcgccggcgatcaggaagccccacctccaccgcagggagaaggaggaggcgaccccttcaccccctcctcctgctcccgtccactccccttcgcccggtggattcgccctctccgaccgccccgccactggcaccccggccccatggacctcctcctccctccttgccaggatttcgacatcaaagcagacagacagggctggcgattctggccagatccaaccagtgcacgtagcagagtttccccaagttgtgaggaatgcacaagccaaccttctgcagaagaattttgcaggcaagagtatgcttgtaggcggcattgacaaagaaacatcccttgcatggatgatatgtggaaatgagctttttgtctggagctacttggctgctgttgcaaaagattgtcttgcacttgagatcccgtcttcgcttgtgggagacaaagacggaaaacccctctctggtaaccagtggacggtttgcatcatgagatggcatagtagtggtccatcaacaaggaacagtggagatatgttgcaccgaagaagttcgactggtgtcatcctgtgcaacggaagaacacaagctattgcttattggcctgatatctatgatgaaagtagtagcaagggtccagttcttagtttatttggccagactggcacgtctgcaagtgatgccatatctggatgttacaggtttaactcgctaattgcagcttccgttccaggagccgctcatgaatgtattgcggttgcttctgagccaacaggtgctttatggttgtttcagtgttcaccactgggtattcaccgaagaaaagtccatcatgatacattagaagataatggtactgatcattctcagaaaaataatggtggaagatccttggtttggctaccaagtaatgaatcatccgaggctgctgaatggaagttctttttgttgaccagccatgggatacaatgttggggcatctcactcttgcatggcatcaatgtaaaaatattagggtctcaggaaattgttggtagtgatggtgagttgggcataaaaaaggacatagctggtcaaaagaacatttggcttttggacatgcagatagatgagcgtgggaaggaatttaatattcttgttgctaccttctgcaaagatcgggtgagtgggtcaaactacactcagtattcacttctgacaatgctgtacaaatcaaaccaaaaatttccatccgaaaacaacgtggttaaatgtgaaaggtttttggagaaaaaagctcctgctcaggtaataatcccgaaagctcgagtggaagatgaagaagttttgttctctatgaggctaaaaactggcggcaagccttctggctcagtgatcatcttatcaggtgatggaaaagcaacggtggccatctattggaggggctctacccgactgtatcaatttgatctgccttgggatgctggaaaggtttttgatgcttccattatcccatcttctgaggacagagatgaaggagcttgggttgttctgacagaaaaggcaggcatctgggcaatacctgaaaaggctgtattagttggtggggttgagcctccagaacgcagcttatcacgaaaaggtagctgtaatgaagcggtcgctgaagagaaaaggagaagtcaggcattcagtgccagtattgttcccagaagagttagctctgaggcttggagtgctggagacaggcaaagaccaacattaactggcgtagctcagcaggctgtggttgatgaagaggctgagatgttacttaatcggctgtttcatgattttattttgtctggtgctgttcatgaggcacttcaaaagcttagagtagcaggggcatttgagaaagagggtgagatgaatgtgtttgttcgagtaagcaaatctatcgtaaacacattatctaagcactggacaacaactagagaagctgaatttcttgcttcaacaattgtttcatcccttgctgagaaacgtcaaaaacacgagaaattccttcaatttcttgtcttgtccaagtgccatgaagaactctcttcaaaacaaagagctgcaatgctaagtgtcatggaacatggagaaaaactctctggaatgatccatctgagagaattacaaaatgcgcttagccagcagagttcaagcacacgtttatcacctcagtctaaaaccccaactgctggtgcactgtggaatctcattcagctggtcggtgagaaagctcgacggaacactgttctattaatggaccgtgacaatgctgaagttttctacagtagagtttctgatatagaggatctattttattgtttgtcgcatcaacttcggtatattataaccggagaagaacacccatctgttcagatgcaacgtgcacttgagttatcaaatgcttgtgtgaccttagttcaggcagcattgcactacagagcagagtacaaggactggtatccttctcctgaaggactgacaacatggaacagtcagcctgtagtgcggtctggaatttggagtctggcatcatctgtgatggagcttttgagagaatcaggatctgcaggcatgccaatgaaatctaatctatggtctcagctggaaggactcacagatatgctactggagggatatattggtctattaactgccaaatttgaacgtggggaggaccatggtgtgctagcccaagaatactgtgaacggagagatgaacttcttggatccctttatgaccttgcaaagcaaattatagaagcaaaatatcaggagtcaagagaaggcaatgacaatcctaatctgaaagaatctatatttagagaggtcacttctcctattttggcaacagctaaacggcatgaagggtaccaaactttgtggcagatttgctatgatatcagtgatacggttctcctccgcaatcttatgcatgatagtgtaggacctcatgggggattcagtttctacgtttttaaacaactaatcaacagccggcattacgcaaagttgttaaggctgggagaagaatttcaggaagagctagctaattttctgaaagaccgcagcgatcttttgtggcttcacgagatatgtttaaatcagttctcagctgcttcagagactcttcatacctgtgctctgctttcaagtccgggagaagatgttgacctaacaagcaccagaaagtcgatgtcctttgttgaaagaagacgtctcctctatctctctaaaattgctgcaaccgcaggtaaggatgttgattatgaagtgaaggttgcacagatagatgctgatatccggattctgaaacttcaggaagagattgttcagcatgatccagaatatgcacagggcaaacatacaagcaagcttcttaggccatcagaactgatcgagatgtgcatgaagagaggccgcgagctctctctcaaagccttcgaagtattcgcctggacaggctcctcgttccgaagctccaacaagggcctcctagaggcatgctggacgaacgcggccgaccaggatgactgggtcgagctctcacaggcatcagtttcagagggctggagcgacgaagtcatccaagaatctctccaaggaatggtcctcttcaatgcttcgaggctgtgctacagcccggacgcggtggtgttcgacggcacgttcgaggaggtgctgcccgtgaggaaagaggacgtgcacgcgagaggcctggaggctaagtgcttctcggtggaggaggtgctgatgcagcacgacacttttccggacgccggtaagctgatgatgacggcggtggtgatgggcaaggagctatcctatgctgccccggcagatgagcctgtggacatggactcgtgatcatgtcggagagggaggcgtttatgtaggctggctgaatcatcgtgatggccatgcaatcggagttatttggttgactggaatagtagtttttactcttgtgatggccatgcaatagtaatttttactctatgatgtactgatgtccattgtcggctgtaaacctttgtagagactgcaacgttgtcagctcttgccttttttcttttagctcgagctgtgttttgaaaattgaaatatgcgtcaatatttttt

SEQ ID NO: 295 - DNA, 1651 bp, Hordeum vulgare
tcaactcaacgcgaaccagaacccgacgcgaggcgtggctcgccgcgagatggtggcacctttacattagttatgctagtttgtgtctggtcatcttttcaaaatggtgaagctgacaatgatagcccgcatcactgatggccttccattggcggaggggttagacgatggtcgagatctgaaggatgctgacttctacaagcagcaagcaaaactgttgttcaaaaacttatctaaaggccaacacgaatcatcaaggctgtcaattgagactggaccgtactatttccattacatcattgagagccgtgtatgctatttgacaatgtgtgaccgttcttatcccaagaaacttgcattccagtatttagaagatctaaaaagtgagtttgagagggtcaatggcagccaaattgaaactgctgcaaggccatatgctttcatcaaatttgatacattcatacagaaaaccaggaaactgtatttggataccagaacccaaaggaaccttgccaagttgaatgatgagctctacgaggtgcaccagattatgactcgcaatgttcaagaagttcttggtgtgggtgaaaaactagatcaggtgagtcaaatgtctagtaggttgacctctgatacgagaatgtatgcagacaaggcaaaggatctcaatcgccaggccttaattcggaagtatgcccctgtggccattgtgattgggatagtactgatgctcttttgggtcaagaacaagatatggtgaccgagtgaagctcgacatccttcactgtgacgccgagaattctatgtcaacagatgcttctacagcttatcccgcatctgcctattcaagcgagattaccattttagccggcttatgctctccccaaacaagaggagcaagcagtaaacccgttgtgtagtactcctactattagtatagatctgatcctgatgcatgacttctccatgaaatcttggagccgaacatactactccgtacctattagaggtgtagattcggccgacatagtaattggtcttccttttgtgagctcaacatgtaagatcagtagtggcaagataccggaaacggaaacgctttggtcacgatgaaatttgttcagcatgctactggagaacaggctatgtcaaattcatttcaaatttgccaaatttgttgggtgaaatgttttgacacggaaaatcaacatgattctggcaatttcggacgaatctactgcagttgatactgccttgtttcctataaaatcctgccttaattaatttcttacagttgaacccccgaaccccgaactagaagcggctgcgggtcagcagcggaagccaagcaccctgccgtcgatcggcgagacgccgacgcggcacaccttggacgcctgcacccggtgcgtcagcacccgcagcaccatcaccttgcccttcaccactagcagcgagtccacctccatcacggcagccgcggcggcgggctgctgcgcggccatgtccagcggcggcggggtggccgcggggaaggccggcacagcgaaggtggtggaccagtgcttggtgctgccgctgtcgatgaggcccgcggggatgtagatggagccgatctcgccgccggcgtaggcgacgcggagcgagctgt

SEQ ID NO: 296 - DNA, 5340 bp, Hordeum vulgare
ccggaatggctgaaagactaaagggactgcaaagccgaaagcccaacttgccatcatcaccaacctcaaggccccaactcgcaggctctcaaatttctccgagcttttccccacatcgtcgccgctcaaaacccacactccccgaccaaaaccctcctggccgccgccgccgccgccgccgccgacggcgaggctgcaatggccgccgcgacctctacctcctgcaggatagcgggcaccgaggtccccatcacgagctcggacaagctgcgatggatcgacctcaccgtcccctccctagcgccggcgagccccgccgacccattcgtctccgtgcccccgcgcgccgcctcggggtgtcacgtcgtgtcctccggccgcgactcccaacgctacctcgcctggaggattcacgaagaaaaccaaaatgtgctagaggtcattgaactctgtgctttgaaggagttcccaagctccggactgcgtttggtattccaggaggcgctatgtccattcgctttcatgtgtgaaagtgagggtgccagacgaagcgagtctgtatatctgctatatgtgctcactatttctggagttgctcttatgtgcaacttgcgcagcccattctcctatgtatctggatcaatactgtctcaaaatgatatagttggatttaatcttcaaacccacacacagagcgctaaggttacagctgttaaagcgaagccaggatgtctagtaattgggcggcaagatgggtcaatctgctgttacagtcttggcaaactagctcctagttcaccaggtttctctaatgagctccgtgatgatgctggaatcgggcgtttgtggactctcatgtcgagaacaaaggctctggggcctgtacaagatattgacacagctactgtaaatgaaagggagctgttatttgttcttcatttggatggaagtttgcgtgtctgggatatttctagtcacacgaaacttgttaattataatgttcaattggatgattttgaagggcaaccctttaggctatgggttggcgaggctgatgatgagcaagagctgatatccttggctgttctgcaccaagggactgtggttccagcttgtgatcatattggtgtatatgccttcagttttggtgctggcgaaagattcttgttgtctcctgaaccttcggtttctgctgtacctttgctagagggaaagatcgttgatttgaaaataagcacagaaaaactttggatacttaaagaagttggaccaatgctctatgaaatagtgcagtataactctgatagcgaggaaatgtgttcatatgtgctacaagaagacactatcagtgagcaaatgttccaaagttctgagagtgcattggatgatttggtttggactgctgattcagtattctcatctatgaaggagcatagtttcagttttatctcatccatgtttctgcggaggctgctgcaaccaggagtgaaccactgttctgctctccgtgaaaccttattggagtacaaaaggtttctatccgattctgagtttcagtcacttacaactagtgggctacggaaagaaatattatccattatagaacaagagggaagttcacaggtcgcaagttctactgtttatcactggaaaaagttttctgcacggtatctccacaactggtgctggaataataggccatatgggttgcttcttgatacgaacagtgaagtgtttggtttaattagaaagggttcattttctctcttccgttgtttggagggtgtggagcaacttatttatggttcctctgatgacttgggaaatctcattggccctgggatgaacttatcaaatgatactgacggtgaaacccttattgaagttctcaggtgcatgggccatataaaccatttgcttgggagatcttctgctgcaatatattacgagtccctcatcagttctgttatatcaccagatgaagttacttctcagatattaaagattctagagagtgggttcagtcctcaatcttcatcgcccctcattacgttgcttggagcagatgcttatgtagaaagaaggcagacagctcacaaaagccaaaggaagttttctgttgagatgctactatctttccataagttgcaatcaagatccacgtcctggtcggcagtatttgatgtgattgagaagttcatgaagtgtttggatacgaaggtcactatacaagagtatgaattgataagactttgtaatgtaaactctgccttggtggttcaggctacttcacaggttgcaagaaccatgtttgaggctgcttttgatctatttctgttcctcagttatttggttggtgtcggtgggcaggtctccttgctgcaaagcgatgttgctagaataaaactgcagctgtttccaatgattcaagacatattgggacagtggatcgttctccattttgtgggaatttcaccaaccacaccaccaaccatcgaggatttcagctatcaactttcttccctccagctaggtatagccgatgagctgtctttgcacagaaagcttggatcctctgattttacattggcttgtttgcttgattttcctaaatccgcggaaggggatgatctgtcgccttgttttcctagtccagccaaggtgatcaacttggtcaggaggtttagcagttcgattatgtgcagaaatagtgctgaccatgtagacagcttcttgggctccacaataaatctgtcagcagttttcatccgacatggtcaatatgaagctgctcagaatcttctgggtattcttgaaacatacttgaactatgccagagcatcccaaactgatcaggatactgatatgacatgtttggctcgcctacatctcagtggattttgccttttgatgcttgcacatgatgaagcaaacattgttttgagagaatccaaggttcaggaagctatcagatgcttctttagagctgcatctggacaagaagctccgaaggcactgaagaagttctcttcagaaacagggtttcaaatttccggggaatgtagatctatttctttatggaggcttcattactacgagtgggcaatgcaaatttttgagcagaactcaatgagggagggagcatgccagtttgctctcgctgctcttgaacaagttgatagcattgttgacttggacaatggaagtgaagtcgaggatctcccagagactacagcgatgattaaaggacgactatgggccaatgtattcaagtacagcttggatttgaaaaactttcgagatgcatattgtgctataatctcaaatccagatgatgatagcaagtatgtctgcttgaggcgtttcatcatagttctttgtgaacttggcgagactaaggtcatttgcaatggtgagataccgttcactggtttggtggaaaaagtggagcaagagctcttctggaaggctgagcgctcagatctatcttctaaaccaaatctatacaaagtcctttattcatttgaagcttataggaacaattggaggaaggcggctgcatacatgtacaggtattttgttagattgagcagagagggggatgcaggtggaagccgccaactcactcacgtattacaagagaagctgcatgctttgtctactgctatcaactcgttgcaacttgttgaaccctcatgtgcctggctcgattcggtttgtgaagctgatgatcatatttcaccaagcaaaaagcctcgtaatcttttgatgcagaactctgcttttggcacagattcagaaatctctacattgcagttttgtgttgacattgaaattcttgaaaaggaatacacactaacagaagcactttatatgcttagcactgtaaatcctaaatccaatttttctgaaagctattctatcgaagccttgacggacattcttgtaaatgagaatttctatgacctggcattcaccatcgtgctgaaattttggaaggagtcaggaatgaaaagagaactggagcgtctctttgcagctattgcacagcaatgctgcccaaacagagtagggaactcagggagaaacctgcctgacactcaacagctgctacttctgccttcttccgaggatgatggatgggatggcaatagcaagactattgctgtggcccatcaagtgcagggaagttgccagtgggaaactcttgaactatatttggataaatataaagatttgcatccgaggctgcctgtcattgttgctgaaacacttctttacactgatcctgagattgagctacctctttggctggttcagatgttcaagactaccaagggtggaaacaggatgatttcatggggaatgtctggcaaagaggcagatccagctgcattatttcgactatataccaattatggccggcatgcagaagcagccaacttgttggtggagtacctggattcgtttgcatcatcgagaccgatggacgtgctgcaccgcaaaaagatgtctgccgcctggttcccatacaccactgtcgagaggttttggtgtcagcttgaagagatgcaaagcgctggccacagtgctgatcagtgcgataggctcaagaagttgctgcatggagccctgatgaaccacctgcaacaagtggtcgtggattcagaagacgtactgtcatcagttggaggaggtcaaggagtggagagccaaagcagctgagatcttgttggtcgtggattacatacatacacaggccaaagcattgttgtatcctgtatgtaggttctgtatgtttttccccagaaacgcaggctctgtctggctgatagtttctgtgggagacgtttgacagaaaatgctcaggacagcagctaacgttcgtctctgtagatgatggagtgatgttccgtttctaatgtgaatatgctagcatgttaaagttccatgtcgtttggttgatgacagacggttgggtagcatatgatgccctcactcggtatcggcagcacacaacgtcaccaaaaaactgacagattttaaccacctgtatctgcagagtttgaaagatcctaaagtttacggtaattgattccaggatgtctgtatgccttagtgctaagtttcttctagtctaggtaaaaaccatgcaactaaaaaaggggtgttagtggtagggcaagctgttcagcagcgggatatttctccagttgtgagttagctcgcctggtgaacgtgatattcgggttctggtgctttcatttgcaaaattatcataacaattgttcaagtattttttttgaacttataatgtcttttcccttggtaattgtaaga

SEQ ID NO: 297 - DNA, 1320 bp, Setaria italica
ggccgccacacgctcgccgcgcccgcgtgcgtgtgctcgcctccctccctccatccccactcccccaggcagccgtcccctgcactgcacctgcccgcgcgcatccggccaccctccatccccggtcgtcagccaccccagccggccgccgcggatcgcctggctggggatcaagatccgccgaggccgaggaacattaatctgggaatggtggctgacacagaaagctcagattcgctacctggaagttcaaatgctgctgctgagacgcctgttcatgggtctcttgatcaaagatctcaggaaaagactccaaagaaaactcataaagctgaacgagagaagctcaagcgtgatcagttaaatgaactttttcttgagctcggcagtatgctagatcttgatcgacaaaatacaggaaaagccacggtattaggtgatgctgcgcgagtactgcgagatctggttactcaagtagaatctcttagaaaggaacaatctgctcttctatcggaacaacaatatgtcagttcagagaagaacgagctgcaagaggagaatgctacactcaaatcccaaatatcagaactagcaaacgatctctgtgcaaggatggggagtagcagtctcagtctaagcagtcctgggatgtcacatccagtggcgaacgctacaagtcctgatttggcgactcaccccatgccacatcacatgtggggcaacattcctaatttaagctctgtagccatggcgcatcaaacgactacagtatcaccagtgcacagtcagcatcactctgccaatgatgttgaagtttatgcaccgccgcctcaggagctgcagctctttccagggacatcttcatcaccagagcatgaatgttcaggcatcagaagcgcagcaaccaactcttcaagcctgacagattctttgccagggcagctttgcttaagccttacacaatcatctcaagaagaaagcagcagcggtgtgttgggaagaagaaaagaacggtgaaatgcttagcagattgctgatgctggaatcagtatttggtggtagtgattgccctgtaaatactgagaatcccctcccttcactgattcagaactaatgttataggtgccctgtactgaactgtgactctgtagcgcttgttctacaaactcagtctgcctttagttctgatgctgatcaaactgattcaggaatgttatagttactctgtactgaactgtggccagcgcttgttctgcaaattcccagccatatttggcgggccagctcatatatgtgctcggaaatagttgattcaacagc

SEQ ID NO: 298 - DNA, 1794 bp, Setaria italica
aggaaatctcagccgagcgagccagcgagctgggtcactcacaattctcggcgagcgaacgagacagagacctgtgatggtggccgcggtgcgcgccgccccggcgctcgccgacaagccgccggggctcgcgatgctggaggtggcggcggcggcgggggaggaccggctgtcggacgccgagacggcgtcgtcgacggcggcgcccaactccagcctcagttcggccagcagcgccggaagcctgccgcggtgctccagcctctcccgcctctccttcgactgctccccctccgctgccctggccgctgccgcgtgttcgccgccacccgcgccgacggcgtcgcggccgcaccggtcgggcgacgcggcgtgggcggcgatccgcgcggcgtccacgtcgtccgcggcgccgctcgggccacgggacttcaagctcctgcgccgcgtcggcggcggcgacatcgggaccgtctacctctgccgcctccgctcccccgcggccgcggccggaagggagagcccgtgccacctctacgcgatgaaggtggtggaccgccgcgtggtggcgaggaagaagaagctggagcgcgcggcggcggagaagcggatcctccgggcgctggaccacccgttcctgcccacgctcttcgccgacttcgacgccgcgccccacttctcctgcgtcgtcatggagttctgccccggcggcgacctccactcgctccgccaccgcatgccctcccgccgcttcccgctcccgtccgcccggttctacgcggcggaggtgctgctggcgctggagtacctgcacatgatggggatcgtgtaccgcgacctcaagccggagaacgtgctcattcgcgccgacggccacatcatgctcaccgacttcgacctgtcgctggagtcgacctcctccccgtcgctcgagtccgccgccggcaacgacgccgccgccgctggcgacgcatccacctccgcgtcctgcttcccggaccacctgttccggttgaaacgccggcgtcgccgcgccgccgcgcgacagacgacgacgttcgtggcggagccggtggaggcgcggtcgtgctcgttcgtgggcacgcacgagtacgtggcccccgaggtcgcccgcggcggcccccacggcgccgccgtggactggtgggcctacggcgtgttcctctacgagctcctccacgggcgcaccccgttcgccggcgccgacaacgagtccacgctccgcaacatcgcgcgccgcccgctcgcgttcccgcccgggtcgggctcctgcggccccgccgacgccgcggccagggaccttatcgcccgcctcctcgacaaggacccggcccaccgcctcggctcccgccgcggcgccgccgacgtgaaggcgcaccccttcttcaaaggcctcaacttcgcgctcctccgggcctcccgcccgcccgtcgtccccggctcgtcgcccctgcaccggtcccagtcctgccacgcggcgccgccgccgccgacgacgacgccgggttctacgctgccccgcaagaagccgatgccgacggcggacgcgcggttcgacctcttctgaccgaccgtccggcggcgccattgccggcgggagacacgcccccccggccgcgacgtcacgcattgacctagcgagcatcagtcaccattgtacacagcgtttatataatctagtaatagcaagtagctagtttaatcccttgtagtgtgccatcattagtctaatcgagcacgaaccctcgaacccttgagctaaggccgtgttta

SEQ ID NO: 299 - DNA, 1421 bp, Zea mays
caacacctaaaagcttcactactctcacatctttctgcttcctgtccagtgtccacacacacaccggaccctttcgccatctctaactttttcatcgatcgatctgtttttttcgaccttggctttccttcccccttttaagctttgatgcacacacacaccacacgcagtcgtaatggacaggctccacctcttgatgtgaagatctgttgcatttccagtctagctagcagtctcgctcacatgtgggaggaacgcatccagcaagcgaagaagatgatgaagaagcagtaacagcggcagtaccactagaactagctagatctcctctcttactagctagaagcttgtacaaacagtgcaccacacagatgttgccgtaccctaacaaccctcaccatttcggcgtctcccaagaactcccacacccaaaccctacggccggcttccccatgcctccaccgggcgcgcatctggatcagcgctactacgtggaccatcacttctttcccggccacggtcactgcttcaactccgagactctggaggcggtgctgaggccggcgcgcgctgccccagagtgcgacgaggccctagtagtcacggcgccgcaggcgggtggaagaagaaacggtagtctgcctgccgccgccgccgccggccagggccagggccagggccacgcccgagcgcggaagcgcccgttccggacggaccggcacagcaagatccggacggcgcagggcgtgcgcgaccgccggatgcggctgtccctcgacgtcgcccgcgacttcttcgctctgcaggaccggctcggcttcgataaggccagcaagacggtggactggctgctcacccagtccaagccggccatcgagcggctcgccgccgccaccgagccctcccaccagcggagcgacgacgcagctttctcacccccaacgtcaggggtggctgatgtgtcagctggtaataagagcggaggagttgccgagaagttgggccgctccagaagtgggggatccgcgtccatggagatggagcgcgcctgcgggctggaccgcctcgtgtcggccgcaccagtgcttcgtgagtactactacggcctcagcgagatgatgagcaacgacaacggaggagatggcgacgacgacggtgagtacgaggaagacggtgatttcctggacggtatgcaatattagtatggtactactagtagtagcttgcatggttaatttctacgtacctagtacactagtacctccagtccagctgctggcagcttacctagctagctagctctttatctggcaatgcaagcacttcttcactatccttagttcctagctagtaactagtagtatgcatgtgtactccttcctttaagttaatgctactggcaaatgctgtgtcagatgtta

SEQ ID NO: 300 - DNA, 948 bp, Oryza sativa
gaagaagaagaagaagaagcggcggccaagatgacgggatttggatcgccgtgcggcgcgtgcaagtttctgcggcgcaagtgcgtgcgcgggtgcgtgttcgcgccatacttctgccacgagcaaggggcggcgcacttcgccgccatccacaaggtgttcggcgccagcaacgtgtccaagctgctcgcccacctgccgctcgccgaccgccccgaggccgccgtcactatctcctacgaggcgcaggcccgcctccgcgaccccatctatggctgcgtcgcccacatcttcgccctccagcagcaggtgatgacgctgcaggcgcagctggcgtcgctcaaggcggcggcggcgcaagggatacaccaccaggacgtcggcgccaccaccaagggcggctacatgagcgccgccgccaccgccgccgacgaccaattagggtacggcggctacaaccagtggtgcggcagcaatgggggcggcgcgccggcggcgtcgcagccgggcgcgtatagcagcaatggcggcgccggccacggccacgactccatcaccgcgctgctggcggccgggtcggactacatgcagcactcgctgtaccacgcgttcgagcactcggagggcgccggcgccgtggacgacgggcacgcggccgccgcggccttcgaggcggcggcggagtcgtcgtcgtgcggcatggcggcgtcgttcgccgccgacgagagcgtgtggaggtcgtcgtcgtcgggataccaagattgcgaggatctccagagcgtcgcctacgcttaccttaaccgctcgtaagatcgaactaagaactactactagtgcagtgcagaatatatatcatcacaagatatatatagagagagatatatatctcaatctcatcaattcctgatcatgttttggacttgatatgatcgagtctgcagcttgggc

SEQ ID NO: 301 - DNA, 2003 bp, Sorghum bicolor
tctccattttcaagcaatttcgtactattcacctctccctcgaagttcccgcccctctcgctgacttccactgcacccaaacgtgccagctgaaacagaacgttcctgcctgccctgtggccggcggtgtagtctctctagctatcctctcccctagtccctatacatccacgagctcgccatcacgaacagctcccagcgatccagagagaagctactagcatagccatagccatagcagcatgggggtggccggcggcggggggcggctgcgtgcgagcagcgcgaagaagcagcggcagcggacgctgaacaacatcaagatcacgctgctgtgcggcttcatcacggtgctggtcctccgcggcacggccggcttcaacctcctgatcagcggcggcgacctggacggcgcggcggcggcggcggcggacgccaaggtggtggaggacgtggagcgcatcctggccgagatccgctccgactcggaggcggacgacgtcgtgttcgtggtcgaggacgacggctcatctctgccgtcgtcgtcgccgcggcgcaacgagacggcggcgagcttcggcaacttctcggcgtcggcgacggtggtgaaggtgcgggagtacagcctaggtcccaagctgacggactgggacgcgcagcggcgggagtggatgtcgcggcacccggagttccctccgctcgacccgcggcgtggtggccggccgcgcgtcctcctcgtctccggctcccctcctggcccctgcgacaaccccgtcggcgaccactacctcctcaaatcgaccaagaacaagatcgactactgccgtctccatggcatcgacgtggtgcacaacatggcgcacctggacccggagctgacggggtactggtccaagctgcccctggtgcggcggctcatgctggcgcacccggaggtggagtggatctggtggatggacagcgacgccatcttcacggacatggcgttcgagctcccactgtcccgctacgacggcgccaacctcgtcatccacgggtacccggacctgctgttcgagaagaggtcatggatcgcgctcaacgccggcatcttcctcctccggaactgccagtggtcgctggacctgctggacgcctgggtgcccatgggtccccgaggaccgtcgcgcgtcgaggcagggaagctgctgacggcgagcttgacgggccggccggcgttcgaggccgacgatcagtcggcgctcatccacctgctgctgatgcagaaggagaggtggatggacaaggtgcacgtggagacggagttctacctccatggattctggacggggctggtggacaggtacgaggagatgatggaggagcaccacccggggctcggcgacgaccggtggccattcatcacgcacttcgtcggctgcaagacctgcggcaggtacgaggattacccgctggaccggtgcgtcggcggcatggagcgcgccttcaacttcgccgacaaccaggtgctccggctgtacggattccggcaccgctcgctcaccaccgccaaggtcaggagggtcaccgacccggccaccaacccgctcatggcaaaggaggcggcgctcaagatggacgccaagttctccagcaactagaagacagagttatacgagttttgaattttgattgagcaagcagttcttttgcgttttgttttgtcttgtcttagctttctgtttttgcaaaagctatagcgcactcgaaaggaactttgatgttgtatgttctgaatttctgatgctttcagttggactggattcagagaaaaatgaaacagggcagaagattcaaacaatgtgactgtgaattgtgagttgtgacactatcacactgatacaccgccattcttcggattagcattgtttaagttgttttgtactagaacgcagagagatcagatgtcacatgtctctgttctgagagtgtgcctacagaattggaaatgctattcttttcag

SEQ ID NO: 302 - DNA, 1753 bp, Glycine max
ccaccttcaggaaaacattcgcgtgattcctgaaaaatacaaaatttgaggaacatttgtctctcatcaatggctgccacgagaccggtgcagtgtttgttacgaagggtttgcagaggaagtaggactattggggttgccacagaagttaatgcttcttcttcttctcagaaaatcatcgacaaggaatatgaacacagtgctcacaattaccatcctcttccgattgtatttgctcaagcaaagggaacctctgtttgggatccagagggaaacaaatatcttgattttctatcaggttactctgctgttaatcagggacactgccatcctaaaattctgaaagcattgcaagaacaggcagaaaggttgactgtgagctctcgagccttctacaatgatcgcttcccagactttgctgagtatgtgacaaacatgtttggttatgatatggtacttcctatgaataccggtgctgaaggtgtggaaacagcactgaagttagcacgaaagtggggttacgaaaagaaaagaattcccaaagatgaggctattattgtctcatgttgtggctgcttccatggtcgtacactaggtgtcatatctttgagctgtgacaatgaagctacccgtggttttggtcctttattacctggcaatcttaaagttgattttggtgatgcagaagcccttgaacaaatttttaaagaaaaaggagagcacatagctgcatttattttagaacctgtccaaggtgaagctggggtgatatttcctccagatggttatttaaaagctgttagagatctttgctccaaatataatgtcttgatgattgctgatgaaattcaaactgggttagcaagaacggggaagatgctggcttgtgagtgggaagaagttcgcccagatgttctgatactagggaaagcattgggtggaggagttataccagttagtgcagttcttgcagacaaagatgtgatgctttgtatacaacctggacagcatggaagtacctttggtggaaatccaatggccagtgcagttgcaattgcctctctagaagtaataaaaaatgagagactcgttgagagatctgcccaaatgggagaggagcttactggtcagctgcttaagattcagcagcaatacccagactatgtgaaggaggtacggggaagaggattgttcattggagtggagtttaacagcaaaaaattgttcccagtatcaggctatgagctatgcaaaaaattgaagtatagaggagtccttgccaagccaacacatgatgcaattatccgctttactcccccactttgcataagtgtggatgagatccaacaaggttccaaggcactggctgatgttctggaaattgatctaccaaagttgcagaagacaaagccaatagatgctgctccagttgccactagtgcatgcgatcgttgtggtagagtcttgtattaaccataaaaagacacgtatgaattgcatgtgcctttagttttccttggaaaaaaatatatcacatgaagaatgttactccttatacatgaacagctggaaactatgttccaatattccatatatcatcataatataagttcatgatatatgtgataggtagctgtataaataaatatataggagttagaggactcattgtataactttcaatggttaatttgcgagataagatatatgattttattatggctagaacaaagttctctagacttgccattcc

SEQ ID NO: 303 - DNA, 3241 bp, Glycine max
gcttttcagattttgctcactccacgccacaaacacatcacctagttgcagatttttattctttttcttccaagtttgtttatccttatcctaattccatttggctttaacttttaataacagcagttttctttttgttatttattgctattatgatgtagtaatttcaatcgttttcataatgactccataatggcgattaatgaagtttctgagctgtgtgagcgatttagcataaagtatacgatgcatcgtttctggttctggatgttcatgttcgagcaaagatcttttgtgtgtgtgcagttactgctttgacgttttggattttcagtaagtaaaatctcggaagtcctcagttaagctcttctgcttacttagggtttggaaagtcacttcatgtagggattagtatttgcactagatccgtggttagttttgaataatttctaaggttggatttgaagtgaatggttttagaaagggatactctgctagagtgctgtggatatatggtcagggcatttgtttgtcttacttgtatagttgtataggttcttgctattttcttttaactgcatatctagtgatttgcagttgcatttgggttggggttcctggtgattattgcatgtgctgtttttctttggatgagaacgggttgtaataatcactgtgaatttgggcattctggatgacaagggttgtccagatgagtgttgatggcgacagcaaagagctgaaagaactgaatcagcgcttacgagatgggaagaagattgctggtggggagcatggtttatgcgaggaagtgaaatgtaatggaattgctgaagaagttaaggttgaacagggggggactgtggagtcctcctctgtccagcagcatataccacagcctcaaggggcaataatttgttgggagaggtttttgcatattagatcccttaaggtcttgcttgtggagattgatgactctacccgtcatgttgtcactgcactgcttcgcaattgtagttatgaagttattgaagcagcaaacggattgcaagcttggaagatattggaggatttaaccaatcatattgatcttgttttaactgaggtggcaatgcctggcttatcaggcattggacttctatacaagattatgggccacaaaacccgcaaaaatattccagtagttatgatgtcatctcatgattctatgggtttagtctttaagtgtttgtcaaagggtgctgttgactttctagttaaacccatacggaagaatgagcttaaaaacctgtggcagcatgtttggagaagatgtcacagttctagtgggagtggcagtgaaagtggcacacaaacccagaagtctataaaatcaaagagtcttgagaagtctgataataattctggaagcaatgacgaagatgataatgaaagtataggcctgaataatggggatggaagtgacaatggtagtggcactcagagctcatggaccaaacgtgctgtagaagttgatagtcataaaccagtttcccagtgggatcaaatagctgagtgccctgacagtacctgtgctcaagttgttcactccaatgctgaaatgggtgggaacaaggtggttcctctagctgcaaaggattgtgcagaacagaatgaacaacttgtcaaaactgcaggttctcaacatagcaatgcacctgatgtcggcccctctaaattcagtgagcaaattaatagaggacaactggaccttaattgtgaaaatcaatctagcaagctaaggtgcaaaggtttatcactgtctgatgccattactagtacttgtgattctcagatgcatagtggagaatttgaagccctaaataaaaaacccaagtcctcagatattgaaaataaaggtactaataatgatgaagaattgccatctcttgagctcagtttaaagaggcttagaggagttgaagatgctgatattacaattcaggatgaccggaatgttttaagacgttctgatcagtctgctttctcaaggtacaatgcagcctctaacactaagaaatctcccactggatgtgttggaagcaattctccttataataatagcttagaagttacaaagaaagattcatctcgtgatattcaatctcattcttgcggcaatcctcctaaccaaaactcaaatggtgctagcaataacattgatatgggttccactactaataatgcttatgctaaatctgcagttatgagtgagccagcaggggcatcaacaacaaaatgtttgtaccaaacatctgctttccagcctgtaaaaaacagccttgtttgtacctctcaacaagttgtcttaaataatactgaagatatgtcggcaacaattctggcaccacctaaactagacagacataaagattctgcagctctggacttccatctccattgtgaaaaccataactgtattgctgacaacatgaagcatcagctgccacctgatcatgatgctgaatctataaagaaaatggctactgctgctccacattgtggatcatcaaacgtggaagaagtgctagttgaaggtaatgttggaaaccacagtatcaatagaagtgtttcaggcagcaacaatggaagcaatggacaaaatgggagcagcacagcagttaatgctggagggacaaacacggaaagcaacaatggactcactgggaatagtggcagtggtgatgctagtggaagtggaagtgccaacagagtagatcaaaacaagacttctcaaagggaagtggccttaactaaatttcgccaaaagagaaaagagagaagggagaggtgctttcataaaaaggttcgatatcagagcagaaagagattagctgaacaacgacctcgatttcgtggacaatttgtgcgacagacctctaacgaaaatgcaagtgaggcaacaacagatagctgattcagagcattggccacaatggcataatgatggggatatgcgaaaaaaggttgaggagtcttcatgtagaatttgggaattattctgtgtgttgtgttaatgtataaagaccctggttattccaacttgttcatttggaacctgaatcaatttatgtggaaagagattgttatgccgattgatgctcggataacttactgtaatttaagttactttttcctcgatcttgtgcttgaatcaaatgctttttcacattatcaactagttactctggtgtatgggtag

SEQ ID NO: 304 - DNA, 1124 bp, Glycine max
ttaaaagaggaatagataataagattggaaatggagaaggcaagcccatgccacaccaacactcctctcccacttcctaatcgcccttccaattttcttcaattcaagcaccaaactttcttcttcaagttcccgaacctgaacccgaacccgaacccgaacccgaacccgaacctccttcgattgcgcaggctcaattgctcagtatcagacggcaccgttccgtcttcggttggtgccacggactcttcttctcttgcggtgaagaagaaagcagcagaggtgtcttctgagctcaaagggacctccatatttctggttggtttgaagagctcttttaaaactagtttggggaagctgctggcggatgcattgcggtattattatttcgacagtgataatttggtggaagaagctgtaggtggtgcactggctgcaaaatcattcagagagagtgatgaaaaaggcttctatgagtgtgagactgaagtactgaagcaattatcatccatgggtcgactagtggtttgtgccggaaatggcgctgttacaagctcaactaatctggcacttctgagacatgggatttcgttgtggattgatgtgcctctagattttgtagccagagatgtaattgaagaccagagtcaatttgctccatctgaaatatctatttcaggatcatacccagaggtacaggatgaactaggtgctctatacgatagatacagagttggatatgccacagccgatgctattatttcagttcaaaaagtagcatctcggttgggttgtgataacttagatgaaattacaagagaagacatggctttggaggctcttggggaaattgagaagttgaccagagtaaagaagatgttggaagaggctgcaagaccattttaaccagcttggacatgctcccttctcaaatttcagttttctttttagttgttttcctttgaaatttcagtcttccttttgatgttgtttaaagactgacactgtactagagtgttatattggggagaaaaaaattactcctttctgtacctacagtgcaacttttttcctacttttttttcttctttttatcaatgattagttgatttcttcctgaatta

SEQ ID NO: 305 - DNA, 963 bp, Sorghum bicolor
atagctctagggttgaaaccagcaaagccaacagcaccgcacagtgtagtagttgcacctaggcgtccgcgcgtcgtcgtcctagctatggatccatatcactaccagactatgtatgacccacgcggcttccccatcatccacccgcagccgccgtacctccaccacccggtggcggtggccggcgccctcagcgacagcagggtgcgcggcggcggcggaggcggtggcgtgcggcggcgtcctggtgccaagctctccacggacccgcagagcgtggcggcgcgcgagcggcggcaccgcatcagcgaccgcttccgcgtgctgcgcagcctcgtccccggcggcagcaagatggacacggtgtccatgctcgagcaggccatccattacgtcaagtttctgaaggcgcagatcagcctgcaccaggccgcgctgatgcagcacgaggaagggtgccatgctgagctagccgccgcctactccgcggcggcggcggcggtggctggtgacgacgaggtgacgctcgcgtcccacggtcgtaccggcgcatgcgatgaggtgatgcagctccagcttcaggtgccgggggaggaagctttgagttatggtgttgttgctgcccatcagccgtacgggctcgatcccaggcatcagctgagtggtgggcacgagctgcctccgttgcctgcttcttgcatcttcgtcgaggagcctgcagacgcatgctactctgtgtgtgacctcgacgacggggagactggtctgcccgccggctcttactagtatagtagtagtggtagtttcttaaggtagcactagcatcccgtgtgtgtcgtccgtgtctgctagatggacgctagctagtacgtcaaattagcaaagtttagctagtactcgatcatcaattgcctgccagtcgtttagtttgcttagagttagagtatatgatgatgcatctgc

SEQ ID NO: 306 - DNA, 1965 bp, Hordeum vulgare
gtggggttggttgggcgcatcaacacccacgcgagaccagacagacagtgcggctcgcaccgctccactccactccactctccacttcgctcccaaatctcctcatctcttttctctttctttctttctccacgcgcaccgccaccgccaccgccaccgtgccgagccgagacgagggagagcggcgtgcgtgcgtgcgtataaatccatccatccgtaggccgtagccgtagatccacggagccaacccgatcccctatcttttccctccctcctctgtttctctgtcccggcgcaggggagaggcgatggagattttctactaccttgtgttcgggggcctgtcggcggtggtggcgggtctggagctgggcaagagcggcaaggaccgcgtcgccaccaccaccgcattcaacgctttcaagaacaactacgtcctagtatactccctaatgatgtccggcgactggcttcagggcccctacgtctactacctctacagccagtacgggttcgacaagggcgacatcggccgcctcttcatcgccggcttcggctcatccatgctattcggaaccatagtaggctcgctagcagacaggcagggccgcaagcgcgcgtgcatcacctactgcgtcacctacatcctcagctgcatcaccaagcactccccgcagtacagggtcctcctcctcggccgcatcctcggcggcgtcgcaacatccctcctcttctccgcattcgaatcatggctcgtagccgagcacaacaagagaggctatgacccgcagtggctgtccatcacattctcaaaggctatattcctcggaaatggtctcatcgccattatagccgggctgtttgctaacctgctcgctgacaacttgggcttcggtcccgtggctccctttgatgccgctgcgtgcttcctggcgataggcatggccatcatcatgtcttcatggagtgaaaactatggagatcaatctgaaggcaaggacttgatgtcccagttcaaggttgccgctaaggcaattgcttcagatgagaaaatcgcattgctgggagccattcagtcgctgttcgagggctcaatgtacacctttgtcttcctctggactccagcattgagcccaaacgacgaagacattccccatggctttatattcgctaccttcatgctgtcatctatgttgggtagctccattgcctcacgcctactggcccggaaaatgaaggttgaaggttatatgcagatcgtgtttgcagtatcagccttcacccttttcctcccagttgccaccagccttctggtgccggcgtcttcagtgaaaggaagcggcatatcgttcggtggctccctgcagctgcttggtttctgtacctttgagtcatgtgttggcattttctggccatctatcatgaagatgagatctcagtatatccctgaggaggcaaggagcaccatcatgaacttcttccgcataccactgaacctgtttgtgtgtgtggtgctctacaatgtgaatgctttccctatcaccgtcatgtttggcatgtgttcaatcttcctcttcatggcggcaatcttgcagagacggctgatggttgtggctgacctacacaagctctcgacaaaatcacaagagatgaccggggaagacgagccgctaaatccttaaaaggccaacagaatcgggagcgaatcagatacgccattgattgaatactccacctgcctgggtgccgaataagatggaagtggggaaagcaagatgctttttgcttgtaatatttattctgtagcgtagatcaatattattggctaggcacacgaggacatcgatgaatacatagttgggaggaagaattgagaggctgctgatttgttcatcggcatggcattatttgtgtttaatgtgctacgaatatctttgtccaagctatacatatattattattaca

SEQ ID NO: 307 - DNA, 2608 bp, Phaseolus vulgaris
agaacaaggactctatagatcatcaactacccttttcctctctcactctcatcaacaatcttcatattcttcttcttcttcacttctactacagccactcacctaagtggctgcttttggttttggttttggttgaacctttaagcttaacttaagacatggcatcatcatcctctctgcatctgtctcaggcccttttggctcgtgctgtgtaccttcatggctcttcttctgatcgtgtatcactctccttcccatcattctctggcctcaagtcacattctccatgcaaagcagccaccttttctgcaggttcacgcagaaggggtgcttctaccagtgttgttcgagccactgctgttgagacactggaccagaccactgaggtttctctggtggagaaatcagtcaacaccattcggtttctgtccattgatgcagttgagaaggccaactctggccaccctggtctccccatggggtgtgctccaatgggccacattctctacgatgaaatcatgaggtacaatcctaagaaccccacttggttcaaccgtgaccgtttcattttgtctgctggacatggctgcatgctccaatatgccctccttcaccttgcaggctatgacagtgttcaggaagaagatctgaagaatttccgacaatgggaaagcagaactccaggacatcctgagaactttgagacacttggagttgaagtgaccacaggtcctctgggtcagggaattgccaatgctgttggattagcactagctgagaaacacttggcagcacgatttaacaagcctgacaatgagattgttgaccattacacatatgttatattgggtgatggttgtcaaatggagggaatttcgaatgaagcaagctcacttgcaggtcactggggtctaggaaagcttattgcattttatgatgacaaccacatttccattgatggtgacactgaaattgcattcactgagaatgttgatcaacgttttgaagcacttggatggcatgtgatttgggtgaagaatggaaatactgggtatgatgaaattcgggcagccattaaggaagcaaaggctgtcaaagacaaacctactttgatcaaggtaaccactaccattggatatggctctccaaacaaagctaactcctacagtgttcatggaagtgcattaggttctaaagaagtggatgctacaaggaagaaccttggatggccatatgagcctttccatgtgccagaagatgttaaaaagcattggagtcgccatgtccctgaaggttccaaacttgaagctgagtggaatgcaaagtttgctgaatatgagaagaaatacagtgaggaagctgcagagctgaaggctatttttactggtgaattaccagctggttgggagaaagcacttcctacatacactccagaaagcccggctgatgctacaagaaatctgtctcagcaaaatctaaatgcccttgtgaaggttcttcctggtctgcttggtggcagtgcggatctggcctcttccaacatgaccctgttgaaatcttatggagacttccaaaagggaactcctgaagagcgcaatgttagatttggtgttagagaacatggaatgggagcaatctgcaatggcattgctcttcatagccctggattcattccatactgtgcaactttctttgtcttcactgactacatgagagctgccataaggatttctgcactgagtgaatcaggagtcatttatgtgatgactcatgattccattggactgggagaagatggaccaactcatcagccaatagagcacttggcaagcttcagggcaatgccaaatattctgatgcttcgtccagctgatggtaatgaaactgctggatcatacaaagttgcagtgcttaacaggaagagaccctcaattcttgcactttctaggcaaaagttggcacagcttcctggaacttctattgagggagttgaaaagggtggctacaccatttcagacaactcatcaggtaacaagcctgatgttatcttgattggaactggttctgagttggaaattgctgctgctgctgctgatgatctaaggaaggaaggaaaagctgtgagagttgtttcttttgttagctgggaactttttgatgagcagtcagatgaatacaaggagagtgttctccctgcttctgtaacagctagagttagcattgaagcaggatcaacatttggttggggaaagattgttggaagcaaaggaaaggccataggcattgatcgatttggagcaagtgctccagcaggaaaaatatacaaggagtttggtctcaccaaggaagctattattgctgctgccaaagaactttcgtagatctatttgttgagtttcttttatctcatctaaaacttgtggttttcactggtggctttgggttgattttacattgtttgttttttgagatgccactttagccacaataaggaagattagattgttcttgcatgtgactgtccgaggagccacttacattaaaagatgagttgaattaatgaagttgtatgaatttttaacaactattttggcttctgagttttgtc

SEQ ID NO: 308 - DNA, 1526 bp, Setaria italica
gtcccacctaccccgaggcccaggccggccgcgagagcggtgcgaaaccaccatggccaacgctctccttctgctcctcttcctgtttctctcgcgcgcctcagcggcggagtacggggaggagctgctgcggcgcgcgggggaggagcgggagtggatggtgggcgtgcggcgccgcatccacgcgcacccggagctcgcgttccgggagcaccgcaccagcgccctcgtccgcgaggagctcgagcgcctcgggatcagcagccgcgccgtcgccgggacgggcgtcgtcgctgatgttggctcgggtgcgctccccatcgtcgcgctccgcgccgacatggacgcgctcccgctccaggaattagtggagtgggagcataagagcaaagtggacggggtgatgcacgcctgtgggcatgatgtgcacacggcgatgctgctgggggcagcaaagttgcttagtcagcgtaaggatcagctcaaggggacagtgagactcctttttcagcctgctgaagaaggtggtgctggtgcatctcatatgataaaagaaggtgctcttgatggtgtcgaagccatttttgccatgcatgttgactatcggataccaactggtgtaatagcagctcatccaggacccacgcaagctgctgtatgtttctatgaagcaaaaatagaaggtaaaactgggatggctgaaaccccacacttaaacgtggatcctattgttgctgcatcatttgccatcctgtcgctacagcagctcatttcaagagaagatgatcctcttcacagccaagtggtctcggttacatatgtcaaagctggaaaagcccttgatgccacccctgcaattgttgaatttgggggtactttgagaagcatcactactgaaggcctttaccgtctacagaaaagggttaaagaggtagtagaagggcaggctgtggtgcatagatgcaaaggaactgtcgacatgaagggtgaagagtacccaatgtaccctgctgttgtgaacgattggaagctgcatcaccatgtagaggatgtcggcaggcgcttgcttggcccggacaaggtgaatcccggagagaagatcatggcgggggaagacttcgctttctaccagcagctagctcctggcgttatgtttggcatcggaattagaaacgagaaagtcggctccgttcactcagctcacaaccctcatttcttcgttgatgaggatgtcattccaattggggcagctttgcatactgccatagcagaactgtatctctctgaggcatatgctctgaacggaggaggggacttgcggtctcattgatgttcttgagtcgaacagatgggtttaaaatgggcaatatataagtatacatagcattaccgcgcacatctggtgcattttctctgataactggtttcaaactacgagtgccccatatgcttctgccaaagaattgtgcaactatgtaaattcagatttcagacagtaacgggcccttctccatttttgcaggtag

SEQ ID NO: 309 - DNA, 2478 bp, Setaria italica
ttccagagagagaaagcgcgcgagcgccagcgaagcagccacgccttcctccctctcgcggattgagccgggtgtgaagcggcgcaacggcggcggcagcggccgaggccgaggcggcgatacggcgggtgattaccttcccttcccttccttctcaggagagggaagcgtgagcggcggcgcgacgagcaccgatgggaccattggagccgcgctaccgcccctccggcgcccctgaggacgcaactaagagaaggacctccaaaagcaaaagcttcaaagatgtcgaaagttttgaagttctggtccttgaaaagaactgtggttgcaagttcaaatctttgaaaatcttgataatagctatcatttctgcaacagttcttaccctcataaccccaaccttatatgagcaccaattgcagtcagcctcccggtatgtggatgtaggctggatgtgggacaaaacaaattctgacccacgatatgcgtcatctgttgatgttcagtgggaggatgtatatagagcattgagaaatctaaaaagtgggaatcaagatctcaaagttggactcttgaattttaatagcaccgagtatgggtcttggacacagttgttcccggacagccatgtttccactataagacttgagcatgccaaggacagcattacttggcggacactgtatcctgaatggatcgatgaggaggaagaaactgagataccctcttgtccatctcttcctgagcctaatgttcgaagaggtgtacgctttgatgtcattgccgtgaagcttccttgtacccgtgttgccggttggtcaagagatgttgcacggctccatttgcagctctcagcagcaaaattggctgtggcctcttcgaagcgcaaccacaaggttcatgtgctttttgtaagcgactgcttcccaattccgaatctcttcccttgcaagaaccttgtgagacatgaaggcaatgcttggttatatagtcctgactcgaaagcattaagggaaaagctcaggcttccagttggatcctgtgagcttgctgttccgctcaaagcaaaatcgagacttttctcagtagatcggcgaagagaagcatatgcaacaatactgcattcagcaagtgaatatgtctgtggcgctatctcagcagctcaaagcattcgccaagcaggatcaactagggatctagttatccttgttgatgagaccataagtgatcaccaccggagaggcttggaagctgccgggtggaaggtcagaataatccaaagaatccggaacccaaaagctacgcgtgatgcttacaacgagtggaactacagcaagttcaggctgtggcagctgactgactacgacaagatcatcttcatcgatgctgaccttctcattcttaggaatgttgacttcctgttcgcaatgccagagatcactgcaactggcaacaacgcaacgctcttcaactccggtgtcatggtcatagagccttccaactgcacgttccagctgctgatggaccacatcaacgagatcacgtcgtacaacggtggagatcaaggttacctgaatgagattttcacatggtggcaccgcatccccaagcacatgaacttcctgaagcacttctgggagggcgacgatgaggaaatgaaggcgaagaagacccagctgtttggcgcagaccccccgatgctctatgtcctccactacctaggcctgaagccgtggctgtgcttcagggactatgactgcaactggaacaacgccgcaatgcgtgaattcgctagcgatgtcgcgcacgcacggtggtggaaggtgcatgacaagatgccacggaagctccagtcctactgcctcctgaggacacggcagaaggcgggcctggagtgggaccggaggcaggctgagaaggccaactctgaagacggccattggcgccgcaacatcaccgaccccaggctgaagacctgctttgagaagttctgcttctgggagagcatgctctggcattggggcgagagcaataacaggacgaagagcagccctgcgacggtgacgacgccgagcttggcaagctcatgatctgtagatatacaaacaacttccgatgtggcaaccatacatgcatagcaatagcttgtatagttggctatgcttaggtctttgctatacaaaatacacccctccctgctgctgtcatggcttggctctgtatcagctgccggcctgcctcgataggtaacgattcttttgggttggctgagataataagttactggtgcatgtaaatttccctgctgaaattctgtgagcgtgtgtgagaaaatgcatttgtatagggcggcaataataaggattactgcatgaaaaaatatggctagttgtacagtgtacaccgccagacttgtatagttcgacaccttaccggcagtgcagaaacagaacaatacactgtaatactaggggcccg

SEQ ID NO: 310 - DNA, 2838 bp, Oryza sativa
gctccttcccgtgctccgccggccgtatagtcaaaaccaacgagtccccgacgccggcgagctccccggccgagcataagaggcggccatggcggcgggcaccgcatcgccaccgccggacgcggagcctcccgagtgcccggtgtgcctctcccccttcgacgccgcctccgccgcgccgcgggtcctcccgtgcggccactccctctgcggcccctgcatcgcctccctcccgccggcctccgcctccgcctccgcctccgccgcctcgctccgctgccctctctgctcccagtgcgtccctttctcccgcgctctcgggccctcctccctccccaaaaacctcgccctcatctccctcctcccctcgcccccaaacccctctcgttctcgcaccgccgccgcggcgccgccgcctcctcatgtcccgctccacgcggaccactcgcgtctcctctcccgcttccgccacgccgtcctcccggagtccgcttcgccgctccactcgcccgctcccgccgcgggcctcgccatcgggtccttcgcttccgacctcggcgccccgtggttctgcccgcgtggccaccccgtaagcctcctcccgatcgaaacccccgccgccgccgccaagcaggagtccccgttgtactaccggcccagccacgcggcgcgggtggccgccgcgatcgatgcgctgagcgccgcggcgagggatgaagtgatcgatttggtggccgtctcgtcgcggttggcgcggcgggtttgcagggtttacggcttctggatgggccccgaggcggctccgctgtggctgctctccgagcggcattcccgcggagtctcctgcttgttggaggagaggagccgacgagaggagacggtggctctgatcagaaatgtcggaatggaggtctgtgaagcgttcatgggattgcacggagaggggctggtactggggtgcatagggctaggatgcttctgcctcgatcgctttggacactgcctgctcgacctgaatcaggttttggccttgtgccacggggttcgggtaggggtttgctcatccaagtctaaggccttcatggctcctgaggtggcagaggtggtgcatgacaagttgcagataaaggatcatgatttcagtggcttgttagggcctagttcagatgcttggttgcttggttgtttattggtggcacttgtaactggggatgagcagcttgcagcaggatggagtactgaggggtcatacgatgattggaagaatgaagtgcttacgaaggttgatgcttcattggttggcacacatatggaaccatggtctgcaaccatagtgtcatgtttgaactatgatccagaaggccgtccagaaattgctgatgtctggaaatgtattaacggctcattgatgaattccgacattgaagctttgattcctaatgttgatcttgcagctcgaaagagttttatgtgtttgctccttggggagttgtcctcaatgtgctctaaccttggtgctgttgagtcagatgatacaatgcatctttctcaggatttggatgacaaacattcaactccagatgatgcaagcagtggtggtattataaacaacgaagaagttggtgcagctggaatggatgggccaaaatgtggactgtacaattcttcaactctgcttgctcaccgtgactgtattacgggattagccattggaggaggctttttgtttagctcttcttacgacaagacaatcaatgtatggtcactgcaggacttctctcataaacaaagtttgaagggccatgaacacaaaatcacagcaattgttgttgttgacaatgataatcagtcactttgtataagtggagacagtggtagtggaatatttgtctggtgtgttgatccttcactcagtaatgaaccattgaataagtggtatgaaagtaatgattggatttatcgaggtgttcactgtttggctgtttctggaactggttatctttacactggtagtagagacaaatctattaaggcttggtctctagaggattattcactacgctgcacaatgacaggtcacaaatcaactgtttcttgccttgcggttgcctgtggtattctttacagtggaagttgggatggttctattagatcatggtggctcactgatcacagcccgctgtctgtactggaagatggtacaccaggaagcattactcctgtgctgtcaatttcaacagaactcgattttgttgttgcatcatatgaaaatggctgtttgaagatctggaaggatgatgtcctagtaaagtcagagaaacttcaaaacggtgctatatatgctgctaaattgaatgacaagtggctctatgctggtggatgggataaagttgtaaatattcaggagttattggaagatgattcagaggtggaaatcagagatgttgctacctttacttgtgattcaattataacttcaatactgtactgggatggaaggctgatagttggactttctaacagggagattaaggttttctacaaggcatcttaactctaaatcaggattattaatcatttgtcactccatcttgtatatattgtgaatagcacactgtatagtcgaattgataacgaaagactgataggaccatgtaattagaatttgaatgctgcttttggtgaatgatgataaacctgtatggtaaagtttgagtgcaactgcacaatagggtaaggttttttgtaacagtagtatcatatagaaaccatcgaagtcgtagctcatatcaatttgtttcttctactagaaaaatcatggaatttgttcttcaatcc

SEQ ID NO: 311 - DNA, 1370 bp, Glycine max
tcggtgcatttcattctgattcactatggccaatggtccagcaccgttttctgagattggaaaaagggcaaaagatcttttgtacaaggattacaactttgatcacaagtttagcctgtcaattccaaactccactggattggggcttatagcaaccggattgaagaaggatcaaatttttgttggtgacataagtacactctacaagagtggaaatactacagtggatgtgaaagttgatacatattctaatatatctacaaaagtgactgtgaatgatatcttgcatggtacaaaagccgctttgagcttcaacatacctgatcacaagtcaggaaagctggatgtgcaataccttcatcctcatgcagccgttgattctagtattggtttgaatccatcccctctattggagctttcagctgcaattggcagcaaagatgtttgtctgggtgctgaagttggatttaatacaacttctgcttcattcacaaaatataatgctggagttgccttcaataaaccagatttctctgcggcacttttgctggctgataaaggacagaccctgaaggcatcatacataaattatgttgatcgccccgatggatttacggttgctgctgaaatctcccacagtttttccacctttgagaacagatttactattgggagctcacagtcaatagattcaaagacagttgtaaagacacggttcagtgacgatggcaaagctgccttccaatgccaacgagcatggaggccaaattcacttataaccctgtctgctgaatatgactccacaaagatctttggttcatccaccaagttcggtcttgctcttgctctcaagccttaacttgccctggctattaaatcttgtttggcgacatcaacttttttcatatcattttacattgtttccaaaacccatgttgggttgttttgagcccatcataaggtaaaccaaagaaactagtaatatttgtgaaatcttcttatgcggcaccggtaaggaggacccagttttgaaatacctacataattgctatagggttttgtagctggttaattacactaccatccaggatctagcttatgatttttgggccaaattctattatttgatatagtgacactcatgatcaggtggatttgttgatatgcctgatgtctcatttcatagttttttcttctccctaatgtctactcatggcaccaatttatcatgatcaggtggatttgttgatatgcctgatatagtgacactcattatatgttttatactttcggttcctagtttaaatattaaatgttaccttgcccgtagagacgcacaaaatttatggagaaaatggatttgatggtga

SEQ ID NO: 312 - DNA, 1169 bp, Hordeum vulgare
cgccgtcgacagccgcccgtcttgctcgagattgacctttggtgaccattagaaaccagagacactgaagatggcgcagcctgctgagctttcccgtgaggagaatgtgtacatggctaagcttgcagagcaggctgagaggtacgaggagatggttgagttcatggagaaggtggccaagacggttgactccgaggagctcaccgtcgaagagcgcaaccttctatcagttgcttacaagaatgttattggtgcccgccgtgcctcgtggcgcatcatttcctccatcgagcagaaggaagagagccgtggcaacgaggaccgtgtcacactcatcaaggactaccgtggaaagattgaagttgagctcactaagatttgtgatggtatcctcaagcttcttgattcccaccttgtcccctcatctaccgctccagagtccaaggtcttctacctgaagatgaagggtgattactacaggtaccttgcagagttcaagagtggaactgagaggaaggatgctgctgagaacaccatggtggcatacaaagctgctcaggagattgcactggcagagctgcccccgactcatcctattaggcttgggctggcactcaacttctcggtgttctactatgagatcctcaactctcctgaccgtgcttgcgacctcgccaagcaggcttttgacgaggccatctcggaattggactcactgagcgaggagtcctacaaggacagcactttgatcatgcagcttctccgtgataacctgacgctgtggacttccgacatctcggaggacgccgctgaagaaatgaaggatgctcccaagggtgaatctggagatggacagtaaacattgtctatgtgtccagaaacttgtctttcttgcttgttcagtgtagattgtaatgtcgtcagtgtggttgttggtaattggaggctccaatttgtgttgtgatagggaagcttgtagctgcctgccttgctttgttatcgggctgcactggttattgcctcttgttgaaccttcctgttactttggtggttctagaaatttctgctgctcttgtctgtgtggccccttgtctattcatctgcttttcttctttaggaagggcgtcttctgaaccctttccactttgctgaatctttgttcgcgtgtt

SEQ ID NO: 313 - DNA, 1968 bp, Populus trichocarpa
gttgtctgtctaaataggttccgttgttcttaaaaataaaaactttcaaaaaggggaccttcatttttgatctacttgatggtgatctcgctttttttccttttcttttttcaattgggtttgtgggtattgaagagaaattgctaaatttgaaaccattttttgattgtggggagggggggggggatttgggggctggtttgatgaaaaatgggttttggtgtttagggtttttgaagaggaaaggagaggatgggattaggtagtgaagaaggtaaagtgaagtcttcttgggatgtgtgcaaatcaaaggagaggaagaagaagaagaaagatggtacagaggcagggtgttgggtcaagttgaggtttataggaagctgcatttcttcaagatccaaagttgatagctctgttagtgggactagtacccattttgaaagtaaatccacgaatgatacaagcatagaccaaccagctgctcttgttgtttcaacctcaaccacaagtaatacagaaagtaactcatccacttccaaacttgaagaggagcttaaagttgcttcccgactaaggaagttcacatttaatgatctcaagtttgcgacaagaaattttagacctgagagtcttcttggtgaaggtggctttggttgtgttttcaagggatggattgaagaaaatggaactgctccagtgaaacctggtactggcctcactgttgctgttaaaacccttaatcatgatgggctccaaggtcataaagagtggctggctgaagtgaatttccttggcgatcttgttcatcctaacctggttaaattgattggctactgcattgaagatgatcaaaggctgctagtgtacgagttcatgcctcgaggaagcttggagaaccacctgtttcgaaggtccctgcctcttccatggtccataagaatgaaaattgctttaggtgctgccaaaggtcttgcctttcttcatgaagaaactgaaaggccggtgatttatcgtgattttaagacctccaatatcttattagatgcggattataatgccaagctttctgattttggacttgccaaagatggtcctgagggagataagacccatgtatcaacccgtgtgatgggaacttatggttatgcggccccagagtatgtaatgactggacatcttacttcaaggagtgacgtctacagttttggtgtggtcttgcttgaaatgataactggcagaagatcaatggataagaaccgacctaatggagaacataaccttgttgagtgggcgagaccacatctaggggagagaagaagattctaccggttgatagaccctcggcttgaaggtcacttttcaataaaaggtgcccagaaagctgcacagctagctgctcattgccttagtagggatcctaaagccaggcctctaatgagtgaagtggtcaacgcattgaagcctctgcccaacctcaaggacatggcaagcacatcatattatttccagaccatgcaagctgaacgggttggatccagcccaaatgcgagaaatggtgtccgctcacaggctggattgttatctaggaacgggcaccaacaaaggagtctttcaataccacatggttcccatgcttccccttatcactatcaatacccccataaatcgccaaaacccaatggtaaaccatagtagcacaggatcattgaagtatgtgcttcttttagccacctcttttcattcatttcttttttcacctttgttctcagtatagatgtattttctgtgaaagcaattgttcttggacaactttgaaggcaatggaggaacatgcctctatgtgttgtatttagaatgatgaccttcccacagggggtaatgttaaggacaggtgaagctcatggcaaaaaatctgtcagtcatgtttcactgcagtcaggaaaatgtttaaagattattagctcctat

SEQ ID NO: 314 - DNA, 2758 bp, Oryza sativa
catggaagcgtaagcgcgaggagagagcggatcaaacaaacgaaacaaaacaaacgctcgcaccgaactcgaatttcctccgcgttgccctcgccctcgccctcgccgcctcgaatcctccctcgccgccgggggtatcccccgttggcccgcctctccgatccgagcctgatcggaggagtcccgcgccgccgcagctggtggatgcgtgcgtgccgctagctgcagatctcctcctctcccggcgacgagcgtctaggcccgtgtggttgtgactaagtatcggatcagcgatctttgagaaaaatacagagtgagaagtctgatcgtctgagggtgcatttgtggagaatgtcagagagcaatgtcgacggcatcgaaatatcagctagtaacgatgagaggagggacagaggggacgctgagatttcagaggatgagccaaggcagacgaggatacggtcgttgaagaagaaggcgctgcatgcatctacgaggctgacgcattcgctgaagaagagagggaagaggaaagtgggctgcagagtgccgaagatcacgatagaggatgtcagggacgcggaggaggagcaggctgtcagctcttttcgagaggttttgtttgccagggacatgctgcctgagaggcatgacgattatcacacgatgcttagattcttgaaagctaggaaatttgatgttgaaaaggcagcacatatgtgggctgacatgctgcactggaggaaggatttcgggactgacacaattttggaagattttgaatttcatgagctagaggaggtgctgcagtattatccccatggttatcatggtgttgacaaggaaggaaggcccgtctatatcgagttgcttgggaaagttgaacccagtaagcttgtacaaattacaacagtggaacgctatattaaatatcatgtacaggaatttgagagagcattccgagagaagtttcctgcatgctcaattgctgctaaaaagcatattgatacgacaactacaatactggatgtccacggtgtgggttggaagaactttagcaagatcgcaagggatttggtgcgctgtatgcagaaaatagatggtgattattatcctgagacactacatcaaatgttcattgtaaatgcggggcctggttttaaactgatctggagtactgtgaagggacttcttgaccccaaaacctcgtctaaaatccatgttctaggaacaaaataccaacacagacttcttgaagctattgactcaagccaactaccagagtttcttggtggttcttgcacgtgctctagccagggaggatgcctgcgatccaacaaaggcccctggagtgatcctttaattatgaagcttgtacattgcatggaatcatctgcgttgaaggacattggccaagtatctgatatagaagaagcaattacaggctctgtaagattgcgtgctctcaagttaccagaaagaattagttatacatcaaatgctgaatctggttcagatgttgatgatcttggatctcctataggacaggaagattttgagtatcatagtttggctccagttcatgaggaggccagggagtcaggatcaacatgcagtggttctgatgataaagttgttgagacgaatacaatatacaaccctcctggaaatggatcgggacagtacagcgcaagacaaaatccctcaataaacagagtttcgcctgagccagcaggtcacgtcccaaatgatggtgaaggaaatgcagatcatgggatcttgaaatatatttctaaaaaagttctcggtgtaattcttgaagtactctcttttttgcgtattttcatccgtcatcgacaacagttggaaaatgtcccccagcatactacaacagtgcacagtaatcaggcagatcttcagataattaaggaagatcgtgtaaatccttgtctagagcgtcttgaaagacttgagacaatgtttaatcagctcagcagaaagcctccagagattccacaggataaggatcgtgctatacaggattcttttgacaggataaagtgcattgaatttgatctggagaagacaaagaaggtattgcatgcaacagtgattagacaaatgcagatggctgagacattggaagctgtaaaggagtccgatcttaggagaagaaaattttgtacataataaacttagcagcaatgtacaggaacaagaaaagaagagtcgatgacttactaatgccggcattccaacataaaactaaacttcattgctttgtacatggttacccttttctcactttttttttggtctatcaaaaaaccgagcaaatcttactgtgaataagtacagagtggtgacccgaggcaaactgagaagatagtcaagaaagaccgtgctggaagtcacttaacatagtccagcttataatagtccaaaagggatattctaaaagagccaatgcacagcttatttatgttccatcgagcctcctgatctgctgtatgcatctcatcaatgccttgtgcatttttcattttcagaacagtttgaggcaatgggccggaattcatagttcttcataccctttttttggttgatatggtcaatacatgatcaggtttttcattgctttgcctcccttcaaatgtaaagtgtaaatatatgactgcactgcttgctgctgcaagatacttataccagattgacatggtgaaacggccaataaatgccaaaatttaccgttctttta

SEQ ID NO: 315 - DNA, 858 bp, Setaria italica
gaggcggcgagaccaacccaaccggccgaggaaaattttgcgcgagggagggtaaatatggcgggaaagtttggcgccacctgttcccgcgccgccgcctccctatttagcccgcgccaccgccgcctcctcctcccctcaactccaactcctcccagatttctccccttctcccaccgattgctcccgagaaccctctcgaccatcgccatgaccgctcccaacggcgccgccgacaccgacgccgtccacgagcctccccagaagatctccaagatcgcgcccctgctcaaggtgaagaagctctccgacaaggccgtcctgccgtcccgcggctccgccctcgccgccggctacgacctctcgagcgccgcggagatggtggtgccggcgcgggggaaggcgctggtgcccaccgacctcagcatcgccatcccggaaggcacctacgcgcgcgtcgcgccgaggtcgggcctggcgctgaagcactccatcgacgtgggcgccggcgtgatcgacgccgactaccgcggccccgtcggggtcatcctcttcaaccactcggatgtggacttcgccgtcaagcccggggaccggatcgcgcagatgatcatcgaggtgatagcgacgccggaagtcgcagaggtggaggacctcgacgccaccgtgcgtggcgagggagggtttggatccaccggcgtctgagccgtgacggcccacttcgctcgaaggagggatggtagtttcatcagtctctagattaggatggcgatgcaaccttggtgtctttagttggctggaagcgctcctgaagtcgtggtgttaagcgtgcgtttggttcagggacatcctgcaact

SEQ ID NO: 316 - DNA, 2818 bp, Sorghum bicolor
cgcgaataaataaagcggggggcgagctcgtctgaccgacgtggtgagctgttcttccgcgctctctctcttcctgtgcgtgcccgcggcatatgctggctggcctgcctgcagcggtggtgttcctcttccggctattaaggtcgtgcttgatgagtagtaggtgattaaggtgagggacgagggcgacgacgacgaggagagcccgggtcgtcgctgcgagagttctccgtgtgtgctagcccgcgtgacagagaggaggaggaggaggaggtggtggtggtgtcagtgcgtgccaatggcgccgtcgtggtgggggagggacgcgagggccaatggcgtcgttagcggcggcggcggcacgcccgtggtggtgaagatggagaacccgaactggtccatctccgaggtcgccgcatccgaggtgtcgccgggctcgccggcgggtgccggcgggggcaaggccgggcgtggcaagaacgcgcggcagatcacgtgggtgctgctcctgcgggcgcaccgcgcggcggggcggctgacgggggcggcgtcggcggcgctggccgtcgccgccgccgcgcgccgccgggtggcggcggggcggacggactcggacgcagccccgggggagagcacggcgctccggacgcgcttctacggctgcatccgggtgttcctggtcctctcgctgctgctgctcgccgtcgaggtggtggcctacttccagggctggcacctctcggtttccctcgaggaggaggtggacgcgggcctccaggccgtcgacgggctcttcgccgccgcctacgcggcgtggatgcgcgccagactcgactacctcgcgccgccgctgcagttccttaccaacgcctgcgtcgtcctcttcttgatccagagtgtcgaccgcatcgtgctttgcctgggctgtttctggatcaggctcaaggggatcaagcctgtgccgctagccgccgccgacaaggaggacgtcgaggccggtcccgaggacttccccatggtgctcgtgcagatgcccatgtgcaatgagagggaggtgtaccagcaatcgatcggcgcagtgtgcagcctggactggccaaggtcaaatttcctggtccaggtgttggatgattctgatgatgctaccacttcggcacttatcaaggaagaggtggagaaatggcagcgagagggggtgcgcatagtttaccggcaccgggtcatccgggatggctacaaggctggaaacctgaaatcagccatgaactgcagttatgtgaaagattatgagtttgttgtcatctttgatgctgatttccaaccacaagcggatttcctgaagcgcactgtaccccattttaagggaaaggatgacgtcgggttggttcaggcaagatggtcttttgtaaacaaggatgagaacctgctgaccagacttcagaacataaatctttgcttccactttgaggtggagcagcaggtgaatggggcgtttctcaacttcttcgggttcaatggcactgcgggagtgtggagaattaaggcacttgaggagtctggaggatggatggagaggacaactgtggaggatatggacatagctgttcgggcacatctcaaggggtggaagtttctcttcctaaatgatgttgagtgtcagtgtgaattgccagaatcctatgaagcatacagaaagcagcaacaccggtggcactcaggtcccatgcaattgtttaggctctgctttgtggatataatcaaatctaagattggattctggaagaagttcaatctcatatttcttttcttccttctccggaagctcatcctacccttctattcattcactcttttctgtgtcatccttcccatgacaatgttcgttcctgaagctgaactccctgcatgggtagtatgctacattccagcaacaatgtccattctcaacatcctcccagccccaaaatctttcccgttcattgttccataccttctgttcgagaacaccatgtcggttaccaagttcaatgccatgatttctggcctgttccagctcgggagtgcctacgagtgggttgtcaccaagaaatcaggtcgttcttctgagggcgatctcttagccctcgttgagaaacactctaagcaacaaagagtaggttctgcacccaatcttgatgcactaacaaaggaggagtcaaatcctaaaaaggacaccaagaagaagaagcacaacaggatctacaggaaggaactcgcgctgtccttccttctgctaacagcagccgcccgcagtttgctgtctgcccagggcatccatttctacttcctgctgtttcaaggggtttcattcttggttgtcggcctcgacctaattggcgagcaagtggactgatagcaatataaggaatataatgggtttttttttttgcttgaagaaatcttcgcaagcatcaaagggctctttgtaaagggaagagtgtcgccctctttggtgcttacacgaggaaaaccttggtccctgttgcaggggtcaaaagattcaccagagatactgaaatgtggaggagctgtagataggtatagtttgggtttagcctgtgagatgcttttattctttcaggtttcgattcttttgtaagaatatttctgtccctggatgggctgttctctctttctttttttctttttgagatgacagactttaccttcaaatgaagataatacttgtgttcaccgtgtatttgatcaatcaatcaatcagtcaatcaattaccatgattattgaggtacatctcctagaagtagtataatgtaaggg

SEQ ID NO: 317 - DNA, 4463 bp, Setaria italica
gaacaaaccaccctgttaaaattctgcacattgcaatcctgctgagctgaaaaaggagtgcgagcggtaaagctcaccgcaagtgagcgcagctgtgctccgcctctgcctcctgaccccgcgccccacactgcactgccctcctcctctttatcactcgccccgacgccgcgctagcttctgacctgaccaccgcagcgcggagcacaaaagctcaccactaccgccacccccacccccacaaacctcgcctgcacgtcaccgataccgaggcgcagcccaggccggcaggcacttcccccgtctcgctctgcttgctgccccaccgcaggccaagaaagaagcgaaagcggcgacgccgtctccaatgccgcagggcgccgcggcggcggcctgagagtgcgagccgctctgtcgactgtcgaggtcgggcgggggaacgcattgcgatggcggagtcggctttggcggacgggaaggcggagaaggcggccagtggaggagggggcgatgcggcgggggaggggaagaagagggccgaccaggccgtggcgttccacgagctgttctcgttcgccgacaagtgggacctcatgctcatggcggcgggcagcctgggcgcgctcgcgcacggcgccgccatgccgctcttcttcctcctcttcggggacctcatcaacggcttcggcaagaaccagacagacctccgcaccatgaccgacgaggtcgccaagtatgcgctctacttcgtctacctggggctggtggtctgcgtctcctcctacgcagagatcgcgtgctggatgtacaccggggagcggcaggtgatcgcgcttcggaaggcctacctggacgccgtgctgcgtcaggacgtggggttcttcgacacggacgcgcgcacgggcgacatcgtgttcggcgtctccaccgacacgctgctcgtgcaggacgccatcggcgagaaggtcggcaactttatccactacatcgccaccttcctggccgggttggtggtcgggttcgtatcagcgtggcggcttgcgctcctcagcgtggccgtcatccccgccatcgccttcgccggaggcctgtacgcgtacacgctcaccgggctcacttccaagagccgggagtcctatgcaaatgcaggcgtcgtcgcggagcaggcaattgcccaagtaagaacagtgtactcttttgtcggagagagcaaagcacttaattcctattctgaggcaattcagaacacactgaagcttggttacaaagctggtatggccaaagggcttgggatcggatgtacttacggaatagcatgcatgtcttgggcactggtattctggtatgctggtgttttcatcaggaatggacagagtgacggtggcaaggcttttactgcaattttttctgcaatcgtcggtggcatgagccttgggcaggctttctcaaaccttggagccttcagcaaagggaagattgctggttacaaattgctggagatcatccgccagaaaccctccatagtcaatgatcataaggatggaaagtggttggctgaggtccatggaaacatagaatttaaggaagttactttcagttatccgtcaaggcctgatgttatgatctttagggatttctctctcttcttccctgctggtaaaactgtcgcggtcgttggaggcagtggttctggaaagagcactgttgtggctttgatagaaaggttctatgatcctaatgaaggccaggttttgctcgacaatgttgacataaagacactccaactgaggtggttgagagaccagattggtttagtaaaccaagaacctgctctttttgcaaccactatccttgagaatatactgtatggaaagccagatgccactgttgcagaagttgaggctgcggcgactgcatccaatgctcatagttttatatctcttcttccaaatggctacaacacaatggttggtgagcgaggcacccagctgtctggtggtcagaagcaacgtatagcaatagctcgtgctatgctgaagaacccgaagattctactccttgatgaagctaccagcgctttagatgcagactcagaaagcatcgtgcaagaagctcttgaccgtttgatggttgggaggacgacggtagttgttgcccatcgtctgtccactataagaaacgtgaacatgattgctgtgattcaacaaggccaagttgttgagactgggacacacgatgaactcctagcaaaaggaagcactggagcatatgcctccctggttcgttttcaggaatcagcacggaatagggatcttggaggtgcatctacccgcagatcacggtcaatgcacttgacaagctcactttccaccaaatctctcagcctcaggtctggaagtctaaggaacttgagctaccagtacagtactggagcagatggacgcatagagatgatctcgaatgcagataatgaccgcaaatacccagcaccacgtggttacttcctgaagctcctgaaattgaatgcacctgaatggccttatgctgtattgggcgccattggttccgtcctctcgggatttattggtccaacatttgccattgttatgggtgaaatgctggatgtgttctactacagggaccccaatgaaatggagaagaaaacaaagctatatgtgttcatctacatcggcacaggcatatatgctgttgttgcttatcttgtgcagcattacttcttcagcatcatgggagaaaatcttacaaccagggttaggaggatgatgttatccgcaatacttaggaatgaagtgggttggtttgacgaagaagaaaacaactcaagtcttgtggctgctcgtctagcagtcgatgcagcagatgtgaagtcagctatagctgagagaatatcagtcatcctgcagaacatgacgtcccttatgacttcttttgttgttggttttatcattgaatggagagtggcactccttatcctggccactttccctcttcttgtgcttgccaactttgcccagcaaatttcaatgaagggctttgctggtgacacagcaaaggcacatgccaagagcagtatggttgctggtgaaggagtgagcaatattcgcaccgtggctgcattcaacgctcaaagcaagatcttgtcactcttcagccatgaactgcgcataccagagcagcaaatccttcgtcgtagccagacatcaggtcttctgtttggactttcacagctatgcctgtactcctcggaggcgctcattctctggtatggttctcatctcgtccgatcacatggatccaccttctccaaggtcatcaaggtgtttgttgtccttgtggtgactgccaactctgtagctgagactgtgagcctagccccagagatcgtccgtggaggtgaatccatccgatccatctttggcatcctcaacagggcaacaagaattgagcctgatgatcctgagtcagagcgtgtcaccaccatccgaggggacattgagttgcggcatgtggactttgcctatccagcacgcccagacattcaaatcttcaaggatttcaacctgaagatccatgctgggcgtagccaagctctagtcggagccagcggttcagggaagagcactgtcattgctctcatcgagcgtttctacgatccgactgggggcaaagtcagtattgatggcaaggacatcaggaggctgaacttgaagtccttgcggctcaagatcggccttgtgcagcaggagccggtcctcttcgctgcgagcatcctagaaaacattgcgtatggcaaggatggtgcgaccgaggaggaggtgatcgaggcggcaaagacagcaaacgttcacggcttcgtcagccagcttcccgacggctacaagacggcagtcggcgagcgtggcgtgcagctgtcaggcgggcagaagcagcggatcgccatcgccagggcggtgcttaaggacccggccatcctgctgctggacgaggcgacgagcgccctggacgcggagtccgagtgcgtgctgcaggaggcgctggagcggctgatgaaggggcggaccaccgtcctggtggcccaccgcctctcgacgatccgaggggtggaccgcatcgccgtggtgcaggacgggcggatcgtggagcacggcagccacaacgagctcctgacccggccggagggcgcctactcacggctgctgcagttgcagcaccaccgtgtctgacggcgttgtgcaagtgcatcctctgattaatacatgatgatgacaccttcgttttggagactgggatggccggatttttttttttcggttggtggtggtcgtgcggatgtagatactagggcaaccgtgtatgttcttaatgctgtggatcgcaagcttgaacttggaacatctgatctgtatcttcccccggaatgtatgatgcaactcttctttaga

SEQ ID NO: 318 - DNA, 6192 bp, Zea mays
ctggcctaatctgcaccgtagcagtccatccgtcacggcgccaccacctctacctccttccctcaccttccagagcccactgctcctcggcggcggcggagatgagcgtgtggaactacgtcgtcacggcgcacaagcccaccagcgtcagccactcctgcgtaggcaactttaccagccccaaccagctcaaccttattatcgcgaaatgtacccggatcgaaatccatttgcttacccctcagggcctccagccgatgcttgatgtgcctatatatggaagaattgcaacgattgagctcttccggcctcataatgagactcaggactttcttttcattgctacggagaggtacaaattctgtgttctgcaatgggatgcagaaaagtcagagctaatcaccagagccatgggtgatgtttctgatcgcattggccgccctactgacaatggacagattggaatcattgaccctgactgtagactcattggtcttcatctctatgatggcttatttaaggttataccatttgacaacaaagggcagctgaaggaagctttcaatatcagacttgaagaacttcaagtactggacatcaaatttctacatggttgtgctaaacctactattgttgtcctctaccaggataataaagatgtgaggcatgttaagacttatgaagttgcactgaaggacaaagattttgttgagggtccttggtcccagaataatgtagataatggtgctggtttattaataccagtaccagctccacttggcggtgtgataataattggcgaggaacaaatagtttactgcaatgccaattccacatttaaagcgataccaataaaacaatccatcatcagagcttatggacgggttgacccagatggttctcgatatttactcggtgataatactggaattttgcatttacttgtccttacccatgaacgagaaagggttactggtttgaaaattgaatacctgggagagacttcgattgcatcatctatttcgtatcttgataatggtgttgtttacgtcggttcacggtttggcgattcacagctggtgaagctgaacctccaagctgatgcaagcggttcatttgttgaaattcttgaacggtatgttaatcttggaccgattgtggacttctgcgtggttgaccttgataggcagggtcaaggtcaggtggtcacttgttctggggcgtttaaagatggttcccttcgggtggttcgtaatggtatagggattaatgagcaggcttcagtagaactccaaggcataaagggattatggtcattgaaatcttcgatcaatgatccatttgacatgtaccttgtcgtgagctttataagtgagacacgattcttggcaatgaacatggaagatgaactagaagagactgagatagaggggtttgatgcacaaactcaaactctgttttgtcagaatgcgatcaatgatcttcttatacaggttactgctaattctgttcggttagtcagttgcacctcccgggagttagtgaatcaatggaatgcaccagcaggattctcagtcaatgttgcttcagctaatgccagccaggttctgttggcaaccggtggtggccatcttgtttacctggaaattagggatgctaaacttgttgaagtgaagcatgctcagctagaacatgagatttcttgtcttgatttgaacccaattggggagaatccacaatatagttccctagctgctgttgggatgtggacagatataagtgttagaatattttcgcttccagatcttgaattgataaggaaggaaaatttgggtggagaaattgttcctcggtctgttctgctgtgcaccttggagggggtttcgtatttgctttgtgctcttggggatggtaatttgttcagttttctactgaatgcaagtacaggtgaactgactgatagaaagaaggttaccctcgggacccaacccatcagccttcgtaccttctcatcaaagggtaccacccacgtgttcgcttcgtcagataggccaactgtcatctatagcagcaataagaagcttctctacagcaatgtcaatttgaaagaggttaatcatatgtgccctttcaatacagccgcttttccagacagtcttgcaattgctaaagagggtgaactttcaattggaactatcgatgatatacagaagcttcatatccgcacaatcccccttaatgaacaagcacgtcgcatttgtcaccaggagcaatcaaggacactagcattttgcagtttcaagtacaaccagagtgtggaggaaagtgagactcatttaatacgtctgctagatcatcagacgtttgagtccctgtgtgtatatcctctagatcaatatgaatgtggctgctccatcattagctgttcgtttgcggatgatagtaatgtttattactgtgtgggaactgcatatgttatacctgaagaaaatgaaccgacgaagggccggattcttgtatttgcagttgaagatggaagcttgcaattgatcgtggagaaagaaaccaaaggagcagtttattcgctgaatgcattcaatgggaaattgttggctgctatcaaccagaagattcaattgtataagtggatgtcacgcgaggatggttcacatgagctgcagtctgagtgtggccaccatgggcacatacttgccttgtatactcaaacacgtggtgacttcattgtggttggcgatctgatgaaatcaatatccttgctggtgtataagcatgaggaaagcgcgattgaagagcgtgctagggattacaatgcaaactggatgactgcagttgagatgcttgatgatgaagtctacgttggggcggagaatagctataacctattcacggtgcgcaagaacagcgatgcggcgacagatgacgaaagggccaggcttgaggtggtgggagagtaccaccttggggagtttgtgaacagattccgccacggttcactggtgatgcgccttccagactcggatatagggcagatccctacggtcatctttggcacaataaacggggtgattggcattattgcctccctcccgcacgaccaatacatcttcctggagaagctccagtcgacccttgtgaagtacataaagggcgtcggaaacctgagccacgagcaatggcggtccttccataacgacaagaagacggcggaggctcggaacttcctcgacggtgacctgatcgagtctttccttgaccttagccggagcaagatggaggaggtgtccaaggcgatgggcgtccccgtggaggagctgtccaagagggtggaagagctgacgaggcttcactagtgtagatggaacatggaagcgttgcttgtaagcaagtagtaacttgttccctgagctgtagcctccgcggctcgcacgatcaaagtgttcggccgtggctgcagtctatcctatgctatatcctatcgtgatttgtttgtttgagctgtgccagtttcttttctttattattaatgcttaatgttaaaattagtggtgaatcctgtgatggtcctaactgataggtgggtcggcgtgagccagtaacaaagggatgtgctgaatgagacggccgtcttgtcttgtggtaggagagttgagatagtggcccaaccctgtccatgaggcatagtccatcccctgtccatttcatagtagcacctccagcaggcagcagcctgcagcccagcccctagtttgatcgatttgaacctgccgctgcgagtccacagcgctgcgcaggcggcactgcggcaggctcttcctccctctcctctctctctgtctgagccgagggctttggcgctcccccccccccccccccccccctctctctctctctctctctcgcacgggcccgcctgcctatcccactgcccggtccaccgccgcaaactctgcccgcccgcgcgcgccccaccccgccgatcgcggtgagcccggactccgccgccgccgcttcgctctaccctgaccagccctagatctgtgcgggatccgccgccatgttctggcgcatgaccggcctctccgcggcctcgcccgtggatacaattctggacaaggagaactttacattggaagagcttcttgatgaggatgaaatcattcaggagtgcaaagcgctgaatacccgactcataaatttcttgcgagataaggcccaagtgtcgcaattacttcgttacattgtggaagaagttcctgaggattcagagaagaaacaatctttcaagtttccttttatcgcttgtgagatttttgcttgtgaaattgacattattttgagaaccttggtagaggatgttgagttaatggatttgcttttttcatttataaaacctgaccatccgcatagcacactgttagctggttacttcagtaaggtggttatatgtttgatgcttcgaaagactgctcctcttatgaattatgttcaggagcatccagatattgttgtccagcttgtcgacctcattggtatcacatcaataatggaggactctcctgaagtgcatgcaaatgctgctgaaattctttctgcggtaactcgatgcgcccctcctgctcttgctgcaaaaatatgcagtccaagttttgttggcaggttgtttcatcatgctcttgacgagtcaagaccaaaatctgttctggttcattcattgtcagtgtgtatatctttattggaccccaaaagactagcatcagtctcataccaagcatttagaagcaacttaactcacgggacgctggttacagccagtccagaaacagttgatggtatactggagagtctaggtgacttgctgaagttactggacattacttcttctcaaaatgtttttcctacaacttatggatgtttgtgtccgcctcttggaaaacaccgtttgaagattgtagaattcatctctgttttgctaacaattggtagcgaaatagctgagaagaagctaataagccaatcagtgataaagcattgcattgatttattttttcagtacccttataataactttttgcatcatcatgttgagaacattattgtttcttgccttgaggttaaaagaaatcaattgattgaccatattcttaatgactgtggtcttgttggtaaagtccttgccgctgaaaaaagttcttctctggcagtggagtctaatgggccaacattaccatcagaagggaaagaacctccaagaattgggaatattgggcacataactcgaatagcgaataagctcattcaatttggaaatagtaacagcatgatccagagtcacttgcagtgagtgggctgtatggcaaatagatgtcctgatcaaacgcaatgaggtggagaatgtttaccattgggcatccgtccaacatctctacatgatcgtgggagggatagcgatgacgacgacttccgagacagagactacgatgtggcagcactcactaataatatgagccaggcatttcgatttgggatatacaggaatgatgacattgaagaggcacaaggatcccacgaacgagatgatgaggatgtctactttgatgacgagtcagctgaagtagtaatatcttcattgtgtttgggggatgatcaggacagttcactcttcacgaattcaaactggtttacgtttgatggtgatagaggaatcaatgaccgcctagctgcctctgttcctccatcatccccggattctgaagcgatttccttaaacactgagaatactgatgaagcgctaactggtgaaaccactggaggcactgagtcactgcgggaaagtgcatcccttgccaatgaactagcagaagtcgctaacgacaatgatgctgatgccacggacggtgagaaaattttgtgtacagaagaggacagtcaagcctccgaggggcctgtggatgctaaagaggacaagactggaggagcgtctaaagcagcgaatgaatctgtgcctgacaatgccttgcctgaatcccaccacactgattgtcggtgcgctgactcatctgaatcaggaacagaagaagatgtggagattgatgatgagaagaaatctgagactgctatgacaaatgaatgagcgttatgggcttggaatgataggatggcggatcagattct

SEQ ID NO: 319 - DNA, 4653 bp, Zea mays
ccactcttcgcctcccgttccccagcccagacccgaagccctgcgcctccccctccgccgctcgccgggcgagatgtccccgccgttcgtgttcccctcgaccctgcgggatctggagctggacaccgacggagacagagacgaggagccctcgctccggccgcagaaccccgtcgccgtcgccacgctccgcgctgccgacctcgaggagttcgtcaagggtgcatcatttgatctttctgataaggagctcttctgcattgaggaacaggaggtgtttgatgccatctactctatcgtgcgtgatttcaattgcctacccccagcccttaagtttaacattgttgagaccttgcgctccaacctcagtgtccttctacccagcatagactcactttcccgggcatccatgtcatccccttctgatgctaccgaaatcactgaccgcattgcctcacaccgcaatgccctcaagatctactccttctttctcatttccattgttctcaccgcggaagctggcgctgaaagctgcacagcggctaaggcaacagcacatggtcgaaagaagaaccatatatattcttggaactgggaagcacaaagaggcaggatcatgagtctagtcgctaattctcttgaagctaacctttcgctactttttggtcctggaggaaccgatgaacgatatctctcttttgtttcgaagtgtacttttgttctctgtgaaaatcaaaatgtgttaaaagatgaggatacaagaaatggcctgtgccggataattggagcaattgccacgaagcatcagaggatttctcaaatcagtgcatctgtttcacatctaatacacaaatttgatttcactgttcctcatcttgcggaagcagttgcttctgcggagaaaaagtttggtgatggaagccttgcaatttccctgattagggaaataggtcgggctgatccaaaagaatacacgagagatagtgttggtgcggataatgttgggagattccttgtagaacttgcagaccgcttgccaaaacttatgtcaaccaacattggtgttctgatacctcactttggtggtgagtcatataagatcagaaatgctcttgttggagttttgggaaagctggctgcaaaggctttcaaggatgttgagggtgatagcaatgctcggcttcgaagtaagcaggctatgctggagattttgattgagcgctgtagggatgtgtcagcatacacaaggagtcgtgtgcttcaggtgtggtctgagctttgtgaagaaaattctatttcaattggcctgtggaatgaagtggcttccgttgcttcagggcgactggaggacaaaagtgctattgtgagaaaatcagcattacagcttcttataacaatgctgcaacacaacccttttgggcctcagttaaggactgcaacctttgaggcaactctagaaaagtacaaggaaaaattacaaggaatggagccttcaaattcagacaaagatgaggccgcaaatgatagttcgcctggtgaagtgatcatggggcaagatgaaagtgtcagtgatagctgtttagcatcaagtcaggatcaaaatgaccgtgatgctacgattgtggatataacaaacttggaacaaataagagctttagttgcttcacttgaagctggtctgcggttttcaaagtgtataacttcgttaatgccaattcttgttcagttgttggcgtcatcctcagctactgatgttgagaacaccatccttttactgatgagatgcagacagtttcagatcgaaggatcagaagcagcactcaggaaaatgttacctctggtgttttctcaggataagtcaatatatgaggcagtggagagtgcattcattactttatacacaaggaaaagtccaatagaaacagcaaaaagtttgttagaccttgccattgattgcagcattggtgaccttgctgctctcgagagcttaattagttccttagtttccaaagcagaaatttcatccagcatggtatcagcactgtgggactatttttgctttaacataaatggagtgagaccagtgcaaagccgtggagctctatctattctttgtatggctgcaaagtcgtctcccagcattttgggtaatcacttgcaagatattattgacattgggtttggacgctgggctaaggaagaacctctgcttgctagaactgcatgtcttgctttgcagagattatcagaggaagacaaggacaagctgataagtaataatagtagagtatttgctgcattgcaaggtttggtaacaagcttctcgattcctgagaaaatatggtatggagctgcagataaagctataagcaccatctataccctacaccctgcacctgaactttttgctactgagactgcaaagaagtctctcagttctgtattcagcgttttaggaacaaatgatgtgtcaaatggagatgaagctcagaatggtgcctctctgtcatcagtatcaccttcaaagctgggtagatttctttttgttattagccatatagcactaaatcatttggtgtacattgagaattctgttaggaaaattcagaaacagaaacggaagaatgaaaaatctcagcccaccactgaggatctccaacctgacgtgtctaaaagtttggaggcacaaggcataaatgccgaactgggacttagtgcaaccatagatattgcaatcgagtcccttgctgaaagagcagaaaaggaaattgtttgctgttcttctgaaaagaatctcataggacattgtgggccatttctctcaaaactctgcaggaatcttgcattgctgcaaaagttcccagaccttcaagcttctgcaatgcttgctctttgcaggctaatgatcattgatgcagagttctgcgaagcaaatcttcaaatcctgtttactgttgctgagagtgcgccttctgaaactgtccgatccaattgcactatagcccttggtgatttagcagttcgcttcccaaatctcttagatccttggacagagtatatatatgcccggttacgtgatccttcagtgtctgtgaggaagaatgctgtgctggtcatttctcatcttatattgaatgatatgatgaaggttaaagggtatataaatgaaatggctgtaagaatagaagataaagatgagaggatatcaagcctggcgaaactcttctttcacgagttgtcaaagaaaggaagcaacccaatttataatcttcttccggatatcttgggtagactatgcaatcaacacctcaaagaagaaacattttgcaatattatgcagttcttaatcaactcaattaagaaggacaaacaaatggaagctcttgtggataagctgtgcaataggtttgctggagtaaatgatgtcagacagtgggagtatatttcttattgcctttctcagctaaccttcactgaaaagggcctgaaaaaactcattgataattttaagatgtttgaacatgcattatctgaagattctgtgatgaaccacttcagaagcgtaatatcaaagtgcaagaagtttgcgaaacctgagctaaaaatttgcattgaggaatttgaggagaaacttagcaaggttcatcaggaaaagaaagagcaggaggaaacaacaaaaaatgctgaggcacacagacagagaattgattcgcttgatgaatttctggttactaaggaagttagtgagaacagtgggaattctgctgaagatgaaactagcgaggtagttgatccttctgtggatagcagcacggaacatatggagaacacgccagaatgcagtgtcaatactagtgctgagaattctcagacaacagccccacttacagaatcagaaggtggcggtgaagagattcaatccgcacaacctgttagcaaaggcatgtcacggttaagggcaaagaaaaccagagatcctgttgtagatccttcggtggaccgcagcaccgaatataaggggaacacgccagagcacagtgcggatactagtacggagaattctcagacatcagccccacttacaggaacagaaggtggcagcgaagagattcaatccacacaacctgttggcaaaggcgtgtcgcggtcaagggcaaggaaaaccagagaccccgttgtagaggactcagcagctccagtgagacgcgccacgcgttcaaccagaagacaaggaagctgatggtgcagcaaagcggcagctcaagccattccgtgccgatctcgcctcgaggtcccggagtactggaccacagcaaagcggtgcctggacgtctggatcggagagttggctggctctatcctttttgcgtgatgcgtgtcggtctagttttagctcgctgattcccggacaggccaataatgatctcccgtgaatctgtctaggggcagtatgtttaactgctccatacgaggagctcttgtgtttggttgttgcagtaggtcggctttcatatggattgtctactacagacattgctcccttggggagcgtatgtataatatctggcctgatctttttgaggcctgatgacgctatgatatttttgaacgtgttgttcttatgaatccagcaggctcagctgatttccagcc

SEQ ID NO: 320 - DNA, 1545 bp, Oryza sativa
gggcgtttttcctttcccttctcttcctctctttctcccccacacgcatccatcaccaaccgaacggccacatttaatcccaccaccaccgcctcctcctcctcctcgcgcggccgcacccgatcccaatccacgcctcgcctcgccgcgatccacgccgccggtggtggcggtggaaggaaggaaggaaggatgctggagacgaagccgccgtcgccggggacggcgggggcggcgggggtggcagggggtgggtaccatcggaggtgggcggcgccgctgctggcgtccgtgctgctctcgtcgctcctcatcgcggcgtccctcttcttctcttcgtcgcgggcgctcctcctctccttctccccgctcccctccgcggcatccgccgagccgctcttcgtcgaggccaagctgcgccagcagcagcagatgcgcggcgcggcggcgtcgggcgggcgcggccgcggcgccgtgccgaggatcgcctacctcgtgtccggctccgccggcgacggcgccgcgctgcgccgcacgctcagggcgctctaccacccgtcgaacatgtacgtcgtccacctcgacctcgaggcccccgccaccgagcgcgccgagctcgccgccgcggtgcgcgccgacccggtctactcgcggttccgcaacgtcaaggtggtcacccgcgccaacctcgtcacctaccggggcccaaccatggtggccaacacgctccacgccgccgccatcctcctccgcgagggcggcgagtgggactggttcatcaacctctccgcctccgactaccccctcgtcacgcaggacgatctgttgtatgttctatctgacttgccaaggcaacttaactttattgagcataccagtgacatcggatggaaggagtatcagagggcaaagccggtgataattgaccctgggctatacagcctgcagaaatctgatgttttctggattacagagaaaagaagtgttccaaccgcattcaagctcttcactggctcggcgtggatgatgcttactcatcaatttattgaatactgcatatggggttgggacaatcttcccaggacggtcctgatgtattatgccaattttctttcttcaccagagggttacttccacacagtcatttgcaatgtcccagagttccgcaacaccactgtgaatcatgatctacatttcatttcttgggacaacccaccaaagcaacaccctcactacctcaccctcaatgactttgacggtatggttaacagcaatgctccctttgcaagaaagtttggaagagaagatcctgtactagacaagatcgaccaggaattattgggccgccaacctgacgggttcgtgtcaggtgggtggatggatctgttgaacacgacaacagtgaaaggatcgttcactgttgagcgtgtacaagatctccgcccagggcctggtgcagacaggctaaagaaacttgtcacaggcttgctcacccaggaaggctttgatgacaagcattgcttgtgaaacttgcagtaatatgat

SEQ ID NO: 321 - DNA, 1769 bp, Oryza sativa
ctcctccccccacatggacccctcatcctcctcctcctcctcctctcccttttctactccattccattccatctcctccacttccaccctcaggcctcagctcgccatcgccattgttgcaacaccaagtgtttgtggtcggaacgagatcgagcagcagccatccatggtgaggaaggagatgggcggcggcggcggcaggctcgcggcggagtaccagggcctggaggtgaaggtacccacgttcttccggtgccccatctccctcgacgtcatgcgctcgccggtgagcctctgcaccggcgtcacctacgaccgcgcctccatccagcgctggatcgactccggcaacaccacctgccccgccaccatgctcccgctcccctccaccgacctcgtccccaacctcaccctccgccgcctcatcgcgctctgggcctccacggccgcgccgtcgtcgccggcggcgccatcggctgttggccccaccccggctgctgcggcggcggagctcctccgccgggtcggggcgcccggggtggacccgtgcccggcgctgcgcaagctcgcggcgttcctgtctgacgacgacgtcgacgagttcgacaagaacgcgctcgcgagggccggtggcgcggcggagaccgtggcgtcggtgctcaggaggagggggaagggtgatgatgatgatggcggcgtggaggccgtcgaggcggccgtccgggtgctcgcggtgctcgccacgtcggactgcatcgaggaggagaacaggaggcgcgtcgccgccgtgctcgccgcggggggcgccgcgccgtcggtggcggcgtcgctggcgcgcgtgatgcggagcgggagcgggctcgaggcccgcgtcgacgcggcgaggctggtggagtcgctgctccgggacggcgcgcgcggcgccaccgcgccgggggtgagggcggcggtcgccgagtcggaggagctggtcgcggagctgatccggctcgtcggccccacggacgagaagggcagcctcgacgcgcaggccgtggacgccggcctctcctgcctcgccgccatcgtcgccgcgacgcggcgcgcgcgcgccgagatggtccgtctcggcgccgtcccggccgccgtgcgcgtcctggccacggaccaccacggcgggtcgcacgcccaggcgctgcgcgtgctggaggccgccgtggggtgcgcggaggggcgcgcggcggtgtgcgaggtggcggaggcggcgatcccggcggtggtgtcgaggatgatgaggtgcggcgggatgggcggcgcggaggcggcggtgtcggtgctgtgggcggtgtgccaccggtacagggaccggcgcgcggtggaggcggcggcggcgtccaagggcgggctgacgaagctcctcctgctgatgcagagcgggtgctcgccggcggcgaggcagatggcgtcggagctcctcaagatgttcaaggtgaacgccaagagctgcctcgccggctacgactccaagaccacccacatcatgcctttctaaaacccaaaaaaaaaaagagaaattcaaattctccattaatttgtcagcttcgttcgatagagaggaaaagaatcgagactggagaaagacaaacttgtacatggttagagaaatttttcctagaaagaaacagatcaaatttcttctttgttctttggccaaaattcagtactgccatgatgtgttcaaacaaattcagtgttgcaagggaagggcagaatgactttcatctttgcat

SEQ ID NO: 322 - DNA, 4455 bp, Sorghum bicolor
ctcgtctccgccgctgcaatcagcaaccagcaactcccatgtgatgtgatgtgagcgaggccgcgccgcgtccgttgcccgtttcgtttcgtgtcctccctcgccaaccaaaacccgcgtcccttccctcccctcgtgttccccagtgtactcggctctctgtctgtcttgcttgcttgctgcttcctgtggacttcgtcgtcttccagcttccaccctccctctgctctgtctgtcccccactcggacctcggagctcaccaccaaaccaccccatccggccgtccccacggctgcctactactactagtacccggcgcttccccttccgcttcattcatttgccaccgccgccctctcctcgtcccttcgcttctgtccgtcctacatctactagctccttcattcattcaactccattcccttcaaagaggacgagcaagaagctccacagattccgactcctcatctcggatgatcatcagccaccactgacggatccgtagctgctgcatccagttccgtcacccggaccggccgccatggcctccaacggcggcgggctccgccacagcaacagcaaccgcctctcccggatgtcctactccggcaccggcgacgacgcccgcgcgcaggccgccgtccccggcgaccgtcccatggtcaccttcgcccgccgcacccactcgggccgctacgtcagctactcccgcgacgacctcgacagcgacctcggcaacgccggcatcggcgacatgtccccggaccgcgacgaccagccgcagcagtacgcgagctaccacgtccacatcccggccacgcccgacaaccagcccatggacccggccatctcggcgcgcgtcgaggagcagtacgtctccaactcgctcttcacgggcggcttcaacagcgtcacgcgcgcgcacctcatggacaaggtcatcgactccgaggcctcacacccgcagatggccggcgccaagggatcctcctgcgccgtcaatgggtgcgacgccaaggtcatgagtgatgagcgcggcgacgacatactcccctgcgagtgcgacttcaagatctgcgccgagtgcttcgctgatgccgtcaagaacgccggcgccgtctgccctgggtgtaaggagccgtataagagcacggagctcgaggacatcgtcggcgctgccaacgccggggccggagctaggcctacgctctcgctgcccccgccgcctggcgccgccgcgtctaggatggagaggaggctatccattatgcgctcccagaaggccatgactaggagccagactggagactgggaccacaaccgctggctctttgagaccaaggggacgtatggctatggcaatgccatctggcccaaggagaatgaggtggacgccggaggcgttggtggaggcggaggtggagctgatggccagccggccgagttcaccaccaagccatggaggccgctcactcggaagctttccatccctgctgccatactcagcccatacaggcttctcattcttatccgcatggtcgtccttgctctgttccttatgtggagaattaagaacaagaatgaggatgcaatgtggctctggggcatgtctgttgtctgtgaactctggtttggcttttcatggctgcttgaccagctgccaaagctgtgccctgtgaaccgagccaccgaccttgctgtcctgaaagacaagtttgagactccaacaccgtcgaaccctactggacgatcagatttacccgggcttgacatatttgtgtctacagctgatccagagaaagaacctccattggtcacagcaaacactatcctgtccatccttgctgctgactaccctgtggagaagctttcttgctatgtttctgatgatggaggggctctcctgacttttgaagccatggctgaagctgctagctttgctaatatgtgggttcctttctgtcgcaagcacaacattgagcctcgcaatcctgacagctacttcaatcttaagaaggacccttacaagaacaaggttcgccaggattttgtcaaggacaggaggagggttaagagggagtatgatgagtttaaggtcaggatcaatgcgctgcctgactcgatacgccgacgctctgatgcgtaccatgccagggaggaaatcaaggctatgaagaggcagcgagagactgctcttgatgatgcagtagagcctgttaagatcgctaaagccacctggatggctgatggcactcattggcctggtacctggattcaaccttctgctgagcatacccgtggtgatcatgctggaataattcaggtgatgctgaaacctcccagtgatgatcccttgtatggcagcactggtgacgaaggcagacctcttgatttcactgaggtcgacatccgtttgccaatgttggtctatgtgtcccgagagaagcgccctggttatgaccacaacaagaaggctggtgcgatgaatgccctagtccgttcatctgctgtcatgtcaaatggccccttcatcctcaacctcgactgtgatcactatgtttacaactcacaagctttccgcgagggcatgtgcttcatgatggaccgtggtggtgaccgtattggttatgttcagttcccgcagcggtttgagggcattgatccatcagatcgctatgccaaccacaacactgtcttctttgatgtcaacatgcgcgcactggatggtatcatgggaccagtctatgttggcaccggctgtcttttccgccgcgttgccctctatggatttgaccctccccgctccaaggaacatggtggctgctgcagctgttgcttcccccagagacgcaagatcaaagcttcagctgctgcaccggaggagacccgggctctaaggatggcagactttgatgaggatgaaatgaacatgtcatcattccccaagaagtttggtaactcgaacttcctcatcaactccattccaattgcagaattccaagggcgtccgctagctgatcaccctggtgtcaagaatggccgtcctccgggtgctctcactgtcccccgtgaccttcttgatgcatccacagttgctgaggccatcagtgtcatctcatgctggtacgaagacaagaccgagtggggccaccgtgttggttggatctatggctcagtcacagaggatgtggtcactgggtaccggatgcacaaccgtggttggaagtctgtgtactgtgtcaccaagcgtgacgccttccgcggcaccgcacccatcaatctgactgaccgtctccaccaggtgctccgttgggctaccggttcagtggagatcttcttctcccgcaacaatgctctgctcgcaagccgcaggatgaagttcctccagaggatcgcctacctgaacgtcggcatctacccattcacgtccatcttcctgatcgtctactgcttcctgccggcactgtccctgttctcggggcagttcatcgtgaagactctcaatgtggcattcctaacctacctgctggtgatcacactgacgctgtgcctgctggcggtgctggagatcaagtggtcggggatcagcctggaagaatggtggcggaacgagcagttctggctgatcggcggcacgagcgcgcaccttgcggccgtgctgcagggcctgctgaaggtggtggcgggcatcgagatctccttcacgctgacgtccaagtctggaggcgatgatgtggacgacgagtttgcggacctgtacatcgtcaagtggacatcgctgatgatcccgcccattgtgatcatgatggtgaacctgatcggcattgccgtgggcttcagccgcaccatctacagcgagatcccgcagtggagcaagctgctgggtggtgtcttcttcagcttctgggtgctggcgcacctgtacccgttcgccaagggcctgatggggcggagagggcgcacgcccaccatcgtcttcgtctgggcaggactcctctccatcaccatctccctgctgtgggtcgccatcaacccgccatctgggaaccagcagattggtggatccttcaccttcccctgaagctcttgccggtttcattgtcgcatggaatggaatggaatggaattcttgctttgtaccagctccagcagcgtttcatcctcagactcagcgctgctgcgggaagtgggattctgactgtcgaaatggctagggcctttttgtcgaaagctgatactgttatgatgagctaaagtagttcttttgttcttttatttttgttattatatatatacatatgttcagatcccaggattggttctgttggactattaaacgagcacaaatttccagtcttctggatgttgcatgctggcctttgaaatgtctcgtgctggtgatgtctgatgtgctgggatgcatttgctttcaatgtaaaagatagtagttgaag

SEQ ID NO: 323 - DNA, 1122 bp, Sorghum bicolor
ccctctcccgctgccggatccgatctcacctgacctcgtcgccgcctgccgtgggagggagaagaggaagaggaagaggaggcggcggagatggcaccggtgtcggcgctcgccaagtacaagctcgtcttcctgggggaccagtccgtcggcaagaccagcatcatcacccgcttcatgtacgacaagttcgacaacacctaccaggctacaattggtattgattttctgtcgaagacaatgtaccttgaagatagaactgtgagactccaactctgggatacagctggtcaggaaaggttcaggagtttaattccaagctatatcagagattcttcagttgctgtcatagtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcgatagaggaaggggaaggtaaggcgaaggaccttggcgtcatgtttattgaaaccagtgctaaagctgggtttaacattaaggcgcttttccgtaaaattgctgctgcacttcctggaatggagacactctcatcagcgaagcaggaagacatggttgatgtgaacttgaggtccggcaatgcaaactcgtcccagtctcaggctcaggctgggggatgcagttgttagttgcagtctctgacacttgctgctcatgatctctgagaccctgagcatcagaaagcgttatcactgatgcttccctcgggaaggagagttgattgcctctcagccagtgaacacaccataggctttacccggtgaatggaccatttgcattggaacgatacgttttatgagttctctagtgttatttcctcagtggcctaagctagcaacagtgtatagttgggttggcactgcaaacttctaccattcgagttgggtattagagctagttattggttcatgttgaacttatatattttccatcttgttgcagttagcttgagtcatgtttgctatgtgtaccaaacatgtattggaatttggaatttttgtaagctaaaataaggccagcactgcaatagcccc

SEQ ID NO: 324 - DNA, 3138 bp, Sorghum bicolor
catgtgtgtgccttccgttctggaagacgataccggggactacttgttgccatgccattgctgtagcgctgtggaccatggaagcaatgcaactgtagcggcagcagcagcagtacgtgtgcccccacattgatcgctcgcatcatcggtccctgacctgcaggaggaggaggaggtactcagctactcactcatcactcgccacatgcaaagctctgaccccagtgatccatggaccgtgtccctgtcccttaaaccctactagctactacaccctctgtccatggccggtctgtgctcgctcttcatcacgcccttaaccccttttgattaccttgtcatccatctcaccacctcacgtaaacttttttgaaagataggagaccataataaactggcagttagctaggacactgatcgctccctttgttcccctttgtttcataaatcatcttgagccaacgagccatgacccatgagccatgcctgtgacctgtgtgtgttcatgcaattcaagctcacagtcattgtggtggcgggtacagaaattgaaggtgctagctgttgctccgaggactgtaaatagttcctcacatgcatggccggagcagcaggggggacacatcacagacgtctgaggaggcaatggagcaatcttctcccttgcagtgatcgaggtgctagtcccagtcccagtcccagatagagacagcaatgagtgatcacagagcctctgctgccaattcattctgcatccttctgcatctgccggtggccggtgcagatgcgtaatggcgggggaggagcaggagcagcaacgccggctgcagcagggttgagtagtgcgtcttgcggagcagatgggcaaggcgagccggtggctcaggaacctgttcctgaccggctggaaagggaggacggccaaggacaggggagctgctgacgtcgactgccagtcggtgctgtcggcgccgctgccctcgcactcgctggcggcgacagcgacagcgacaccgtccgggagggagaagaggcggtggagcttccggtgcccgggcgcgtccggcggcgcacagggacagggcccgctcgcgtcctcgtcgtcgcactgcttctccgaggccgaggtgcatgtcgtcgtcgtggcgcaggagcaggaccagcagcaggtcgctgccgccgccgccgccgtcgtccctgggactgcgttgtcgtcgtccaccgcgggcacgaggaggaggagcgccggcggtggcgatcgtgacgcggccgcggtcaggatccaggccgccttccgatcgtacctggtaatggttgctacagttcggtgtgatgaaattgcaaacgagaagtttggatgcataaccacggacacagaatggttagatgtggagagtgctgtccaatctggtccagtacctggttttggaaaaaaacttggcaatatcgtggacgttcacttgcaagagtatgacaaagaagctatctattttgatgaagctgttaggaaaggaaaacgagagcatttggagtccagaatactgaatcttgtccaacctgcattccagaaaatgttgactcatctgcgcatgaaggctctagaaaaatttaaaactggtcttaattcatctttggagagtggaaaaggattcgcggtatctgctcgagacaatactgaatgctctctcaaagactttgaacaaggctgtgcagatgctataatcaaacaggcgaactgggactgctctaaaatgctagagaaagttcggcgtgatattgaagaccatgcactttcaattcgtgaaagcaagctatcagaattgacaacccatgctaaggagaaactaagaaaagcacttgctgaacctgtggagtctctatttgacgctgcagaccaaacaacctggcaatcaataagaaatgtttacaaacgcgagacagaggccatcctaccggagtttctgaaaaccctttgtgggtttgaaatggaatatggtccagcagaagaaatggtatccaaattaagggattatgcccggagtgttgtggaaagtaaagctaaagatgaatctagcaaagtattgatccatatgaaggagaggttcacaacagtgtttagccatgacaaggattcaattccaagggtctggacaggaaaggaagatgttcgtgcaatagcaaaggaagctcgatctgcggctctcaaacttttgtctgtaatggcggccattcgctgggatgacgagccagatagtattgaaagcatcctcacttcaacacttctggaaggctctgttgtatcaaaaattgcacatgctgcttctgctgatccacttgcttctaccacttgggaagagattcctccaaagtatacaatgattactccttctcagtgcaagtcactgtggaagcaatttaaatcagaaactgagttcacgattacacaagcagtatctacacagcaagctcacaggcgtggtaatagtaaactgcctcctccttgggcaattgtggccatcgctattcttggtttcaatgagatcatggtgcttcttaggaatcccatttatctgttcttgctatttgtgggctacttgatgttcaaagctttggcggtgcagctagatgtcagcagagaattccaaaatggggtggttcctgggataatctctgtgtcagcgaagctcctaccgacgatacagaacctggtgaacaatgtggcagccgagcagcaagccgagcaccagcacccgcaccctcaccctcacccacaggccgcagaccccccacagccacagatgcagccgccgccgctgctcctgagcccgagaagccccatgagcgagcttcggaggctgcacatgccgtcaagcccgcggaaggtggcatccccggtgccatcctcgtcgtcgtcgtcatctgccgtatcgtcccctaggcacactggcgaggatcagaagccaagaccaggggtagggggagctgagaacccgtctaccgtcgctgactcgatagtgtgatgactgatgagccatggtggcgtttgactggtatgtagactgtgtggcattagaagtacaagcagaggtatggagtatggagtatggaccttgtgttgtcccctatttcaatgcatat

SEQ ID NO: 325 - DNA, 1727 bp, Triticum aestivum
gcgagcggtacctcgaaagacggacaagagatggcgtggcggctggcgctgccgctgctgctcttctactcccccatcctcctctgctcctcccaagtccaagacaatgatccctccaaactgttcaagagcgcctccgagatgatgagcctaaggaaatacgacggggcgctcggtctgctcaacgctatcctcgagctcgaccccaaccattccgaagcttacaggcagcgcgcaacagtgcttcgtcacagatgcagacacaaggaagctgagagtgactataacaaattcctggagctcaagcccgggactgcttcagtggagaaggaactagctcagctgctgcaggctcaaaacgcattggaatccgcttatacccagtctgatgctggagaattctcaaaagtcctggagtacgtcaacaaaatcgtgctcgtcttttctccaggttgcttaaaggcaaagcttctcaaggctaaagcgttgctagcactgaaagactattcgaatgttatttcggagacaggatttattctcaaggaagatgaagataacttggatgcgctgttacttcgtggtcgagcatactattaccttgctgatcatgatgttgccaacaggcactatcagaaaggcctacgtctagaccccgagcattcagaattgaagaaggcatattttgggttgaaaaaacttctaaagaagaccaaaagcgctgaagaaaatgctgctaagagcaagtttcgcgtggctgttgaggactacaaggcagcactagcaatggatccagaccatactttgtacaacgtacaacttcatcttgggctctgtaagactctggttaaacttggaagaggcaaggaggcaatcagcacctgtacggaagcactcagcatagatgaagaacttgttgaagctttgtcacagagaggtgaggctaaacttctaacggaagattgggaaggtgcagttgaggatctaaaagaggctgcccaaaaatccccacaggacatggcaatccgagaagcgctcatgaaagccgaaaggcagctgaagctgagcaaaaggaaagactggtacaagatcctgggcatctcgaagacagcgtcggccgcggacatcaagcgcgcgtacaagaggctggcgctgcagtggcacccggacaagaacgtggagaaccgcgaggaggcggagaacatgttccgagagatcgcctctgcatacgaggtgcttagcgacgaggacaagcgtgtgaggtacgaccggggagaggacctggaggagatgggcatggggggaggcggcggcggtggcttcgacccgttcggcggaggcggcgggcagcagtacacgttccaccacggcggtgggttccccggcggggcttccagttcaacttcggttaattaaaagcaggccaggcttactcttttgttgatgatggtgatgtcctagttttctagtagtgtgtcctggtctttgctttaggagggagagcttaacggcaacatgtgttaattatactatatctctagctaagagcttttactaccgtcgtcttggctcttgttactctggttaaagaaagttttgcttaagcaccaacgatacaacaaattttccctgagattaattaattgtaccactgtattatgatttatagctggttatttgtgatgcatcgaccagttcattggaaataaggtacgtactacgaaaaacgg

SEQ ID NO: 326 - DNA, 1461 bp, Zea mays
tcaaacatgtgtcgttctatgtgacaagagggtaccatagaagctaaaaggaatgttttatagaactaattagacctgatatggtgtatggtgcagaatgttggtctacaaaaagacgacatgttcaacatacaaatgtgttgtggaaacacatatgttgcattggaattgtggctatacaagaaaggacgagtccgaaacgataatatacatggtttggacatgttgaacggtgacctgcagacattagtgtgtagtaggatactaagatgtaatagcaataggaagagagacatgagaacgacaaagttgatatggtggaggagacaataaaaggagaatgaaaatgatgacatatagtgcatggaaaacagctatccatgtattttgatcttgatttgtggtttctgttgggttttaactctagcctaccccaacttgcttaggactaaaagactttgttgttgtacctatgttgcttgatttttacttctgttttagttcatttcacatacttttctgaataggaatatgcatatgcaaagtgttcttttttttagctcccagtatatgttgatttatgcatttcagtggaccaatacgcctttagtattgcgcatacaaagacaatataagtttttgccgtttttctttatagggtgttatcatattgtctctgggacatttcctcagaattaaggttcattaacggtgcacatgatttggtacaatttggctatgctgtttcagaagtcataacctctttctaccatacaaacacaatataagtttttgctgacaaacaggaaggattggttaagattctcaagaaatatgacaagagaactggagccctgatccggctgcccttcattcagaaagttcttcagcagcctttcttcaccactgatctcctgtataagcttgtgaagcagtgtgaagccatgctggagcagctccttccggttagtgaggcatctgtctcaagtgaagatggaaaaggagactctaatgatgaagagaagctggcgaagccaagttcttccttggtaaatggtggtggcatgccagagttagatgagatcgagtacatggagagtatgtacatgaagagcaccgtcgcggcccttaggtcactgaaggagatccggggcaagagctctactgtcagtatgttctcgttgccacctcttcagggcaacaatgcacaggacagctaccagatccgggcagagcaactagatgaggagccggagaggtggagcaaagtaacagtgatagagcaggcggccaaatgacagaccgaatgggcaaaacatctgatggctgaacttaaaaattttagacttggacatttgctggagatgggactgggatcccaatctcccattcagaaatttgtatgaattcaggattcctaacagctgcgaaatggtggacatgttaaatcatagaattccc

SEQ ID NO: 327 - DNA, 2090 bp, Zea mays
ttttaattgagaaatccagtacaacatcatggtttgcatacaccacgttacctaagatatcaatttgtttaaatgcattttctcctgcaaaattttgattttgacaaaatagacatcgttagattttttgtgttaacatctcatgctgatctgtgtagttgctatctgagatgacttccagtaagctaaatcttgagaagttggccatactatgttggctcaattctaattgtccattttcccagggagaacatattggatggtattgtggtgtttacccttctttttgggagtgagctgttcgaggactatattagccatcttgcaatggcaacaatggcttcctctaagttgacaagtgataaggacaaccctaaaaagcttcaggataggctcaagaatgtgcaaagggaaagagagtagaagctagctagattcctcaattaattcttctctcagtatgttcgtggagacaaagaaggatttgctaatcgtgctgaagccgaggcaaagaggctcccaatgcacctcatctggattggatattcttcgcaccattggatatgtctattctcgatcagcaaaggagcttggcaagaaggccatgtacctaggagtgccattcgtatgcgagtgggttaggaacaagagtcattcatggaagtcacagatcacaacattgaaagggcggaagaagttttgaaagaaggagaggcgggtcccgtcaagaagtatgatgccgacatgaaggccaagggggcgcccatggagccttaatttatgcccgagctcagattgcttgttgggttgaagctgctcgctggggaggacggtagtggcggctgggcttctccttctccggaagaactgcggtgcggactgaaacttttctgctgtggcagtggcggcgtcatgcacgtagatggaaggggtgtcgaagaaacttttccgttgatttcaaggagttgcagagtacctccaaatcatagaagaccagttcatacagaagaaacatatagaagcctaccaagttgtcaaattgccgatgtcgcttgttcttctcacatcaaccctcctatacccctccaccatggagggtcagcagtgaggcatgttcccctatctcagaacaatgacggtgaggtaagataagatagtttaagattttcagttattttctcaacaactaaagttgggcatgtcacatgtgtagtgttctactgttcttggtctgtattaatgacagatgctctgtcgcaggacccgcacgtggtccgcctgctcgacctcaagcagggcgtcaacaaggaggggcagaccatcctgtacctcgtcttcgagtacatggacaccgacctgaagaagttcatccggggctatcgcgccaaccacgagaagatccccgcacaaaccgtcaagatcctgatgtaccagctgtgcaagggcgtgggttttgttcacggccgcggggtgctccaccgtgatctgaaaccgcacaacctgctcatggaccgcaagaccatggcgctcaagatcgctgacctcggactcagccgtgccatcaccgtccctgtaaagaagtacacgcacgagattctgacgctgtggtacagggcgcccgaggttcttcttggcgccacacactactccacgccggttgacatttggtccgtggggtgcatatttgctgagttggttactaatcagccacttttccctggcgactccgagttgcagcagctcctccacatcttcaagttgctgggcaccccaaatgaggagatgtggccaggagtaggcaagctgccgaactggcacgtgtacccccagtggaagcccactaagctgtccactcttgtccctggtcttgactccgatggctatgatttacttgaggtcagtgaaaagtatgcaacgcacttgtcatcgagaatttgtagtcacggattgttattctaggggcttagaaattgatcttaggcaccgtagaatctaacaataactactttatgaggcaagttacagctttggtgttctatttgtatagccataactcctttcatcagcgtaggtctgtgcatcaaatgact

SEQ ID NO: 328 - DNA, 465 bp, Zea mays
gttttatcacattttgactgacttgtactcgtttaatgaaaacagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacgaggcctggactggctgtccagcaacattgcgagcaaggcttgaatatcaaatgcgaactgactaggagctccggatgtatcatggaaacttaggacagaatcgcctctacaacctgttaggtgtcttctaccggcac

SEQ ID NO: 329 - DNA, 2448 bp, Sorghum bicolor
gatgccagcccatgaacgctggtgggcctacccaagtacccagcctttcctccacagcctacccgggaacgaagaagcccacgcctaacggccgtgccaccgccctcacagttccaggcttccagttccagctcacccctgcttcctcgggcggcggcgccgccgccgtttggcgcacgcgcgatgccggcgacggcggaggactccccggcgatacggaagctggggcagctcttccggctgaccgaagtatacctctgggacgattcgtatggcgctggacctcacgatggacggaagaactggcgctcggcggaggctgctctcgtggactctcatacagataaaacatgcaatgaagcatccaatggcactgacaaaggccatttgtttgttgaagatttggaattggccaacctcatgggttctttggggcttcctgtttcattcagcacaagtaaagtgaacaagaacacaggcaacaagggaaagaaaaaaggaagacaagcactgctcaaagcagcaaagactcaaatcaatgatgctgtgaggatatgtgccaatactgaagatagagaaagtgctgttgaatcattggatgttatggcgcacatgcactcatgcaatttatctgggactccgctgggtcacaatgaaccctgccatgatgacactgacaagatgcttagggaagacagtccttgtgttgaagaacaagaagagtctggctgtagcaccatctattctgctgacaaagcccctagctgtgatgctaaaaatctgctcactgaacttgggacttttgagctttctgataacttgggcaacccagcaaaagaagattattcaattcaagaaaatcaagcctctgacagcgtgttgctagattctgaagagatgccaaggcatgactgtgttgatggtgaatctacacattcctgtgtcgacatttatcaggaagaaagagtgtccacaagggaagatcaaacatctgaagaaactctgtcagtatcccatgatcataatgatgttggccaagaagctagtctaagtttggcagagccatcttctattgatgagcatgcacaaagttctgccaacaacttttactatgactatggtgaatggagggttgtctgggatccgttctatagtcggtattatttttacaacatccagacacaagagtccacatggtgtcctcctgaaggattggaggattttgcatcatattgtagcccagataccactaaagagctagttgaactgggatctcagtgtacaagcatagcaccgcaagagaacaatctggctactgatgacaatcatttagaagcacaggaacaagatcactgcattcatgatttatctgacattcctgtcgaaaaagcaatatatcaaagtatgataactacctctgacaaagcacagcacactgaaaataagtacagcgattcaacaactattgtgttagagatgaaccaggaagttactaccaccaaaaagaaaaagagagttgcacttttacataatagtttcttggtttctttgagcaaatgcaactttgcatggctgctacgtattgcctacttatgtctagatcattcatgccaagacatggcagggaacatctccaatgacatcatcaagtactggactcagcggtactcacttttctcactttttgatagaggtataaagatggatgaagaagggtggttttcagttacgccagagcctattgcaaagcatcatgcatctcgtgttggtgcgggagtaatcattgattgtttcacaggagttggtggaaatgccatccagtttgccacaaagtgcaagcatgtaattgcagttgatattgatccacaaaagattgattgtgcacatcataatgcatccatttatggagtaaataatcacatagatttcattgtaggtgattttatacatatagctcctcatctgaagggagaaactgctttcatgtcgcctccttggggtggacctgactatgccaaagttgatgtttatgatatgaaaagcatgcttttgccttgtgatgggtactctcttttcaaacttggtactatgatagcttcaagagtagtgatgtttcttcctcgcaacattgatctaaaccaattggctgacatgtccttgtctgtggaccccccatggtcggttgaggtcgagaagaacttcctcaacggaaagctgaaagccataacagcatactttgaagaacaggattgttgagtcgcgcatcggcactggtgatacaaatcatcttgtgaacttaggactcacgaccaattttggagggaccttgagtataggacttaggacatgtccctctccaatggatacaatgaaggggtcttggatgttttcaccaaaggacatgccccttcgcctttggtgaagacagtatttgctaattgatcaata

SEQ ID NO: 330 - DNA, 6190 bp, Sorghum bicolor
cggcctcattcattttacctgcccggcggcgactctgctctaagttgctgacggcgagcggcgcggacgacgagcaggcagcccgcggcgtgtcacgagagagttaggcgagtctgttagggcatatagtcgcagcggaccagcgtggcagcggcgcgcgaccgaggaggttagagcgctcgccgctatggcgccgccgcgcggcgacaggaagaaggggaagggcgccggcgggaagaccgatctgcgccccgaccggaagcagttcaaagggcatcgcaaggaggttgcagccgctgagcagggggatggcgacggagagcggcagcagttggcagcgccgggttccgctgcgctcctcgccgcagcttctgacgaagctgacttcccgagagggggacgcagcctcctgagcaaggatgagatggcggaggctcgcgcggaggcggagcaggatttcgagagggaggggaagaagggtaaggggaaaaggaagaggaggggcggcgagtcgtctggttttggcccggacgatgacttggggacactctttggtggcgccaccactgggaagctcccacgctatgctaatcgcatcacagtaaagaatatttcaccaaatatgaagctctggggtgttgtaattgaggttaaccagaaagatattgtgttaagtctacctggtggaattagagggtttgttcgctcagaggatgtgtgcgacattgctttgcaggaaaatcgcaaggatagtgagaacagtttatgtgcaaaagttgttcatgttggtcagcttgttccttgtatagtcctacgagttgacgatgataagaaagaaggaaaagtacttgctgcccaagtcaaaagcattgaggaccatggttacattcttcattttggagtatcctcctttagcggatttatgcaaaaggatgacaaagaaaatgtgaagattgagcgccgacaactgatgcattgtgttgtgaaggcgattgacaaaactcgggctattgttcacttgagctctgatgaagacttgctttgtaaatctattattaaggatctgaaaggcctttctattgatcatttgattcctgggatgatggttaatgcacgcgtccattcagttcttgaaaatggagtcatgttatcatttcttacttatttcagtggaacagttgatatttttaatttgttgaattcctttccctctggtaattggaaagatgattacagtaagaataagaaggtaaatgctcgcatcctgttcgttgatccatcaacaagagcagttgggcttacattgaacaaacatttacttcatcttgaagtaccccctattaatctaaaagctggagatatctacgataaatcaaaggtgctgagggtagataaaaaggctggtctttttctggaaataccttctccaactccatcacctggatttattagtatacatgatgtgtcagacaaggatgcaaaaaacttggagaagtttaaggaaggcagtagcttacgtgtccgtatacttggagtacggaatcttgaaggagttgcaataggcactgtaaaagacagtgcttttgaagggtctgttttcactcatgatgatgttaaacctggaatgttagtgagagctaaggttgctactgtggagccattcggtgctattgtacagttttcaagtggtgtgaaagcactttgcccgcttcctcacatgtcagagttggaacatgttgtgaaaccaccaaagaaatttaaggttggagctgagcttcttttccgtgtattgggctgcaaatccaagagagttacagtgacatacaagaagtctctggtgaaatcaaaacttgatgtgctagcatcatatgctgatgcaaaaattggtttagtgactcatggatggattactaaaattgaaaagcacggttgctttgtaaaattctacaatggagttcagggttttgttagcagatctgaccttggattagaggctggaactgaagcagaaaatgtttatcatgttggtcaagtggtcaaatgtagaattatcaatgtgatacctgcttcaaggaaactaaatgttagttttgtcatatcccataatagggttattccaatagacactccaaagttgggtagtattgtctctggtgttgtggaacggcttactcctgcagctgttgttgtcagtgtaaatggcttctccaaggggacaatactgaatgaacatttggcagaccatcatgatattgaaggtcacaatttagttctttcggcaaagcactcacttatcaattgcgcaaatgacattccttctgagatatcgcagatgcatcctggagttgtagttcatggttacatctgcaacattatcgaatctggatgttttgtccgttttctcggacatttgactggtttctctcccaaggacaaagcagttgataggcggatagaaaggctttctgatgcgttctatgttggccagtcagttcggagtcatatactcagtgtaactgcagaaactgctagagtaaaactctcacttcaacagtcaatgtgctcctcaacggattcttcgtttattcaaggatactttcttctggatcagaagattgcagcattgaagtactcaagcaatgattgggctcacacttttggcattggtagcttagttgagggggaggtgggagcaatagaagaatatggtattatccttaacttcaaagaccatctggatgttgttggcttaatcgagcaccatcagcttggtggcagtagtgtggaagtggggtcttctgtgaagggccttgttttggatttatctgatggagttgttaatttgtcccttaaaccagagctaattggcagtgttagaaatgttggaaaaaagaagaaacgccaaagggctgcagttgcagacttggagcttcatgaggaagtgaatgcagttgtggaaataatcaaagggagctatttggtcctttccatccctgagtacaattacgcaattggttttgcaccactgatggattacaactcacaactgcttccccaccaccactatgataatggacaacgcattactgtggttgttggaaatatcccaagttctgactcttctggaagacttatcctactaccaaaggcttcagctcagtattctgccctctctgaatctaaaagggctaagaaaaaatcaggctacaaaattgggtcacttgttgaagcagagattattgatatcaagccgcttgaacttctactgcaatttggtggcaatcttcatggaagaatccatattactgaggttcctgaaaaggattctgatgagcatccctttagtaaactcagaatagggcaaaagcttactgccagaattgttgcagaggctgaaccttctggaaagagtggcaaaaacttcaaatgggaattgtctattaggccatgtatagtcaacggagagtttgacgaattaactgctcaaaaagaacaaaagcacaccacaaatgagattgtacgtgcttatgtcgtcaaggtggataaggaatgggtctggttaactgtatcaagaaatgttatggctcatttatttgtacttgatagttcttccgagcccagcgaactgaaagaattccagcagcgctttagtgaaggccaagcagttaaaggccgtgttatcaatgtgaatcgggagaaaagattacttcggttgaaggcacttgataaccaatgcacacagctgaatatagatgaaatacaacaatcaaagtcctctgtgtttgaacaaacaaaacaaggagatatcatcggtggacgtgttcaaaaaattctacctggcgttggtgggcttgtcgttcagattggacctcatctccgtgggagggttcattatactgaaattgttgactcatgggtgaccgaacccttgtctggattccatgagggccagtttgtgaagtgcaaggtcctgtctgtgagccgctcatcagaaggatcacttcgagttgatctatcactccgttcatcaaacctgatcagagactctaacaactcaggactagttgatgatctggcaacctgtacctcccggatcgaaaagatcaaggatctgcttcccggaactgagattaagggctatgtgaagaatgttaattccaaaggatgttttattatgatttctcgaatggttgaggctaggattactctatcaaatttgtcagatgagtatgttgaaaatccgcagaaggatttccctgttggaatgcttgtacacggaagggtcctgtctacggacccatcatcagggagagtggaggcatcacttaggaagaccacttgttccaaattggaaaagctggatgatattagttatagtgatttgcatgttggggatatcattgatggccaagttaagcgggttgaatcctttggattattcgttacaattcggagaagtgaactggttggtctgtgccatgtatcagaactttctgatgaacctgtcgttgatattaactcttgctataaagctggtgatatggttaaagccaaaattctgaagattgatgagaagcggcatcgagtatcacttggaatgaagaagtcgtactttgattctgatctgactgctgacacaaatgatgatgaagatgatgaaagtgctcttatggacatcagtgttgcccctcagatggttgaatatcataatagaagtttagttaatcgcaaagcagaaccaatggcttctgtgccgcctcttcaggtttccttggatgaatctgaatgttctgacctagaggataataataataataaaggccctgaaattgcaaatggaactgaagcaaatgctaaaaagaatgataaacaattaaagaaggaagcaagaaaacaaagggaactagaaatcagtgctatggaggaaagggctttgcagggagatgtaccacaaactccagatgattttgagaagttggtcaggagctccccaaatagtagttttgtctggataaaatatatggccactttgttagatcttgcagatgttgagaaagcacgtgcagtagctgagagggctttaaaaacaataatcccaagagaagaagaggagaaacttaatgtttgggtagcatatttcaatctggaaaatgaatatggtagtccacgggaggatgctgtgaaaaaggtattccaaagagccttgcaatattgtgatcccaaaaagttgcacttggctcttcttgcgatgtacgagaggaccgaacagtatgaacttgcagatgaacttcttgacagaatgaccaaaaggttcaaaacatcctgcaagatatggttatgccgcattcagttcgccctcaagcaaggcaaggatgttgcgtgcatcaaatccattgtaaaccgtgcgcttctaagtttgccacataggaagcgcataaagttcctctcgcagacagctattctagaattcaaatgtggggtgcctgaagaaggaagatccagatttgaactaatattgcgggagtacccaaaaagaacagacctttggagtgtttatcttgaccaagaaatccgccttggtgacatagaagttatacgggcattgtttgagagggtgacttgtcttaccctacctccaaaaaagatgcagttcttgttcaagaagtaccttaattttgagaagtcacttggtgaagacaacgaaagaattcagtttgtgcagcagaaggcaattgaatatgttcagagttcactgccgtcacaagacaacccttgaacttatgatacttgatctttacctgagacggagattgataatcccatggacaatcacgtttttgaggaagacaagcttaggaaatcggagattgataagcccaaggacaatcacatttttgctcgttacaggaagacaagattaggaaatgccagtcgtacagtagatgtgatctctttgatgaccccttgaacattattgttaaaaggtcaatgtaaaatgtgggctattcaaaattttgtttgaaactgttatataagttatgaagcattaaatctagtctgccatgtttcacccgaatgtttgaaaggatccatcctaagataaccggatctggtccccataaattgatctgttctaatgtggtattcattgttgaggcagaatgaatgggtaaccgaatgtctttctgtg

SEQ ID NO: 331 - DNA, 2686 bp, Helianthus annuus
ttggatcagaactcacgagaactgttctatgaatcggagattgaagcgatgaggccgaatgagtcgaataccatgtttattgatttctcgcatgttatgcggttcaatgatgtgttgcagaaagctatttctgatgagtatttgaggtttgaaccgtatttgaagaacgcgtgtaagcgatttgtgatgggacagaaaccgacattcataactgatgacaatcctaataaggatataaatattgcttttcacaatctgcctatcataaaaagactgagagaactgagcacatctgagataggtagactagtgtcggtaacgggagtggtgactcgaacaagcgaggttaggcctgaactgatccagggcacttttaagtgcttggagtgtggaaccattgttaacaatgttgagcaacagtataaatacactgagccgatgatatgcatgaatgctacatgttcaaagaaaggaagatggacacttctcagacaagaaagtatgtttgcggattggcagagggttcggatgcatgaaacatcaaaagaaatacctgcagggtcactgccgcgatcgttagatgtcattctacgccatgacattgttgagcaggctagggctggtgacacggtgatctttacgggcactgtagttgtgatacctgacatattggcattggcagctcctggagaaagagcggaggttcgtagagaatgtggtcaaagtcgacgcactggcggtggtagtgtccaagaaggtgtcagaggtcttcgtgcattgtgagttagagatctttcgtataagcttgcgtttattgccaattcagtgcagatttgtgatggtacaagggatgctgacatacgatataggcagagggacgccgaggatgatgacactctacggttcacgtcggaggaggtagatgaggttacacaaatgagacgtactcctgactttttcaacaagcttgtcgatagtatggcccctactgtttatggtcatcaagacatcaagcgagcaatcctgcttatgcttttgggtggtgtccacaagtttactcatgaaggaatcaatcttcgaggagacatcaacgtttgtattgttggggatcccagttgtgccaagtctcagtttctcaagtacacaacaactttagttccgagatctgtatatacatctgggaaatcatcgtctgctgctggattgactgctactgtcgcaaaagagccagaaaccggagagttttgtatagaggctggtgcactaatgcttgctgacaatggtgtttgttgtatcgatgagtttgacaagatggatgtaagagatcaggttgccatacatgaggctatggaacaacaaacaattagtattacaaaagcaggaatacaagcaacgttgaacgcaaggacgtctattttggctgctgcaaatcccactggaggccgctacgataagtctaaaccgttgaagtacaatgttgctcttcctccagccatcctttcaaggtttgacttggtatacgtcatgattgatgatcctgatgatacaacagattatcatattgcaaaccacatagtgcgtgtgcatcaaaagcgtgaagcagctgttgatccaacattcaccactgcacaactgaagcgttatattgcatacgccaagtctaaaaagccgaagctaaatgcagaagccagacaacttttggtggattcttacgttcatctccgtaagagtgatacggctccaggaagtagagtcgcataccgtatgacagtcagacagttggaggcactaatcagactgtcagaggcaattgccagatgtcacctggacgatgaggttctcccacgtcatgttagtttagcaaccaaactcctaaaaacttcagtaatcagtgtggagtcacaagaaattgatttgaccgagtttcaagatgagaatatagaacatggtgataacgaagaaaatggtgatattggagaaaacggcgaagctcagccaggtggcgcagatgctgacgcaaacaatatgaacccagaaaatgcagatggggccggagggaagaaacttgttataacagatgaatactttcaaagggttactcaagctcttgtgatgcgtcttagacagcatgaggaaacggttcagcgagaagggagtgggttagctggaatgaggcaaagggatctgatccagtggtatgtgaaacagcggaatgaaagtgaggcctacgaaaacgaagaagaggcaaaggctgaagtcaccaaggttaaagctataatagagagtttggtaagaagggaagggcatttaattgtggtgaacgaagaggaagtgccgccacaaggggaggatgatggaaatgccagacggccttctcggaacaacaggattcttgcagtggcacccaactatgttcttgatcaactcgactaatttatcggctttgtgatactagttatttggtagtttcagaaactagacaccaaatttcattgtaaagcttgtgatgctgctacagcaatagtatgagtctaggtatgtgctctatgtagttctgtttcatcctttgttttggaacataaaaacttttttattatttaaaaaccggatattggtgtttggcttgtacttgtcacggttcacactatggtcgttttcactaggaaaaagtaatttgttctataac

SEQ ID NO: 332 - DNA, 960 bp, Oryza sativa
atagctggtgcctggtggcgagcgcaacgaaccacaaggaagagcagatggcggccaccggcgctggagaaggcaaggagacggccgccgtcgccggcggcggcggcggaggtagcctgcacagtaagaccctcctcaagagcgagccgctctaccagtacgtgctggagtccaccgtgttcccgcgcgagcccgactgcctgcgcgagctccgcctcgccaccgccaatcaccccatggcggtcatggcggcctcgccggatcaggtgcagctgttcggccttctgatcgagctgatcagcgccaagaacgccatcgaggtcggcgtgttcaccgggtactcgctgctcgccaccgccctcgcgctccctgacgacggcaagatcgtggccatcgacgtgagccgggagagctacgacgaggtcggagcgccggtgatcgacaaggccggcgtggcgcacaaggtcgacttccgcgtcggcctcgccatgccggtgctcgacgagctcgtcgccgaggaggggaacaaggggaggttcgacttcgcgttcgtggacgcggacaaggtgaacttcctcggctaccacgagcggctgctgcagctggtcagggtcggcggcctcatcgcctacgacaacacgctgtggggcggctcggtggcggcgccgccggcggcggccgacgaggcggtgccgtcggggcgggaccgctcgctcgccgcgctcgccagggagttcaacgcggcgatcgccgccgaccgccgcgtcaagccgtgccagctcgccatcgccgacggcgtcatgctctgccgccgcgtggcctgaccaccacaacacaccgatcccctctccatggatgtacttttcagaaagtgcgttgggtaaaagtaaaaatgaataaaagttgctactacttggactcttttagtcataaaatataaaaatttggatgatgtgagta

SEQ ID NO: 333 - DNA, 1700 bp, Oryza sativa
cacagtgacacacacaccgcgagcgcgccgctcgcgagtagagtgggagttcggttcggcgaggcgagaccggccatggcggcatcggagaccgcgccgttcggcgtctcggcggcatccaagggcggcggcggggtggcgggggcgagggcgcagcacgggcaactggcggtggcggggcgggtgcacgacgcgctcgtcttcgcggcgggcgcggtggcggcggtgctcgtgctgctggccacggcgtcgttcctgtcgcccatgcccgtcacgaacctcgtcgcgttccgctccctcccggtgtcggtcgcctccacgtccgccgcctccgcggcgatcgacgccgatgtcggcgtacgcggcgggccgggcgcggcggggaggacgttctacgacgactcgagggtgtcgtacgccgtggaggtcgggcggcgtggggggatcaccgggtgggacgcgaggcgggcggcgtggatgcgactgcggtacccgcgcgggctcaacgcgacggcggcggggagggagcgggtggtgatggtgtccggctcgcaggcgccgccgtgccgcggcgaggggggcgaccacctcctcctccggttcctcaagaacaaggtcgactactgccgcctccacggcgtcgagctcctctacaacaacgcgctgctccagcccaggatgctcgcctactgggccaagatccccgccgtgcgcgccgccatgctcgcccaccccgacgccgagtgggtctggtgggtcgacgccgacgccgtcttcaccgacatggacttctccctcccgctccacaagtacaaggatcacaacctcgtcgtctatggctggaacaaggaggtgtacggcgagcgctcgtgggtcgggctcaacgccggcgtgttcctcatccgcaactgccagtggtcgctcgacttcatggacgcgtgggcgcgcatgggccccgcctcgccggagtacgccaggtgggggagcgtgctccacgacacgctccgggggaagtccgacaaggagtccgacgaccagtcggcgctcgtctacctcctctccgagcacgaggagaaatggggggccaagacctacctcgagaagggctacttcttccaggggtactgggtggaggtcgtcgaccggctcgacgacatcgcggcgaggtacgaggcggcggagcggcggccctcggcggcggcggcgcatctccgccggcggcacgcggagcgggagcacgagcggtacgcggcggcgaggaacgcggcggtgaggggcgccgtcccgggccccgccggcggcgggcagagcgggtggcggcggccgttcgtgacgcacttcaccgggtgccagccgtgcggcggcgagccgaacaagatctactccaagaagagctgtgccgacgggatgaaccgcgcgctcaacttcgccgacgaccaggtgctccggaactacgggtaccgccacaaggacccgctctccgacgaggtgcggccgctgccgttcgactacccagccgcccggtgacgcggcggcggcggcgccgcccccgccttggcctggacgcgcgcctagctctttcgttctctctcgttcgttacagtaaaaaagaaaagaaaatgaaattatcagtgctggtaatagcagggacagataaattcggcccaaatttgcatcttttcaagtcaaatctaccctgc

SEQ ID NO: 334 - DNA, 2844 bp, Oryza sativa
aggctgatatttagggtggatgtggaagccaactcaacagatttgaagccactgcatgaggggctaataaataagtctacatgcttcactttcttgtggtaaccttgtatgctgtatcagtctctagagaaatatcaactcattggtggaaaagaaacattctggtgtgttcataactcagccatttagagaagacaatgtcagcttcggagttcaggattccttaccagcaagtatcatcttcacagactactgagaatgcaggccagttcaagatctgccgatgtggggaaggagacccaaatacaaacacatctgaaactggtgataaatcgccaactagttgtcctaattgccagaatgcacctcccagaggaaatgaaccgattgttacactaggtggaattgacttgaataactccggaagtgttgtggtcaaagaagacaagaaacttttaacagtgttatttcctgatggccgcgatgggcgaactttcactctcaaggcagaaactacagaagaactcaatgaatggagaagtgcactagagaatgctctggcacaggcacctgttgtagcaaatactgttggccaaaatccaattttcagcactgacatagcagagcctgctgaagctccagctgaacagtcggacaataaatctatcattggcagacctgcagagtttgcccttgtagatgctgatggtagtccagctttcctggagaaggccttaaagttcattgaagattatggtgtcaaggtggaaggaatcctacgtcagtctgctgatgttgaagaagtcaaacgaagagttcgggactatgaaaaggggaaaaatgagttctccccagaagaggatgcacatgttattggtgactgcatcaagtatgttcttcgagagatgccttcatctccagttcctgcaccatgttgcactgcactggttggagcttaccgaactgacaagacaagaaggcttgatgctatgaatagagtaatttatgaagttttcccagaaccaaaccgacaactattgcagaggactcttaagatgatgcagattgttgaatcacacaaagctgtgaataggatgtctcaatctgctttggcggcttgcatggcaccactccttctccgacctcttcttctcggtgaatgtgaaattgatagcgactttagtatggctggggatggttcattccagctgcttcaagctgcagctgctgccaaccatgctcaagcaatcgtcatcattatgctcgaagaatacgatcagatatttgatgacttggaagacggttcctactcttcagatgcatatactgagtccgaagacggtgattttgacaaggaatattccacagacaacgatggccctgaagaggatgactcttatgattctggtgaagataacattgaagaaggcatggatgatgatactgagcactcatctggtggcagtgaatgtgacaacaacattaagaccagtgtctctgatgacaaggttaaaagcaataactctggcacagcatctaatggcaacgatcagggtttacaacctcctaagaaagcagcaagaacaggacatggtgcggtaagggaagacacctgccaaattgaaagcaatgatccatccaatcgaaaacaagaattatacgaatcaaatggatccacagaccaaatagaaaagttaaatgttcgctcatcatcagcaagagcaaaatttatggagaaatcaagcagctcaagaaataagagcaaaaagaccttatggggccgtacttcagcaagaaaaaacctgtcagcagaggagattgactattgcagtgatgacgagactcttattgagaagcttgagaacagcaagacagatctccaatctaaaattactaaggaggcgaaagaaaattcaatcctacaagcaagtctcgaaaggaggaaagtagaattgcataaacgccgattagcactcgaaaaagaagtggaaaatttgcgagatcagctacagaaggagagaaatttgagggtctcattggagtcagggctgatgaatttgcgaagagggcaggcgtccttcccatcaacaattgacaacaagactaaggctgatcttgaggaagttgctactgctgaagctgatattttgaacttgaaacaaaagggttctgatctccgtgggcaactcaacaaccaggtccagatgagctccgcctcattatgtgactcatgcaacaaacgactgctaaatacagacaagctaaccgaaggtgaacagagtaccacatcatcaaatgttgggcccaattctatatctgacatggtatcggctacacacatggctcaaagaatgttgatttctaagggtgagattgtgaaggatggccaagatccattggcatcaaagtggaaccttgcacagaaacaatactcaaataatccactattaggcaggcttggatctagaacagaggattccggggcaccatctgcattagccaagctgacaaatcgactcaatttcttgaaagaaagaagggcgattcttgcaagtgagatgcagaacttagatttggctcgcccgccagggcctccagctccagctccgaagagagactccacatgagaagtgagaattttaacatggcatcattatcaggctacggaactttgcactgtttggtctcaaatgtgagcaatgcacatatgatggacgttacataagctatttcactcctgctttggaagatggggattggggatgatgtatattgtaagttgtaacattaccagatgttgctcagtctgagacgcatcatcatgtgagaaaaagaggttggtgg

SEQ ID NO: 335 - DNA, 680 bp, Oryza sativa
atgagcttgtttgggcggagctccaggagccagctgacgttcaggcccaagaagagctccccttccgggagcaagggcttgccgctgaagaagcacatcgacgccaccctgggcagcggaaacctgcgagaggcggtccgtctgccaattggagaagatctcaacgaatggctcgctgtcaacaccgtagacttcttcaaccaagtgaactttctgtacggaaccctgatggagttctgcacttcatctacctgcccgatcatgtctgccggaccaaagtacgagtacaggtgggctgatggaatgaaggtgaagaagccagttcaagtgtctgctccaaagtacgtggagtacctgatggattgggtggagagccagcttgatgatgaggccattttccctcaaaagattggggctcccttccctcaaaactttcgcgaggtgatcaggaccatcttcaagcggctcttcagggtgtactcccacatgtaccactcgcattttcagatgatcctcaagctcaaggaggaggcccatctcagcacttgcttcaagcactttgtgctcttcacttgggaattccatttgatcgacagggcagagctggctcctctcaacgagttgatcgagccgatagtgtttcggtatttttaagagcgctccaacaactgatgaggcaa

SEQ ID NO: 336 - DNA, 1986 bp, Oryza sativa
atggcgaagactatggaacgaggacggcgcgagaggcgaaggatcgtgcggctccgagttagtaaggtctatcaaattgtccagttgaatagtcaatgcttattgcaaattcgatttcagaaaggtgcatccaaaaggagggaacaaattctcttctgtaggtgtggtgatcctctatctctcgtattgccctgggttttgcttatgatggaaggtcatagcaatgaactgggacgggccaacaccttgaagaaaggaggtcttcgaccaatcccggtcatcatcggtaatgtttttggcttaacaaatgaagtatctgaacgaattgtgagcgcatcagttactgcaaaccttattatctaccttacaacaaagtatcacctcggtgctgcaagtagtgcaatcatcatctttgtgtatcaagcagctgcaaattttttgcctgtgtgtggtgcaattgtgtctgatgcactattgggtcgttacctgatggttacattaacattgttctcctgcacaactgggacttttatgctattcctaacatcactaattccaaaattaacacccccagattgtggtctttcaaatcaaggttgtacttcgccatctccactacaactgtttgttctgtgtgcctctcttggtttcatgtcgctcggagcgagtggtgttcgcccctgctgtcttgcctttgctgaggatcaaattgctcattgggacgaagcccaaaaggaccgtgcactccgtggtttgttcagctggtactatgtatcggtcggcttcgcgcagatagtggctgttaccatcctcgtctactttcaagatcaggtgggttggaaggttgggtttgggatttcagccgccgttatgctatccatcacacttgtgaacttggcagcatcacccttctatgtgaagatgaagccacagaggagtatatggatcagcttactgcaagtggttgttgtgtctcttaagaaccaccacctggtacttccgaagacatatcagagtgctcagttccataatgcctcgggattaagagagctagttccatctgaaaaaatgagattcttgaacaaagcatgcattctgagataccatgcaaccaatgtgagcgatggagcaggcagaactaactcatggaacatctgtaccgtggagcaagtggagaacctcaaatctgcactcagcgtgataccgatgtggtcagcaatgataatgaccttcctgatacaaagctcatccttcggggtactacaagcagccaccatggaccggcgagttggcacaaaaaagttccaactaccggcgggctctatctcaatctttgagatcataaccttcacgatatggtcaggctgctatgaccggtacattgtgccatttcttagaagaatcacaggtaggcagcaggtgctaacccttaagcaacggatgggcattggtgtgtccttgtccattgcatccatgcttgtggcatcagcagtggagacatacagaaggaaggttgcggttaagggagggttgcagcacgatgctaagggaacattggaaatgtctgtgctgtggctggcacctcagtatgtcataataggccttgcaggcgcatttagctccattgggcagatcgaattctattatgcggtgcttcccaagtccatggggagctttgtgctagcattgctcttcttcggtgctggtgtcgcaagcatcattgcaacattagtgatcaaggccatcaacctgatcaccggtagaaatggcatggcaccatggctgtccaataacctaaatgagggtcactataactattactacttccttcttgctgtccttggtgccattgacctgatctatttcatagtttgctcttatgttttcgacgaaaggacacaaaacatgtccctggaaactagtggtgatgcaaaagacatggtagagtttcaaggctagctcaagcaatggtagtgcaaattagtg

SEQ ID NO: 337 - DNA, 1684 bp, Glycine max
gttttgttgacccaaaatgagagtcgagcgagagttactagagagagtatctaataaaccgaaagtgtcttagtcttccctgcttccgtcaactgcaatggcaatggcaattgcaatggttcctcaacctctgctgacccttttcctctttttctcccttctctcaattgccaactcttctccttcccaacaccttcagatcgccaatgccgaacgcaggattgatttgacttctcacattattaaggtgtacttgacattgaaggttgaaaatttggggacatctcctgcttcagaagtacatattgccttttcgcccactgaagtagaacatctagcaatagtcaaagctgctgcaacttctgggaagaggaagaagaaaacttatgttcctctagatgtcaaatctgctgagctacctgatggaccaaatggaactaagtttttctctataactttgttaactccactaagtaaaggtgaaaccacaacactagaggtgctttacatattgacacattctctggaacctttcccagtagaaataagtcaatcagagtcacagttggtttatttccgtgatagtgcaatattattgtctccctatcatgtcaagcaacagacaacttttattaagactccaagcacccgggtagaatcattcacagtggtggaccccactaaacgtgctggtacagagttgaaatacgggccatatgaaaatcatcccccgtattcatattctcctgtacttattcattttgaaaataacaatgcatttgctgttgttgaggagctagaacgtgaaattgaaatatctcactggggaagcattcaagtcactgagcaatatagcttggtccatgctggtgctcgacataaaggtgttttttcaagggttgaatatcaaactaaaccaggtggtactggtgtttcttcatttaaacatcttttagcgaaactaccccctagggttcactcagtatactacagggatggaataggaaatatttcctcttcacatctacgtacagattcttggaagtcagaacttgaaattgaacctcggtatcctctatttggaggctggaaatcaacctttgtcattggttatgggctaccattgcaagacttcctttttgagtctccggatggcagaagatacctcaattttacttttggttgccctcttgtcgagacagtggttgacaagttgattgtaaaagttgtgctgccagagggatccaaagatcccacagttgagattccttttgaagtgaagcaacatctagagatcaagtattcatatcttgatgttgtcggcagaactgtggtggttctagaaaaaagaaatgcagttcctgagcataatgctccttttcaggtgtactacagttttaaccccatattcatgcttgctgagccattgatgctggtatctgcatttttcttgttttttgtggcttctgtggcatatcttcacattgatctttccatacgcaagtgatgaacacctagctagtttcttgaaaggcagtgactgagcagatccaaggttccttatttttgaaggtcatattgcattttggcaattttgtatggagttaagaggattaattgcagttatagatatacttgtttgtacattttttcccaggcaatttgatcttgtgccattcatcca

SEQ ID NO: 338 - DNA, 1609 bp, Helianthus annuus
aggtcgggtaagatgagatgatgttaataagggcgatgacgacggtgttattgtggatttgtttggttcagttgactgcattaggaggttctttgggacctagggttttgaaagggtggccttcttgctttactcaagattctcattcggctgctgcgttggatgttaagttgttgcctgttcatgccagagttcttccgcacaagagggtttacaagaacaatggttacttagtggtttcatgtaatggaggactgaatcaaatgcgttcggctatttgtgatatggtcgcgattgctagatatttaaatgttactctaatagttcccgagctggataaaacttctttctgggctgatccaagtgagtttgaggacatttttgatgttgatcatttcattacatccttgagagatgaagtccggatacttaaacaacttcctccaaggcttaaaaagagagttgaattgggaatcgtgcataccatgcctcccgttagctggtctgatatttcttactatcataaccagattcttcctctgattcagaaatacaaagttgtgcatttgaacagaacagatgctcgtcttgccaataatggtcaaccccttgagcttcaaaaacttaggtgtcgagtaaatttccgtgctctgagattcaccaatcaaatagaggaattgggtagacgtgttgttaaacttttgagacaaaacgggccctttttggtgcttcatctcagatatgaaatggatatgttagcattttccggctgtacacaaggatgcaacgctgaagaggttgaagacttgaccagaatgagatatgcttacccatggtggaaggaaaagataataaactctgatttgaaacggaaagacggtttatgccctttgacccctgaagaaactgctcttacacttagagcactcgatattgaccgtgatatccagatttatattgctgccggtgaaatatatggtggaaaaaggagaatggatagccttgctgctgcctacccgaaactggtaagaaaggagactctgttaggagcagctgaccttcaatatttccaaaatcactcatcacaaatggcagcattggattatcttgtgtcactcgagagtgatatttttgtacctacttatgatggaaacatggccaaagttgtcgaaggccatcgcagatttttgggtttcaagaagacaatactcttggacaggagggttctggtcgaattaatcgacaaatatactagtggcttgctgggttgggatgaattctcgagtgctgttaaggatacacatgcgcaacgtatggggaaccctagaaaaagattggttattgcagatagacccaaagaagaagattacttctatgcaaatccagaagagtgcttgcagccatcggatgatgatgatgaagaagaagctgtgaacatcctatgatcaaggatttgcggttaatttggtatgaatttacgagagtatgatttttggtcctcgaccctgtcggtgtacaatgagtgtttgttcaaaatatgaggatgccgcgcattttggcgagagaccatggcagatgacaatgtttccacgaatgcgaaggggaatcc

SEQ ID NO: 339 - DNA, 1124 bp, Solanum lycopersicum
aagcacacaaggaacaaatttgtaaaattgtagtagtataaatagaagacgcatgttaacaccgacaaaacaacagaaatgccgatctgtagctcttcttcatccttcttcctctagctccacaaaatcatggatccttcacggcttagccgtcggagcagcagcagcagccgtagctctcggcgctcacgcttaccttagccgatccggcaagtttcggagccgggtcataggtatcatacccgctcgttttgcttctactcggtttcaagggaaaccgctcgttcagattctcggcaagcctatgatccagagaacatgggaaagggcaaagcttgctgagacattggatcaagttgttgtggcaacagatgatgaaaagatagctgagtgctgtcgtggttttggcgctgaagtgataatgacttctgaatcatgtagaaacggaaccgagcgttgtaatgaagctcttcaaaagcttgataagaagtatgacattgttgttaatatacaaggagatgaacctcttattgaacctgaaataatagatggcatcgtcaaagccctacagtctgcaccagatgcggtctttagcactgctgtgacatctttgaaacctgaggatgcatttgatccaaatcgtgttaaatgtgtggttgacaatcgtggttatgcaatatatttttcacgagggctcatcccttataacaagttaggcaaggttaatcctcagtttccttacttgctgcacctcgggatccagagttatgatacgaagttcctgaaaatatatccagagctgacaccaacaccgttgcaactagaagaagatcttgagcagctaaaagtccttgaaaatggatacaaaatgaaggtgataaaagttgaccacgaagctcacggtgttgacatcccggaagatgtcgagaagatagagcagttcatgcgtgagaggaacatggcttagagcaaagtgagttcttttgatgactcacataggactcctacagctataaaggtggtgttctttggtttcaatttgcgctttggttagcacgtcaattatctctcagagttaacttttgtgaagaaaaagaaaattggaactgaactcgctgtgtaaa

SEQ ID NO: 340 - DNA, 1695 bp, Triticum aestivum
atctatatatagcacttgtgggctctcagtacttggatttacggcgatggcgagggataatggcgacgggctggcggcgattgccgggcggatcggcgtgctcgggtccgtcgcgctgaacatcgcggcgctggcgatctacctccgtggccgcgccgccgccgagaagcaggccagcaagaaggtgaagaaggcggcggctgtggcgccgtcctccggcaagccgcccgtcgcgtgtgattcggtcatcaacttggatcacggtgatccaacgatgtttgagacgttttggcgcggaccgattggcgaaagtgctacgttggtgattccagggtatcaaacgatgagttacttctccgacgtcggcaacctctgctggttcctcgagccaagcttcgagcgtgaggtgcgccgcctccacagcctcgtcggcaacgccgccgtcgagggctaccacgtcctcgtcggcaccgggtcctcgcagctcttccaggccgcactctacgcgctcgccttgcccattgccgacgcgccagtcagcgtcgtatcaactaccccattctactccatgtacccgcccttgacggacttcctcaactcggggctctaccgatgggccggcgacgccaacacattcgacggcgacgactacattgaggtcgtctgctcaccgagcaaccccgacggcagcatccgcgaggccgtcctcaagtccaagtccggcaaggacatccacgacctggcttactactggccgcagtacactcccatcacccaaatgcttgcccacgacatcatgctcttcaccgtgtcaaagtgtacgggccacgccggcacgaggatagggtgggcgttggtgaaggacaaggaggtggctcagaagatgagcaagttcatggagcaaagcaccataggcgtgtccaaggacgcgcagctacgcgccgccaaggtactcggggcagtcaccgacggctacgagcaccagcttgccaccgctgccggtggggacgcgaacctcctcttccattacgcgcggcggaagatggcgcaccgctggtgtgcactccgtgctgccgtagcagcctccggcatctttagcctccccaacgaggtggccggcttctgcaccttcaccaaggacactgtcacctctaatcctgcattcgcatggctgcgctgtgagaagcaagaagtggaagacctagagagcttcttgcgtgagaacaagatcataacccgcagcgggactaagttcggagctgatcaaaaggtggtcaggatcagtatggtcgacactgatgaagcattcggcatattcgtcaatcgccttgccgccataaaatgaggacaccggataagtgaataatgtgtttgtttttatggccagtgaatgatgtgttgtttctcttagcttctctatattttcgtacctccctagttagggatcgatcgatgagttttgtttccgaatacccagcttagtgatccagctaaataatttcatttttctaggtttctttacttatgaaacaacctgagatgctatttattccgaaagagaggttggaaaaaataacacagtacaaataccgaaaacagaatatgaattttggagccgggctcgaatacctttcctggttcatctcttacaactagcgaggttgtagaagtagggtatgaaatgcatttgaacga

SEQ ID NO: 341 - DNA, 2790 bp, Zea mays
cactcacactcgctctctcactgaagtgaggaagaacagagagaaggggagggagatcgtagcagcggcgctgttcgagagctcgccgatctgctgcgggaatggggtgcacggcgtccaaggtggagcaggaggacacggtccggcgctgcaaggagcgccgccgccacatgaaggacgcggtagcggcgcgccagctgctggcatccgcgcacgccgactacctccgctctctccgcgtcaccgccgccgcgctctcgcgcttcgcgaagggccacccctcgctcgccgtttcgcaccacactacccccgtcctcctctccgctgccgcaccgccgcctgcccccagcgccgcccgtgcgctccccacaccggcgccgtccaccgccgcgtcgtcatcgctcccgcctccgacgccgctcgcccagcacccacacccgccgccgcagccgccggcggcgatggcggcgccgcaaccggcgccggcgagggcaccgcgcccgcggcggctcagggtgccccacatcctgtcggactccagcgtggccagccccgcgcggtcgtcgttccgcaagcagccgccggtgggcacgccgtcctcctcgtccgcgtgggactgggagaacttctacccgccgtcgccgccagactccgagttcttcgaccgccgcaaggccgaggtcgagcatgccagccgtctccgggagctcgaggaggaggagaaggcccgggcctacctccagcaccacacccagtacaacctcaaggaagaagacgaggccgccgaagacgacgacggcgaggtggaccatgaaccggaggggatgcattgcggcggatgggaggacgacgagcactacgcgtccacgaccacatcggagaccagatcggaggatgagggcgagatgggggacagatcagaatgcgggttcgcggccagatcggagtgcgggttcgtggccagatcggagtacggcgggacggcaccgtcagagtacgccgccgtcccattgcccctgaggagggatgagaggtcggaggctggcgactcctccacggtcacggcggcgacagagatgcggatggtggtgcgccatcgcactctcgaggaaatcgtggcggccattgaggagtactttgtcaaggcagccgactccggcaacgatgtgtccgagctcctggaggccagccgcgcacagctcgaccgcaacttccggcagctcaaaaagacggtgtaccattccaacagcgtgctatcagcattgtcgtcgacatggacatcaaaaccgccattggctgtacgatacaagttggacactaatgcactggagatggagtcgacggaagggaagagtcatggatccactctagagcggcttttggcttgggagaagaagctctacgaggaggtcaaggcgagagagagtgtgaagattgagcatgagaaaaagctttctactctgcagagcctggagtacagagggagggatagcgcaaagctggacaagaccaaggcctccataaacaggctgcaatccctgatcgtagttacgtcgcaggctgccacaaccacatcatcagccattgttagagtccgtgacaatgagcttgcaccacagcttgtccagctctgttttgcgctactgggcatgtggaggtcaatgaaccatttccacgagatacaaaacgagattgttcagcaagtccgcggcctggtggacaactccatggccgagtcaacatccgacctccataggcttgcgactcgtgatctcgaggccgctgtcgcggcatggcactcgaacttcaaccgtctcatcaagtaccaacgcgactacatccgctctctgtacggctggctgaagctcacgctctgccaggtggacagcagcgtgccccaggaagcccatgcctcgatgatctcgcgcgagctcaccagcttctgcgacgagtggaagcaggcgctggaccgcctcccggacgccgtcgcctcggaggcgatcaagagcttcgtgaacgtggtccacgtcatctacaccaagcaggccgaggagatgaagatcaagaagcgggcggagacgtactccaaggagctggagaagaaggccaactcgctcaggtccatcgagaagaagtactaccagtcctactccatggtcggcctcggcctccccggcagcgggcgcgatggcatcgaaagccacgctgcgtacgatgcccgcgaccctctcgcggagaagaagaccgagatcgcccagtgccgccggaaggtggaggacgagatgacgaggcacgccaaggccgtcgaggtcacgcggtccatgacgctgaacaacatacagaccggcctgccgggtatattccaagccatagctgggttctcggggacagtggtcgaagctcttgatgtggtctgccgccgagctgggtctgtgcggtagaagaagctctttgccatcaggattaccaagagaccatttgctgcctctctttttcttttctgggtgattcagtagtttatttatatagggaaactgcaatatattatatatatagctcaaagtagagtggtcaagtatagaagatggttccccggatgttttgccctgtcacaggatggtttcagttgtagttgtagataatgtgattttgcccaggatttgttggtctcctttttctgtggggagtgcgaggggagagatttataatgtacagacattaaggttgccttgcactctagcctcatcatgatcaagcctgtgtttctgtttagcaaaagcgctggtgtcc

SEQ ID NO: 342 - DNA, 2738 bp, Zea mays
cacggtcacaccaccagacccagacgcgcggtcacctctccggctctcccctcgttaagaaccaacaaaaacctgtgcctgcctgcctgccactctgcgcatgtgaccgagcaacccactgccgcccgggatcgagccgccgcattgccgcgtcccttctggagccgccgccgcccacgggggtaccggatctgaggagcaaaggccattacttatcgtaagcaagatttctaattggcggaagcttttatgtgtagctgactgttgaatttactggtctcaagtatagagtaggcaggcaatctgcagtttagtggaacccaatgggttcttctccttccaaagccactggagaggatgccctggttctgtgcaaggatcggatgcgccacatcagacaagctattgactcgagagatgcactgtcagcagcgcacttatcttacacacaatctctccgtagtgtgggtactgcactgcggcagtatgctgagtctgagatctcaccggaatcatcgctctccatttcagaagtggataagtcaccatcacattcctctatggcatctccttcgccttcgcgtgcagtagagagtgttgcctctctggggcatcgagcaagtccatctattactccaccctcaacacgaatccattgcatgaaagcagcagcaaccactcctttgacctttgtgatagatcaatctactgctgaatttgtggggcgcgaatccccagtatcagcttttgtcccacccccaccaccattgcctccagaattatgtaccacgtgggacttctttgatcccattgatgctgctggtacctcttcctccaacaatgagaatgaggtaaccctgaacttcagtagattgagggatctaagagagtcaagggtagctgaagtagttccattgaaagaagttgaagaggaaatcatgtccagaaggcatacagaaatttctgatgataatacaccacctgagcaggaaagagagccaaagcaaggtgggaccggaaaaccaagtcagttggtggatacttcaaccaaagctacatctgagcaggttgctgcaaagttggaggaaagtgaaatggaaaaagaattatgtgcagaggcagaggacccttcagagttcatcactcatcgagccaaagattttgtgtcgagcatgaaggacattgaaacccggtttatgcgtgcagctgaagcaggaaatgaggtttccagaatgcttgaaaccaagaagatccgacttgacatatgtgctaaaataccaggttctccagtcaagctaccttctgcccgatttgtgtcagcacttcgagtgtgctgcaatcgtgatgttattctcaaccaggaaactgcgcagcatgtttcaaaggttgtcacatggaagcgttctgtctcatctctttcatcatcatctaagagtgcacttatgacatcgataatgaaagatgatgtggatgacagtaatagtgattttgttgaggaattcgccatggtatccggaagccattcttctacgttggacaggctacacgcatgggagagaaaactatatgatgaaatcaaggcaagtgaaaatgttaggaaggcctatgatgagaaatgtaacctactccgacgccaatttgcacgaggcctaaatgcgcaggtgattgataagactagagctgttgtgaaggatctccattccagggtatctgttgtgattcaagctgttgatgcaatctccaaaagaattgagaagataagggatgaagaactgcagccacagcttgtcgagctaattcaagggctaatcagaatgtggaaactgatgctggaatgtcaccacaaacagttcatcacgatcacattagcataccacgtgaaagactcgacctcggcgcgtcaaggtgagcaccaccatcaccgccaggcggcgatgcatctgtggaatgagatggacagcttctcctccagcttcagaaactgggtcaccgctcacaaatcgtacgtcgaggccctcaacgcgtggctccagaagtgcgtcctgcagccgccccaggaccggcgcaggcgcaaacgcaaggtctccttccctcctcggcaggctgtctcccctcccatattcatcctctgcggggactggctcgccaggacagaacctctccctgctgacgagctatgcagatccctcaaagacgtgatgcagctcctccgcggctcgttcgagcaccgcgacgagcagaacaggcccagaagcggcgagtcgcaggagtgcgggatgctggagaacagtagcgagcaggaggcggcggctaagagtgggagttgtgcagcatcagctgaagggctgcagtcgagactgacggcggttcttgaccgcctgacaaagttctcggaggcatcactgaagtgctacgaggagctcaagcagaactacgagatggcctgtgctgattataggagagttggaccaaatgctcagcttgcttaggattgatgttggctgtggtgtgtgactttttgctatctctgttctggatgacaaattctctagtgttttggtatatattttgtgaacaatcaggtgatagcacaatctttggccgaatattactgatgatttagtgctatcagttatgtaagcttcatcacttgccctgccctgatgcttcgaaaggcctatgagaaccgttttcacaacgatataacaggcaaaatataccatgattcctgtgcgcta

SEQ ID NO: 343 - DNA, 1698 bp, Oryza sativa
gagtctaatttagcaggcagaactaagagagcacggcggcggcggcggcgatggcgcagtggccgtggaggtggagggtgctgctgccgctgcttctccttcactcctcccccgtcttcgcgcaagaaggccaagataatgatccctctactttgttcaaacgagcctcagaaatgatgaacctaaggaaatatgatggatcacttggtctgctaaatgctgtgttggaggttgacccaaatcactcagaagcttacaggcagcgtgcatctgtgcttcgtcacaagtgcaggtacaaggaagcggagggtgactatagcaaatacctggagctaaaacctgggagttcttctgtggaaaaggaattatctcaactgcttcaggctcaaaatgcattagagtctgcttatggccaatttgaatctcatgacttctcaaaagtcctggagtacatcaacaaaattgtgcttgttttttctccaaactgcttaaaggcgaagcttctcaaggctaaagcattgctagcacttgaagactactcaagtgttatctcagaaacaggatttattctgaaggaagatgaagataacctggatgccttgttgcttcgtggccgagcatattactacctcgctgatcatgatgttgcatccaggcactaccagaaaggccttcgtctagaccctgaacattcagaactgaagaaagcatattttgggttgaaaaatcttctgaagaagactaagagtgctgaagataatgctgccaagggtaagctacgtgtgtctgctgaggactacaaggcagccctagcaatggatccagatcatacttcttacaatgtacatctttatcttgggctatgtaaggttctggttaaactcggaagaggcaaggaggctatcagtagctgtacagaagcactcaacatagatggagaacttgttgatgcattaacacagagaggtgaagctaagcttcttacagaagactgggaaggagcggttcaggatctaaaagaagcttcccagaaatctccccaggacatgggaatccgagaagcactaatgagagctgaaaagcagcttaagttaagcaaaagaaaagattggtataagatccttggcatttcaaagacggcatcagctgcagatattaagcgtgcctacaagaagttggcactgcagtggcatccagataaaaatgtagataaccgagaagaagcagaaaacatgtttcgagaaattgctgcagcttatgaggttcttggggatgaagataaacgtgtaagatacgaccgaggagaggatcttgatgagatgaatatgggaggaggaggtggtggtttcaatccttttgggggaggtggtcagcaatacacattccattacgatggtggattccatggaggaggaggattccccgggggcggctttcctggaggatttcagttcaactttggatagaaagttactgtctgtggagttggagtttgtatgtttgtttgttttaggaacgctgataagcttaacaacaggtattgattgtaggcagtcaggccgaccgaccgatcgatcaagatgagaatcgtatacaagtgttgtttaagcaccatcaaattttccttaagttgtatccttccttgggattttctgacgcatatgatccaatcgaaataaactgagccttactgtggag

SEQ ID NO: 344 - DNA, 1812 bp, Zea mays
tactctctttcattagaaaccaaacatctacaaaaaatagaactggattggttccattcgcatccactcttttaccaaacacatcctaatatatgtacttggtggagtaatttagtcctcgtttcatggttgcttttttttttttttgctaaaatttacgcttctcatggcatacagccagttgaatttgttccagccaagcaaaacatagctgggctattttgagtacaaaccggcccaaataaaacatgggattaactaaaagcctacggcccaaacttttcgcaaagcttcaccgtttaaaaccgaaacctgacctgcgggctgcagcagcgtccgctccaaaacgcaacggtcgaatctcctcgaattcgaattgcagccggtgccacccacctcacatggcggcggcggaagagatgatggcggtgctggacaaggagacgctggcgctgatgggtctgggcaacgccgccgccgcggtggttgccgagtgcgagaagttcaaggagaacgcgaggccgctcaagcgcgggcgcgacgtgtccaaactcaaccacgcgctcaaggcacacgccgatcccgcccagcgcgccactcttctcgaagcccgaaagaagctgattgaggcaatctacgagtaccaaggcgaggatccgctccaaccgtggctggactgcatcaagtgggtgcaggagtattttccgaccggcggcgagtgctcagggttggtggtgttgtacgagcagtgcgtgcggaccttattggacgacgagcgctacaaggacgacctccgcttcctcaaagtgtggctggaatacgcggggaactgtgctgatgctgaggtaatatacaggttcctggaggccaaccagattgggcagggccatgcgatctactacatgtcttacgcatcgttgctggagtcaaagaacaagttgaggaaagctaatgagatctttgaccttggtatagctagaaaagcgaagcctctggagaagttggaagctgtatacagggcatttcttcgaagatcaatcaaaaagagggaacaagaggatgatacagtagatgatgatctgccaaaacgcagtttcgggaataacttgaaacgagatgaaaacagaaatcagcaagcagggaactcccacctggggagaccaagggcactgcagaggccgctttcagtttacaaagatgaaagtccattaccaaatcagggccttgacagagtgaggagcaaagaaaataacacaagttggcgcgtcctcggaacacgagcagaacggaacaaggaaaataacatgatgcctgctaaatggacgtctcacaagattccacagaagttaggagcaagaggagcggttcaatcaacccgagccagttgttccattgaagtcttcgtcgaggaagactgcacacaggaacctgctcggccggtgccaaagagcccaaatccttctgttctgaagctcaggcaaacaacaagcaaaagccttaagaaggagactgaattgctcaaggagaacccgctgcgcaacttccccctgagcaggcttaggtaatcagcatcttgctggttctgagaaacatctcgtacgttatgatttggtcgtatgtatggttgctgtgaggtgttgtgcccaaaaaaggctttattagcctctaaagcttagacgagcaatgtatgcctatggcattatccaagtgatgtaaggctgtgcattatattgacacggcgtgcttattatgaatagacctgcagatctcgtgcgtgcctatgtgaatctagcctcgcaaaataatctgctt

SEQ ID NO: 345 - DNA, 2175 bp, Oryza sativa
tcctcctctgctcgcttttcccaccgtctccaagcccaatccaatggcttcctctctcctccgcgcctcgccgctctccctcctctcccgcctaaagccactcaaccctagccccaccgcctcgcacctccgccgcctcctgctgctctccaccgcctcctccacctcgtcggcctcgtgctcgccgtctccgccccgaaccctagcggccaccgacgcggcgaccccgccgccggaggaggaagcggcggcgcccgcggccgaggcgaagcgcgagaggctgcagccgctgcagtggcctgcgagggacgcgctgtgcggcgagctcggcgccggtgacgccggccgccgcgtgcgcctctgcggctgggtcgctctccaccgcgcccacgccggcctcaccttcctcacccttcgtgaccgatccggcacggtccaggtgacaactttgccagaatatccagaagtttatgctgtggtgaacaaactaagagtagagtcggtggttgcggtcgagggggttgttcggtcacgcccaacagaagccatcaacacagatatgaagactggggctatagaggttgctgccgataatatatatgtgctgaactcagtaactcgttcattgccttttccaatcaccactgctgatactgtaaaagagaagtttccagaagaaattagactgagattccgggtgctggacttacgccgaccacaaatgcagtcaaacttgaggttgcgccataatgttgtcaagcatattcgtcgatacttggaggatagacatgattttgttgagccaggaatgttctatgctcttcctcaaagccctcagctgttcaagcaaatgttgatggtctctggctttgaaaaatattatcagattgcaaggtgtttccgagatgaagatctgcgtgcagacaggcaaccagagtttacacaacttgatatggagattgcatttacatcaatggaagatatgttgaagttgaacgaagaattaatgagacatatattccaagaggttggtgatatcaagctgccaaatccttttccaaggctaacctatacggaggcaatgaatcgctatggaacggataggcctgaccttcgttttgattggcagctgaaagatgttagtgatgcatttttgggcagtagcttcaagatttttgcagatacattagaaaacgggggtgtcatcaaggcattatgtgttcctggtggtgccaaagaattttcaaatactgacctaaagaaaggaactgtctacactgaagcttccaaagctggagccaagggcctgccttttctcaaagttatggacaatggagagcttgaaggaattggtccactcgtggcaagtctgaaacctgaaaagaaagagcagttgttgaaacatctagatgcaaaatcaggtgatcttatcctgtttgcactgggtgagcaatcagcggctaatcgaattcttggcagattaagattatttattgctcataagctggaagtgatagatacatcagcacattcaattctttgggtgacggattttccaatgtttgaatggaacagtgatgagcagagatacgaggcactacaccatcctttcactgcaccaaatcctgaagatatgaatgatctaccatcagctcgagccttggcttatgacatgatttacaatggagtggagattggaggaggcagtttgaggatatacaaaagtgatgtacaacaaaggatttttgagatcatcggtatctcacccgagcaggcagaggaaaaatttggctatcttttagaatgttttgacatgggtgctcctcctcatggaggaattgcctatgggttagatcgtttggtgatgcttttggctggtgaaaattcaatccgggatgtgattgctttcccaaagactacaactgctcaatgttcactcaccaaagcgccatctcctgtagatccacagcaattgaaggatcttggcttccgtacgtgaagtgagtgcactgtttgtaacaaggtttgagttatataggaacatccattgtctacaccgggcacccaacctgtcacagcacattcaccttttgcgaatgtgcttctgctcttgagaaattttgaccatggataggctggttgtccatctcatgaatccaataaaaagtttaaagc

SEQ ID NO: 346 - DNA, 744 bp, Solanum lycopersicum
ataaactatataatatcttgataagatgataagacacgtggcactaatctctctcatcaccaaaactacaacactctctttttccccaaatcttttcaaaaaacacaaatcaatggcttctccaaccctaatcaccccatctacatcaacccccaaatccctcatcaccccaatccgatcaaaactcatcacctccgtaaccaccaccaccatcaccctccgccgccgcgaattcctctctctgtccgccggaatcctatctccatcccttctccttcccgccacgtcagcattcgcagctaccgacgaggaatacgtgaaggaagcatcggaagtgatacagaaagtgagatctacgttgaatatggataaaggagatccgaatatagctgattcagttgctgagttaagagaagcgtcgaattactgggttgcaaagtatagaagagagaaagctttgttgggtcgggcttcgtttcgtgatatatattcggcactcaacgctgtttcgggccattatgttagtttcgggccgactactccgattccggcgaagagaaaggtgagaatcttagaagaaatggataccgctgaaaaggctttaaagagaggaagataaaacaaaagccaatttttttttttggaattatttaaatttttctatatttaattttctgactatgaaaattatataattatatcatgaagatgaggaagttgaatgaaaagtctaaatttaatttt

SEQ ID NO: 347 - DNA, 2863 bp, Oryza sativa
ccttcctcggcccacttggcgagttgctccttcccgtgctccgccggccgtatagtcaaaaccaacgagtccccgacgccggcgagctccccggccgagcataagaggcggccatggcggcgggcaccgcatcgccaccgccggacgcggagcctcccgagtgcccggtgtgcctctcccccttcgacgccgcctccgccgcgccgcgggtcctcccgtgcggccactccctctgcggcccctgcatcgcctccctcccgccggcctccgcctccgcctccgcctccgccgcctcgctccgctgccctctctgctcccagtgcgtccctttctcccgcgctctcgggccctcctccctccccaaaaacctcgccctcatctccctcctcccctcgcccccaaacccctctcgttctcgcaccgccgccgcggcgccgccgcctcctcatgtcccgctccacgcggaccactcgcgtctcctctcccgcttccgccacgccgtcctcccggagtccgcttcgccgctccactcgcccgctcccgccgcgggcctcgccatcgggtccttcgcttccgacctcggcgccccgtggttctgcccgcgtggccaccccgtaagcctcctcccgatcgaaacccccgccgccgccgccaagcaggagtccccgttgtactaccggcccagccacgcggcgcgggtggccgccgcgatcgatgcgctgagcgccgcggcgagggatgaagtgatcgatttggtggccgtctcgtcgcggttggcgcggcgggtttgcagggtttacggcttctggatgggccccgaggcggctccgctgtggctgctctccgagcggcattcccgcggagtctcctgcttgttggaggagaggagccgacgagaggagacggtggctctgatcagaaatgtcggaatggaggtctgtgaagcgttcatgggattgcacggagaggggctggtactggggtgcatagggctaggatgcttctgcctcgatcgctttggacactgcctgctcgacctgaatcaggttttggccttgtgccacggggttcgggtaggggtttgctcatccaagtccaaggccttcatggctcctgaggtggcagaggtggtgcatgacaagttgcagataaaggatcatgatttcagtggcttgttagggcctagttcagatgcttggttgcttggttgtttattggtggcacttgtaactggggatgagcagcttgcagcaggatggagtactgaggggtcatacgatgattggaagaatgaagtgcttacgaaggttgatgcttcattggttggcacacatatggaaccatggtctgcaaccatggtgtcatgtttgaactatgatccagaaggccgtccagaaattgctgatgtctggaaatgtattaacggctcattgatgaattccgacattgaagctttgattcctaatgttgatcttgcagctcgaaagagttttatgtgtttgctccttggggagttgtcctcaatgtgctctaaccttgatgctgttgagtcagatgatacaatgcatctttctcaggatttggatgacaaacattcaactccagatgatgcaagcagtggtggtattataaacaacgaagaagttggtgcagctggaatggatgggccaaaatgtggactgtacaattcttcaactctgcttgctcaccgtgactgtattacgggattagccattggaggaggctttttgtttagctcttcttacgacaagacaatcaatgtatggtcactgcaggacttctctcataaacaaagtttgaagggccatgaacacaaaatcacagcaattgttgttgttgacaatgataatcagtcactttgtataagtggagacagtggtagcggaatatttgtctggtgtgttgatccttcactcagtaatgaaccattgaataagtggtatgaaagtaatgattggatttatcgaggtgttcactgtttggctgtttctggaactggttatctttacactggtagtagagacaaatctattaaggcttggtctctagaggattattcactacgctgcacaatgacaggtcacaaatcaactgtttcttgccttgcggttgcctgtggtattctttacagtggaagttgggatggttctattagatcatggtggctcactgatcacagcccgctgtctgtactggaagatggtacaccaggaagcattactcctgtgctgtcaatttcaacagaactcgattttgttgttgcatcatatgaaaatggctgtttgaagatctggaaggatgatgtcctagtaaagtcagagaaacttcaaaacggtgctatatatgctgctaaattgaatgacaagtggctctatgctggtggatgggataaagttgtaaatattcaggagttattggaagatgattcagaggtggaaatcagagatgttgctacctttacttgtgattcaattataacttcaatactgtactgggatggaaggctgatagttggactttctaacagggagattaaggttttctacaaggcatcttaactctaaatcaggattattaatcatttgtcactccatcttgtatatattgtgaatagcacactgtatagtcgaattgataacgaaaaactgataggaccatgtaattagaatttgaatgctgcttttggtgaatgatgataaacctgtatggtaaagtttgagtgcaactgcacaatagggtaaggttttttgtaacagtagtatcatatagaaaccatcgaagtcgtagctcatatcaatttgtttcttctactagaaaaatcatggaatttgttcttcaatcc

SEQ ID NO: 348 - DNA, 1714 bp, Gossypium hirsutum
cagaagggaggaagtgacattggcaatatggctttgctgcattcttacttcttaagcgctggtgagtatgtttcagggtccacggtcttggcagtggcaatgtccattgcttcctattttctgatccctatggtgtttggtggtcgccataaaaactggaagaatgcaccaccaggccctgttggttggcctatccttggcagccttccacacctctccaatcgtctccatgaagatttctttgacatggccaagatctacggtccccttttcagtctaaacttgggaataaagccggccatagtggtgtcatcaccggaaatggcagcccaagttttgaaggaaaaggaagggatgttctccagtcggaccataaccgagaccattcgagtcatctcttatgatgcccattccatcattttctcgccctatggtcccaggtggaaggttcttcgaaggatcttgatcaccgaactactttctcctaaggcctttgaacaatttgagccacttcgtacctcacaggttcatggtttgctcaagtatttgtacttggtctcaaagtccaacactcaagtgaacatagcagaatatgcttttacagcactggccaacctagtgagtaatttcgtctgctccaaggaccttttcgacaactcaatgcctgaaggaagacaaatgaaagagaggttctgggagttgataaaggtgattgggaccccgaatttttctgatctcattccatttgttaaaccatttgatccacaaggcttgaagagaaaaatcaacaagatcttcggccagttggatgctttctatgagaagttaattgaggagaggtttgctgagaagggaaaagctcaacttgatgggacgataccctacaaacggaaaatggatatgttagatgttctgttgagttatgagagtaatgataaacaaaatggtttggacagtttaccaaaatctatcgtcaaaggaatgctttctgaaatgtttattgcaggaactgagacaacctcaagcactgtggagtggggcatggcagaaatcctaagaaaacctagtgtagtcaagaaactgctactggaactggatcaagttgtagggaaggacagatttgtggtggaaagcgatatcccgaagctgacataccttcaggcagttgtgaaagaagttttcagactgcaccctggcgttccactcatcatccctcgtcgcaccaacgaggcatgcgaggtagctggctaccatatccccaagcactgcatcgtttacgtgaacgtttggggaatggcaagggatcctaatgtgtgggaagatccactggagttcaagccggagaggttcatagggtcaagcgtggatgtgaagggccaagactttaacctcttaccgtttgggacggggagaaggtcgtgcgtgggatggccactggctcatcgcatggtgcactattacttggcagctctgctccatgctttccagtgggagtcacctccagatgtcctgaatgatctgggggagagagtggggcttactattcagaaaggtaagagcttgcttagcactcccaagcctcgactgccagcctctgtttatgagcgttagaacggcaccatccaagtataagttagagtgtgcctgtaatgttcctatgttatgttcttatgtttaatacataatgcgaagggtgctcaaatgaaagtttggt

SEQ ID NO: 349 - DNA, 2540 bp, Hordeum vulgare
cggggatggggggagggccgcggacgttcgcgggggggctgtccaagtggcagcacaagcggatgcacgagaagctggcgcgggggaaggagcggggcctgctgcggcacgagaagcagctctacctcgcccgcctccgctccgagatccgcgcctcccacctccccggcgcccccgcctcccccgccgaccacgccgggccgacctcctcccgcgcccacatccgcgccctcgccgaccgcttcctccgccccggcgccgaggacctctggaacgacgacgacggcccgctccgccgcgcgcggctgccctcgcagcagaagaatgcggcgaggaccctgccgtccggcgcccggatggtcgactggaagcgggtggagtccggggagaggccgaagccgccccggggaggaggggactggaaggactgggaggagctggattcgggggagccgagggccggcaggggagccggaaatgagcagccgcgattgccggccgcgtttagtcagaggagagggtacgggacggtggctccctggtggtggcaatggagcccgggctcgggcacaccttcgcagaggaaggaggcgtccttcggcttcttcggcctgaagagatgctactcggcgatgcctccactctcaccgcgtcaggaatcgggtgccgcgctaatgccgttgggtgttcgacagctctccgaggctgggggtggcacgaaggggacaccgccggctctgttctatgctcaggagaggttgtactcgggagcagccccgcggcggtttggccagaaatggaggccggattcatcggacgaggatgaggaggtcatgccacctgcaaagagggatctgaggttggcgaaattcgtggcttcaagggaagatgagtcggaagatgatgaagtgggggagacgagcgccatcaggaggaaatggagcagtgctgctctgaggaactgcgatatgaagagagataggaggccgctcaagtcctacgaggaggaaagcgatgatatcactggcagaatccaagagctgcgagaggagataagaaatagggaggtgctgggtgctgagaggcggcgctatgagtcgaggggtgaatctgtgtttacaaataaaagattcgatgaatgtggcatctccccacttactgtcaaagcactcactgatgctggatatatacatacaaccgttgtccaggaagcagcccttccaatttgtcttgaaggtaaagatgttcttgtcaaggccaaaactggaaccggcaaaagtgtagcttttctgcttcctgcaattgaatcagtcttgaatgccatgaagagccatacaaatcatcgagtgtctccaatattcgcccttgttctatgccctacaagagagcttgccgtccaggttacagctgaggcaaatgttttggtgaagtaccatcatggagtgggtgttcagtctcttattggtggtactagattcaagcttgatcagagacggttagagtctgacccatgccagattttagtggcaacacctggaaggctgctggatcatattgaaaacagatcttcattctctgtccgcttgatggggttgaaattgcttgtattggatgaagctgaccacttgctagatttgggttttcgcaaagacatagagaagattgctgatagcttgccacgccaaagacagacactactattttcagctactattccaaaagaggttcgaagggtttcacagatggttttaaacaaggatcatgtttttgttgatacagtgggcttgggagctgttgaaactcctactaaggtgcagcagcaatatcttgtggtaccacatgaactacactttcatatggttcatcgccttcttcgagagcatattgatcaggaagtggactataaggtaattgttttctgcacaacagccatggttactgaatttatgtatataatgcttcgagatctgaagctaaacgtcagagagatacattcaagaaagcctcagctttacagaacacgtatatctgaagagttccgggattccaatcgcctgattctggtaacatcagatgtttcaacacgtggagtgaattatccagatgttaccctagtgattcaggctggtgttcctcctggcagagagcattatattcatcgtcttggaaggactggaagggaaggtaaatcagggaaaggaattctgttgattgcgccatgggaagagtatttcttgaacgagatacatgatctcccaatagagaaggctcctgtgccacagattgatcaggagatgaaacaaaaggttgatgattcgatcaagattgttgacatgagcatcaaggaagccgcataccatgcatggcttggttactataactcgatagctgatgttagcagagacaaagtcatgcttgctgacctggcaagtaggtttggtgtctctatcggcatggaaaagcctccgacgctgtataggaaaaccgccttgaagatggggttaaagggtgtgccgggaattcggataagaaaatgatga

SEQ ID NO: 350 - DNA, 1332 bp, Hordeum vulgare
ctaaaccctagccagccctcgcccccgccgccgccgccgccgcacgcacgtccaacccgacacccccgcaaggcgagcgagcagcaaaccgtcccccggcgtcggcggctggcgaggatgggccgcgagaagtcccggaggctctccggcagccgagacttccggcagcggctggtgctggcgacgctcacctccacccccatcgtcatcaaggacatccgcgccggcgagggcggcctccgcccgcacgagatgtccctcctccacctcctcgacaaggtctccgaccagcacgccatcgacgtcaacgacacagggacgaaggttgggtacaagcccggggtgatcgtcggcgggaaggacctggagcacgactgcggggtgcaccgcgggatcggctacttcatcgagccgctcgttctgctcggcctcttcgccaggtcgcccttgtccattcggctcaaaggaatcacaaatgatgcaaaggacccttctgtggatactttccggatggttacgttgcatatgctcaagcattttggtgttcctcttgaggggctggagctcaaaattgaatgccggggaactcctccctgtggtggtggtgaagtgcttcttcgagtccccaatataaacagtacattaaaggcagtcaattgggttgatgaaggcatggtaaagaggataagaggtgtgacattcgccaccaaagtatctccacagattggaacccgtatcgtctatgctgcacgtggactcttcaataagttcattccagatgttcatatcttcaccgatcatagagttggtttatctggtggattgtcaacaggctatggcttatctgtagttgccgaaaccacaacaggctgtctgatttctgcagattcttccgtgagttatcccaatgttgataaaatgagtgaacaatccaagaagcctgagctaatgtctccagaggatcttggtgagcaagttgcatcgatgctgctagaagaggtggctcaaggaggagttgttgactcaacacatcagggccttctgttcatgttgtgcgctctctgcccgcccgatgtgtcaaaggtacgcgtgggacagctgacaccgcacgctatagaatcacttcgaaacatcaaggagttccttgatgtcaagttcatcatcaagcctgacccaaactcaaacacggttattctaaaatgtgttggtgccggagtgaagaatcttgctcggaagatttcataaacctcatctaggatggaaagcagtgttttggaaccgcaacacaggaattttcaagttttgttgcaagtgtgttgtggatcttcttag

SEQ ID NO: 351 - DNA, 623 bp, Hordeum vulgare
atcgccttcgagcatcagccatggcagagcagactgagaaggctttcctgaagcagcctaaggtgttcctctgctcaaagaaggccacaaaggggaacaataagcctggcaaggagggcaacaggttctggaagagtgttggccttggtttcaagactcccaaggaagccattgagggaacctacattgataagaagtgcccattcactggcactgtgtcaattaggggtcgcatcattgctggaacatgtcatagtgctaaaatgaacaggaccatcattgttcgtaggaactaccttcactatgtgaaaaaataccagaggtacgagaagaggcactccaacatccctgcccacatttccccttgcttccgtgtgagagaaggagatcatgtgatcattggccagtgcaggccactgtccaagactgtgcggttcaatgtgttgaaggtcgtcccagcagggtcaaagagtggtgctgtcaagaaggcgttcaccggtgtctgagcaagtcatgaccttttttctctgaaaccttttctccatgaaattttgacgtcacatctatattcttccatctgtgtgtacgagggttttgccttgattgttctccaagcttcctag

SEQ ID NO: 352 - DNA, 804 bp, Hordeum vulgare
gcttttaccatccggttgttgcggcggcggcggcgatggcggcggaggacgtggagttcgtggactacgagcggggcgaggacgaggacgacgaggggatggaggacgaggaggacggggaggtctcggcccgcgcgctccccgtgccccgcatcgccgtcgccccctccgtgccgcgcaccggcagggggcgctttgtcggccgcagccgctccgtcatggcctccacccgcgaccgcttcgactccatccccttcgccggcagctccgcgcacggcggcccgcagcgctcaattgaaggatggatactacttgtctccggagtcaaagaagatgcagaagaaagtgatttgtatgatgcttttgctgagtttggtgaggtcaaggacttgcatttcaatctggaacgtcgcactggatatggcaagggatatgcattgattgaatatggatgttttgaggaagcacaaactgcaatcagaagaatgaatgggacagagctgttaacaaagactatccatgttgattgggcattcaacagaggtcctatacagaaggccacgagtacaggaccagcacagcgacggtctaggactccgcctcgcaggcttgctgccatgacatactgagagggcgctgctaggcctgcaatctcggaccagtattggtcagtgttttttggtactgcttgtcagggatatttgatatgtcatagattttagtcgtaaccagttgtcttacggcagtaagcggtaaccgaacaatgagccgagtatggtccagaaactgagtcctgattctgcc

SEQ ID NO: 353 - DNA, 1964 bp, Setaria italica
cagagatgccgctggggcagcgcgcgggggacaagagcgactcccgctactgcggggtggaggtgctcgacttccccgccggcgagggcctccccgccgtccttaaccactccctcgcctccgccttcgacttcatcctcgccccgctggtcgaccccaactaccggcccacgcccggcgccgtgctgcctgtgtcggcgtcggacctcgtcctcggcccggcccagtggagcaaccacgtcgtcgggaagatcagcgagtggattgatttggacgcggaggacgagcggctccggctggactcggagctcacgctgaagcaggagatcgcgtgggcgtctcacctctcgctgcaggcgtgcgttcttcctgcccccaggagaccttcttgtgccaattatgctagagctgtgaatcaaattttgcaaggcctgaccaacatgcatttgtggcttaggttacctctggagaagtctgagccaatggatgatgatcttgataaagtaaagaataacagccaaatgagtgaaaaagtagactcgtgggaattgtggaattcattcagattgctatgtgatcacagtagccaactatgtgtggcacttgatattttgagcacactgccatcaataaactcattagggcggtggtttggggagcctgtcagggctgctattcttcaaacaaatgcttttctaacaaatgcaaaaggatatccttgtttgtcaaagcggcatcagaggctactaactgcattttttaaccattctgttcaggtaataatctctgggagatcaaatcacaatgtttccccagtgtctgaaggagtgctttctggtgatgagaactacattgaagaagctcctgttcgacatgcattaagtccatacctggactacgttgcatacctatataggaggatggatccgcttcctgagcaggagcgctttgagatcaattacagggattttttgcagtctcctctccagcccctgatggataatttggaagctcagacttacgagacatttgagaaggatgtagtgaagtatagccagtatcaaagagcagtcgctaaggccttggttgatagggtcccagatgatgcagtctccacaactaggacggtgctgatggttgttggagcaggccgagggcctctagtacgagcatcattgcaggctgccgaagaaactggtcgcaagttaaaagtatatgctgtcgaaaaaaatcctaatgctgttattactcttcatagtttgatcaaattggaggggtgggaaagcttggttactgtaatttctagtgacatgaggtgctggaatgcccctgaaaaagcagatattttggtcagtgaattgcttgggtcctttggtgacaatgaactatctcctgagtgtctggatggtgctcagcgattcttgaagccagatgggatttccattccttcttcatacaccagtttcatccaaccaataacagcatcaaaattgcacaacgatatcaaagcacacaaagatattgctcattttgaaactgcatatgttgtcaaactacaccgcatagcgaatcttgcacctccacaacaggtttttactttcacccatccaaatttctcaccagacgccaacaatcgaaggtataccaagctgcaatttgaaatgctaccagatacgggatcatgccttgtgcacggatttgctggatatttcgactctgttctatacaaggatgttcatctcggaatcgagccaaacactgctactccaaacatgtttagctggttcccgatcttcttcccgttgagaaagcccatctatgtgccggacgggtctcctatagaagtgcacttctggcggtgctgtgctcccacaaaggtgtggtacgagtgggctgtgacaacaccgtctccgtcgccaatccataacagcaatggccggtcatattgggttggtctatagtag

SEQ ID NO: 354 - DNA, 3693 bp, Zea mays
gctggatttcagtcgtctgatatactgagacttagtagtgctgatccagtgaacctatccacaccaacttgattacagtctctctgacacaactatggcgccctctgccgctgccccaggcatctctgaggctgagggggcaccacgcatggccaagttcctctgcagctttggaggtagtatccttccccgaccacttgatggctgtcttcgatatgttggtggcgagacaaggattgtcatattgccgcgtgacatatcatatgccgacctagctgcacggatgagagatctctacaaggatgctgataccatcaaataccagcaacctgatgaggatctggatgcgctggtctcggtcgtgaatcacgatgatgtggtgaacatgatggaggagtatgacaaagtcactgccacaggggaggcgttcactcggctcaggatcttcttattttctcagcaattggatgacaatgctgcatcagtggctgtgcattacaatgtagacgagcgggaaacagagagaaggtatgtagatgcgctcaacagccttggtgatgttaggtcaccttcctcccctgtatctgtggagcagctttttggcatcggaggcaatgattcaggaattcctgattttgctggcttgagacatttgaatgtccctcgtccatcacatggtcagaggtatggagagatggattctccttggagccctgcttatgtctcaccaagccagtacagagtgcatgacccgagggattttccaatttcaccgtcatctgcaaggttccaagtaggagcggaggattttgatgacaggattcctgacgactttgtaaggcagtcaccaaaatatcattattatgaggctcaatcaccatcacatatggataatttagtctggcttccacctggtgctgtaattcagcaaaatgcaggtttccctggtgatttgagcaagcacaataaatttttggatgggaacagtggatgtgatcactgtggttcactattccacaagggtcagggttcggtgactgatcctatctatatgaatcctcgttggactcggccagtccaacaacattttgaccaaccaagcatgattaatgattatcccggtcaccatgctaattcttgtccagattactgccgccctggtgagcattatgcgggaggtcaagatgttagattggaaaatggtgtttatgttaaagagcaaaatggtggtcatactcccatgctttataatgagtcacgtcctcacgatagagtctggtatgcgcataccaaccaaagtcatcagcggtatgaggatccaaggctgcattatcctactaatgatagagtgatcgagccatacattgtcgatgctagctctgtaaattccgcatttgcaccaaacaaagtatatgaaatgcattcagcatctcttggtcattctagttctagccatgaaagtcctcactattttcatggtagcagtgagctcataaatgacgcatatcacaaccaacaagttggaggcagtgggtcatatgtgcagccagcagggtctgaagaatcccctggtcagcattacaaccacttttcggcctatggtgcagattccttttatcaaatgcaacaaaatttgccacccattcaatctttgaggaggagagcgaacagtcctgttcacactgcctcaccatatgattccccacacctgccaataccaaatgggagcattaacatgaattctgttagaaatacaggtgatgcgagtcccaggatagcaggtcttattggatatgatcgaatgccaaacccatttactccgcccaatggcagcatactatatagagttggtgggcatgatgttcctgcagctatggagaacactagtgcttttggtcctaggtctaatccaactgctgctcagtatgttcagccttttattgctcctgaatcaatccagcatcaacctggagttcccttgagggaggtttatcctgaaagagcataccctgaacccatgccgtcatcatatgctgatggcaaagtagctgtttctgcattgcccctcaccgaccaattattcaggttggatataaacacaatgaagaaacttgaaggacaagatgatgggaactctactcgaaatgtgaatgaaacaactcttttgcatgctgtggatgaaccaagtaccttaccccaccatgttggatctgtacatgaagtcgatcctaagcaggagaagctaaccgaaaaagaaagcaggcaaaagcaacatgaagctggggctacagcactgcaggaatgtgaggatatttcagaggatatgttgaatttccttcctgaattaattgcctctgttaaaaaggtaacactggaagatgctgctgagacacaaatagcccaatcagatgctaatgctgctgtttcacctgttcctgatgatgacgataatggaaagaagctggatgaggcaacagctggtaatacaaatgcaaatcaggaccttgatttgcaaggaagccttgatcggcagaagagtttcaagattgagtctacaactgctgaagctgaagctttgtcgaaaggactacagactataaaaaatgatgatttagaggaaattagagagctgggttcaggtacttatggggcggtctatcatggtaaatggaggggatgcgatgttgctattaaaagaataaaagcaagttgctttgctggaagaccatctgaaagagagcgtttgatcacggatttctggaaagaagctctgatcctaagctcacttcatcatccaaatgtggttgcattttatggtgtagttcgtgatggtccagatggaagcttagcaactgttactgagtttatggttaatgggtctctcaaacagttcctgaggaaaaaagacaggacaatagatcgccggaagagagtaatattagccatggatgctgcatttggcatggaatatttgcacgggaagaatatagtccattttgacctgaagtgtgagaatctactggtgaacatgagggatccacagcgaccaatctgcaagatcggtgatctcgggctatcaaaggttaaacagcatactttggtatctggtggtgttagaggaaccttaccgtggatggcaccagagcttctgagtgggaaaaacaatatggtgtcagagaagattgacgtctattcgtttggaattgtcatgtgggagctgcttactggggaagagccatactctgatatgcgtgctgctgaaattattggggccattgtaaacgattccttacgccctcaaatcccttcatggtgtgatcctgagtggaagggattgatggaaagctgttggtccagtgatccagcggagagaccgtccttcactgatatatctcaaaggttgaggaaaatggccgctgcaatgaatgtgaagtgaaggttcggaagccatatttgtcttgattttccttagtcctggagtaacccggctgtcatttgccttgtgtcgaaaataagtatgctataaagcgttctgtcttgatgggaactgttgggctgtaattgtaaataagttttgacttgcttcatcttgctgtgcaaagtagtaattaataggcacgatcaaagctgggcacagttatcttttccccccatacaaaagtgtgtcctaggactaggaggagagatggatcg

SEQ ID NO: 355 - DNA, 354 bp, Oryza sativa
cttcaatggcgactgtgccagttaacccgaagcctttcttgaacaacctgacagggaagcctgtcattgtcaaacttaagtggggtatggaatacaaaggatatcttgtttctgtcgactcttatatgaatctgcagctggctaatacagaggagtatattgatgggcaattctctggaaacttgggtgagatactgataaggtgcaacaacgttttgtatctccgaggcgttccagaggataccgagatagaggatgcggaatgagatagcccgggccatgtccagattgattattgtaatatgctgctgacatgaacaattaagtgtcatgtacaactgatgcagattgacc

SEQ ID NO: 356 - DNA, 1759 bp, Oryza sativa
tcctacacttaccgtcaccgaccgcgaaaaaattcccccaaaaccctagcggcggcggcgcgcgctcccctccccacctccgccgccgcggcgtcgaggcagcaccggagggcgatggcgtcgacggtgctggaggcgacgcgggcgaagcacgaggacatggagaggctggagcggctggcggtgcgggagctgcagcgggagcccgccaacgcgcgcgaccgcctctaccagtcccaccgcgtgcgccacatgctcgacctcgtcatctccacctccggcaagctcgtggaaatctacgaggacaaggataatgctaggaaggatgagatctccaaccatcttagttccacagtgcaagctgaaatctttccaaagttctatgacaggctcaaagagatccgtgattaccataggcgtaatccttctgcccgtttcgttagtgcaactgatgatttcgaagagctactaaaggaggaaccggctattgaattcactggagaggaagcttttggccgatacctggacttgcatgagctttacaatgagttcataaattccaagtttggaactccaatggaatactcagcatatgttggcaccttttctcatgtggagaagatggcacaaaatctgaaaacctccaggcaatacagagaatacctggagcatattttggagtatctgacatcatttctgtatcacacagaaccattgcaagacattgagaagatttttgcaaagttggaaagcgagtttgaagaacagtggatcaatggtgaagtgcctggatgggagagcaaggacccagagaaagaatctgcacaagagtcagtaatagaccttgattactataccactgttgaagagcttgttgagctgggcccagaaaagttgaaagaggctttagctgctcgtggattaaaaagtggtggtactgttcaacagcgtgctgagcgacttttcttgttgaagcatacacccttggaacaattggatcgtaagcattttgccaaaggttcacacagttctgtctccaatgctacttctaatggtaacaatttcaaggataatttgaagaaggaaattgctttaatggaagtaaagatgaggcgcctttgtgagctactagatgagatcattgtacggacaaaggaaaatgcagagaagaagctgactctcacatatgaagaaatggaagcagaacgagaagaggaagaagtgcaagctgatagtgaaagtgatgatgaagaccaacaaatctacaatcctcttaagttgccgatgggttgggacggcaaacctataccctattggctatataagctccatggtcttggtcaggaattcaaatgtgagatatgtggaaaccacagctactgggggcgacgggcttatgagcggcatttcaaggagtggcgccatcagcacgggatgcgctgtcttggaattcctaatactaagaacttcaatgaaatcacatccatccaggaggcaaaagaactctgggagaaaattcaacaacgacaagggctgaacaagtggcggccagacctagaagaagagtacgaagatcaggagggaaatatctacaacaagaagacctacactgatctgcagcgccagggcctgatttagaatccctgatgcgatcctaacattttggcccctatgggctgctgctgaagtggttggccatttgttctattgaacttcgttgacctctgggtagttgtagcactcgatacttgtagcacca

SEQ ID NO: 357 - DNA, 2149 bp, Oryza sativa
cttctcttctctcctccacgtcgcggctcgcgcctccaaatccccccccgcgaggcgagcagggcgaggcggcgaaagcgcgacgcgcgagcggatcgaggcggcggcgtcggtgccggcatccaccgcgtgcataggttgcgtcggcggcggcggaagcggggcgcgatgacggacggccaccacttcaacaacatatccctcggcggccgcggcggcaacaaccctggccagtttaaactttattcgggaggacttgcatggaagaggcaaggtggaggaaagaccattgaggttgaaaagtctgatatcacttctgtgacatggatggcaatccccagatcctatcagcttggtgtttcaacaaaggagggcctcttctacaggttctttggcttccgtgaacaggatatcagttcattgactaacttcatggaaaagaacatgagaatcacaccagaggagaagcagctttctgttggtggacataattggggcggaattgaaatcaatggcaatatgcttagctttaatgttggttcaaaggaagcatttgaagtctctctagcagacgtagcacaaactcagatgcaaggaaaaacagatgttgttctggagtttcatgtggatgatactactggtggtaatgagaaagattcattgatggatttaagctttcatgtaccaacttcaaatactcaattccctggagatgagaatcgtccttcagctcaggttttatggcaggctatcttgaataaggctgatgttggctcatcagaggaagctgttgttacatttgatggaattgctattcttactccaagaggtcgatacagtgttgaacttcatctgtcattcttacgactccaaggacaagctaatgatttcaaaattcaatatagcagtattcttcgcctctttgttttaccaaagtcaaataatcctcatacctttgtggttatcactcttgatccaccaattcgcaaaggacagacattatatcctcacattgttattcagtttgaaactgaagcagtcgttcaaagggatctgacattaagtgatgaggttttggctgaaaagtacaaggatagactggagaactcttaccagggtctgatacatgaagtgttctccaaggtccttcgtggcctatctggtgctaaagttacgaggccaagcacgttccgcagttgtcaagatggatatgcagtgaaatcatcactcaaagctgaagatggattgctctatccgctggagaagggcttcttctttctaccaaagcccccaacactcattctgcatgaggagattgagtatgttgaatttgagcgacatggtgctgggggtgctagtatctcatctcactattttgatctcctggtcaagctgaaaaatgatcaagaacatctattcagaaatatccaaagaaatgaataccataatctcttcaatttcatcagtggcaagcatttgaaaatcttgaatcttggagaagctcaaggtagagctggtggcgttacagctgttcttcagagcactgatgatgatgctgttgatcctcatctggagcggatcagaaatcagactggcgatgatgagagtgatgaagaggatgaagattttgtggcggacaaggacgacagtggatctcctactgatgattctggagaggagggttctgacgctagtttaagtggaggagaaaaggagaaatcttccaaaaaggaagctagtagctcaaaggcgcctttgaagaagaggaagccaaagggtggggatgcggcggaaggctcggagaaaagaaagccaaagaaaaagaaggatcctaatgcccctaaaagagcaattgcaccattcatgtacttctcaaaagctgagcgagctaatctgaagaacagcaatccggagctggctaccacagagattgcgaagaagcttggggagaggtggcaaaagatgacagccgaggagaagcagccatacgtcgagcagtctcaagttgacaagaagcgctacgcggaggagtcagccgcctaccgcggggcggctgccatggatgtggactccggccctgcttcggactgaagagaagagacctgaattgcattccagattacccttagtctaggagggcgacagacag

SEQ ID NO: 358 - DNA, 2524 bp, Oryza sativa
cctccgcttcgtctcctcgccggagttgagccgcgggatccgtcggagatggcgaccggagaagcggcggcggcggcggcgtcgccgccggagctggcgtcgttcctggcgatcgggcttgaccagcgcacggcggagaacgccctcgccaaccgcaaggtcaccgccaacctcaccgccgtcatcgccgaggctggtgttagtgggtgtgacaaatctgtggggaatcttctctacactgtcgcgacgaagtatccggcgaatgccctggtgcatcgtcccgttgtcatccaatacattgtgtcgtcaaagatcaagacccccgcgcaattagatgctgctctgtcgtttctttctactttgggtcctgatccattggacacagcaaagtttgaagagacatgtggagtgggggtggttgtttcaactgaagagattcagtcaatggtcactgatatcctgaaggaaaacatggaagccatagttgaacagcgatatcatataaatgttggcagcttgtgcggacaggttaggaagtggcacccctggggcgatgctaagttcataaaggaggaaattgataaaaggcttacagagattcttggtccaaagacagaagctgacaatgtaaagcctgtgaaaaagaagaaggagaagcccgcaaaagttgaggagaaaaaaactgcggtagctgctcctgctccaccatctgaggaagaacttaatccctactccatatttcctcaaccggaggaaaacttaaaggtccatacagaaattttcttcagcgatggaaatatatggagagcacacaacagaaaggacattttagagaaacatcttaaagcaactggaggaaaagtgatgacccgctttcccccagagcctaatggctaccttcatattggtcatgctaaggctatgtttattgattttggactggctaaagagcgcaacggacattgttaccttaggtttgatgatacaaaccctgaggcggagaagaaagaatatatagatcacattcaagaaattgtccgatggatgggctgggagccttataaagttacctatacaagtgactatttccaagaattatatgaacttgctgtttgtttgataaagaagggactagcttatgtcgatcaccagacaccagaagagataaaggagtatagagaaaagcaaatgaatagtccatggagggataggcctatagaagagtcactaaaactgtttgaagatatgaggcatgggttggttgctgagggaaaggcaactcttaggatgaaacaagacatgcagaatgataacaagaacatggctgacttaatagcatatagaataaagtttacacctcatccccatgctggcgacaagtggtttatctatccaagctatgactatgctcattgtttggttgactctcttgaaaacattacccattcgttgtgcacactagaatttgacatacgtcgtccttcatactactggctgctcgtatccctggaccagtaccagccatatgtttgggaatattcaaggttaaacatatcaaacaatgttatgtccaagcgaaagctaaataaacttgtgacagagaagtgggtagatgggtgggatgatcctcgcctgttgacacttgcaggactacggcggagaggagtatcatcaacagcaattaactcctttattcgtggaatgggcataacaaggagtgacaacagtttgatacgcttagaacgccttgagtatcatattagagaagagctcaacaaagtagctcctcgtgctatggttgttttgcatcccctaaaggttgttataaataatttagactatggaacaataatagaccttgatgcaaaaaagtggcccgatgctccaggagatgatgcttcggcctattacaaggttccattctcaagaactgtctacatcgagcagtctgattttcgtgtaaaggattcaaaagattattatgggcttgctcctggtaaaacagtactactaaggtatgcattcccaataaaatgtacggaagttatctatggtgataattcagataatatcattgaaatccgagctgagtatgacccttcgaaggctacaaaaccaaagggtgtgttgcactgggttgccgaaccttctccaggtgttaacccgctcaaagtggaaatcagattgttcgagaaattatttctttcagagaatcctgtggagcttgaggattggctgggtgatctcaacccacgatcaaaggaagtgataaagggtgcctatgccgtgccttcgcttgcaactgcagcgctgggggacaaatttcagtttgaacgcctcggttactttgctgtggattccgactcgacggctgaggaacttgtgttcaacagaaccgttactctacgggattcctatggaaaagctggacccaagtgatcgttttgtttgtggttgaaaagattggtgtaacagcatcattgctggtcttttgtattgcaccagcggtaaaatacaccagtgg

SEQ ID NO: 359 - DNA, 1130 bp, Oryza sativa
acccctcgtctgtctctcttccccaaaccctccacccaacccgcctcctcgagcgacggcgcagccatggcggaagcagcagcagcacctcccgccgccgccgccaccaactacgaggtggacctcggcaacctcatggcctacgacccgtcgcatcacctccccgccgcatcctcctccagggaggagctgagggaggagtgcctgcggaaggggacggagctggcgcaggcggtcgccgacgccctcttcgcgctgccggccaccgaggaccgcgacggccccatggtccgcctcccgccgcccaccacccgcttcccccgcgagaagcatctaccaaggccgaagccccctactaaatgggagcagtttgcgaagatgaaagggatcacaaagcacaagaagaacaaacgtgaatgggacgagcaaactcaaacctggaagcggacttatggctatgaccgtgttaatgatgataaagacattccaatcattgaagccaaggcgacagatgagcctggtgttgatccttttgctcaaagaagggaagataagaagaagcatgttgaaaagcaagaaaagaacagactagaaaacttgaaaaaagcagccaaagttggtgctttgcctagtcatatacaacttgctgcaacagcgttgcctatcacgggaactaaagcagacatacccaaaaaatctagaaagaaagatctcgaggatgttgctggcatggcttcatcagcaacagctagtggtgggaagttcgatgaaaaattgcctggcgagaaacctccaaaaaatcctggcaaacatagaaagttcctccctgttgttgaaggaaaaggaatgggcaaccaggagaaacagcaaaatgacaaaatcttgaatgctctgctggccaaaagttctgaggatcaaatggatgttggcagggcaattacgatgtacaaggtgaagaaggagaaacaaaggaggaaagataaggaaaagtcttcttcatcgaacaagctgaagccccagaagaaaacactcaagaaatcttcgaagaaaaaggcttaggttaattacattcttcggacctgctgtaggaggtgagcatagttttcgagactcaaggagaattggcaaat

SEQ ID NO: 360 - DNA, 569 bp, Oryza sativa
cgaaccctaactccatcttccccggcggcggcgcagcagaggatatcagccatggtgaagtttctcaagcccgggaaggcggtgatcctgctgcaggggaggttcgcggggcggaaggcggtgatcgtgcgggtgttcgaggagggcacccgcgaccgcccctacggccactgcctcgtcgccggcctcgccaagtaccccaagaaggtgatccgcaaggactcggcgaagaagacggcgaagaagtcgcgcgtcaagtgcttcctcaagctcgtcaacttcacccacctcatgcccacccgctacaccctcgacgtcgacctcaaggaggtcgccgcggggcccgacgcgctcgccaccagggacaagaaggtcgccgcctgcaagtccgccaaggcgcgcctcgaggaccgcttcaagaccggcaagaacaggtggttcttcaccaagctccgcttctgagctctctcctgcggcggcggcggcggcgatgggatggtactggtgcacggccatctcatcctttttctctttttctaaagcttttcgctttctgagtagcagccaat

SEQ ID NO: 361 - DNA, 998 bp, Oryza sativa
cgacgatggacatggcgcacgagagggacgcgagcagcgaggaggaggtgatgggcggcgacctgcgtcgcgggccgtggacggtggaggaggacctcctgctcgtcaactacatcgccgcgcacggcgagggccgctggaactcgctcgcccgatcagcagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcacctcccgggacgcaccgacaacgagatcaagaactactggcgcacgcgggtgcagaagcacgccaagcagctcaagtgcgacgtcaacagccagcagttcaaggacgtcatgcgctacctctggatgccccgcctcgtcgagcgcatccaggccgccgccgccgggcagcagcagcagcaggaaggcggcaccgacacgccgcccctgtcgtggcagcacggcggctccgacgggctctacgagtcgccggagctcccggcgcccgatgccagctgctggccagccgagtactgcgcggcggccggcggcgcgcagtcgggcggcacgcctgcaccggagctgtcgagcaccacggccgggtcgtcgtcgctgtccacggactccggcgccggggcgcagcccagctggcccacgcaggccgacggcgccgagtggttcaccaccgcctgcgacgcctccagcgccaccggcggcgtggccatgcgcgacacggagctggagctggcccagccgccgtgccagggcgggcagacgtggacgacgtccgagtcgtcgctgcctggcctcaccttccccgacctcgccgtcgcggacttcgagatcggcggcttcgacgtcgatagcttctggacgagcatggaggacgaccagctgtggtgccccacccaggccgccgtgtgatga

SEQ ID NO: 362 - DNA, 673 bp, Oryza sativa
caatctccttgtggctagttcggacagcagcagcagcgtgggtggtgccgctgcgattccggaggagggggcggtagttcggaggcggcgcgatgaggttggagaagtgctggttctgctcgtccaccgtctaccccggccacggcatccagttcgtccggaacgacgccaagatctttcgcttttgccggtcaaaatgtcataaaaatttcaagatgaagaggaatcctcgtaaggttaaatggacaaaagcgtacaggtgcttgcatgggaaggacatgacacaggactccacctttgagtttgagaggaaaaggaacaggccagagcgctatgaccggaatgtcactgagcaaacacttaaggctatctctcttattacaaagattagacatgaacggcagaagaaacatattacagagaggcaaaaacagggtaagacaaagcaacgggagagggatgctaaggagttggaacaggatattcaaatgcttccaaagaaggttaccctatcaacacaaaaaacaaaagtcgtggttaaagtttcccagcagcagacagaagagaatcttatggaagagtaatgaaatggaatcaagttttgcatgttgttatgtaggactgtgtttcatcaaatcgttactatgaacggtgtatttgactgggtatcagc

SEQ ID NO: 363 - DNA, 2237 bp, Oryza sativa
gcgcgatgcgggccagggagatgcacccgctgtgctgcctcgtctccgactgcgcgttgggtggaggcggcggagggggaggtggtgaggggggaggaggagactgctcgccgacgaaggcggcggtggggggagaggaggaggtggtggcggtggcgggggtgctgtacaagtggaccaacatcgggaaggggtggcggccgcggtggttcgcgatccggggcggcgtcctggcctactccaagatccgccgccgcgtcgccgccgagccgcctcccgaggccgccgccgccgccgcagccaacggcgtcaggctcatcggcgtgccccgcggcggcgtcggggaccagcccatcggattcgtccctctcaagatctcatcatttagcgaaagtaaatcggatgataaacggttctacatcattaccccaaccaagacgcttcagctgaggactggctctgctaaggaccgtgtggcttggattgaagcacttgtttctgcgaggagtgaatattctcttaacgggggtgtaccgtgtgaccagaatgagggatcattttccactgaaaagcttaggaatcgcttgcatgctgaaggtgttggagaggcaactattaaagactgtgaacagatcattcactcagaattttcacagtatcacactcagatgaagcaacggtgtgaagactatttaaacttcattggcagtcttccaagggaacttgaggtagttaattcgggagatgcatctgctattgagaagccacagtcggagttgttcaaacatgactgttccagctctggaaaatgtagtgagtacagcaacactgaatcttctgatgatgctggcaaacaagaggtagggcagttgtcagatgaggatgagtttcatttctatgatacaaggcaaagtttcagtgacactgctgcaagtcctgacttgaaaatgagatgttcaaatagtgggagtggagctcacaagtttggtgaattactagctatcgacaagacgaatgaatacttattgtcatcttcaaaacgccgttcagagttacccgtaccaatagaaaaggagaaaggtgttagcctttggtcaatgatcaaagataatgttggcaaggatcttacaagagtctgtcttcctgtttactttaatgaaccattgtcttctcttcaaaagtgctttgaagatttggagtattccaatttactggatcgtgcatatgaatatggttcaaggggaaacgggctgatgagaattctttatgttgctgcatttgctgtctctggatatgcttccacggattctcgcccctgcaaacctttcaatccattgttgggggaaacatacgaagctgattatcctgaaaaagggatccgtttcttctctgaaaaggttagtcatcatccgatggtcatggcatgccattgtgaagggaaaggttggaaattttggggtgacagcaatctaaagagcaaattttgggggcagtccattcaactcgatcctagcggtgtgctaactctacagtttgatgatggagaaactttccagtggagtaaggttacgacaacaattaataaccttatcattggccgagtctattgccatcaccatggcacgatgaacataagtggaaacaggcaatattcatgtaagctgactttcaaagagcaatccttcctcgatcgtaatcctcgccaggttcaaggacttgttacggatgctaatgggaccaaagttgcattcttgatgggaaagtgggacgagagcatgtcttgcatcattggtgatgatgcttctaaagtgaactcccgtaatgcaaatcagagtacgggtgccactttattgtgggagaaaaatgtgcctccagccaatcccactcgatataacctgtcatcatttgcaatcactttgaacgagttgacaccaggtcttaaggagaagcttccaccaacggattcaagactcaggccagatcagcggcatctagagaatggggagtacgaaaaggctaactctgaaaaattgcgcctggagacgaggcagaggatggcaaggaagatgcaggagagtggttggaagccaagatggttccaaagggacacagaggatggaacattccgttatgtcggaggttactgggaggcaagggagcagaggaaatgggttggttgcaatgacatattcggcaataatgtgtccactctttgcaccagcgcaagtatatagtaa

SEQ ID NO: 364 - DNA, 3707 bp, Sorghum bicolor
cagccatgtacctctacagcctgacgctgcagcgagcgacgggcgcggtgtgcgccgtcattggcagcttcagtgggcgggactcgaagaagtcggccgcctccggctccggctccggctccacgcaggagatcgccgtggcccggggcagcacgctcgacctcctccgcccggacccggagacgggccgcctccgcacgctcctctccgtcgacgtcttcggcgccatccgctcgctcgcgcagttccgcctcaccggcgccaacaaggactacctcgtcgtcggctccgactcgggccgcctcgtcatcctcgagtactcccccgaccgcaaccgcctcgacaaggtccaccaggagaccttcggcaagtcgggatgccgccgcatcgtccccggccagctcctcgccgtcgaccccaagggccgcgcgctctgtatcgccgcgctcgagaagcagaagctcgtctacgtactcaaccgcgacgccgccgcgcgcctcaccatctcgtccccgctcgaggcccacaagtccaatactctcaccttcgccctcgccgcgctcgactgcgggttcgacaaccccgtcttcgccgccatcgagctcgagtacgccgagtctgaccgcgaccccacgggacaggctgccaaccaggcgcagaagctcctcaccttctacgagcttgacctggggctcaaccatgtctcccgcaaggtctctgagcccattgataatggtgccaatcttctagtgactgtccctggtggcggtgacggtccgagtggggttctcgtgtgctgcgacaatttcgtgctgtaccggaaccagggtcacccagagattcgtgctgttattccacggcgtgctgacctccctgctgagcgtggcgtcctcattgttgctgccgccacacacaaacaaaagagtatgttcttcttcctgctacagactgagtatggtgacatcttcaaggttgaccttgatcataatggggatactgttagtgagctcaggatcaagtactttgacaccataccagtgacatcagctgtctgtgtgctgcgatcgggtttcctctttgctgcttctgagtttggcaaccatgcactttaccagttccgtgatattggcagagatgcggatgtcgagtcctcttctgcaacactgatggagacagaggagggattccagccagttttctttcagccaagggcactgaagaacctcatgcgcatagatgagattgagagcctcatgccagtcatggacatgcgtgtcgcgaatttatttgacgaggaaacaccccagttgttcactgcctgtggccgtggtccgcgctccacgctgcgcatcctgaggcctggccttgccatcagtgagatggcccgatcaatgttgcctgctgagcctattgctgtgtggactgtcaagaagaatatcaatgacatgtttgatgcttacattgttgtgtcatttactaatgtcacgcttgtgctctctattggtgagaccattgaagaagtcagtgacagccagttcctggacaccacacactcccttgcagtcacgctccttggtgaggactctctaatgcaggtccacccaaatggcatccggcacatcagggaggatggtcgtgtcaatgagtggaggacgcctggaaagaaaactattacaaaggtcggatcaaaccgtctccaggtggtaatcgctcttagtggtggagagctcatctattttgagatggacatgactggtcagctcatggaggtggagaagcaggacatgtctggtgatgttgcatgcctggccattgcgccggtccctgaggggaggcaaaggtccaggtttcttgctgtaggatcctatgataacaccatccgtatcctctcactggaccctgacgattgcctgcagcctctaagtgtccagagtgtatcatcggcaccagagtcactcttattcttggaggttcaggcctctattggtggtgaggatggtgcagattatccagccaaccttttcctcaatgctggtctgcagaatggtgtccttttccggaccaatgtcgacatggttacgggtcagctatcggacacacgttctcgattccttggcctgagacctccaaagttgttcccttgtgtagttagccacaggcaagcaatgctctgcctatccagccgtccttggctgggctatatacatcaaggccattttctcttgacaccactgtcctgtgatacgcttgaatctgcatcatcattttcttctgatcagtgctcagaaggtgtagttgctgttgcgggagatgccctacggattttcaccattgaacgcttgggagagactttcaatgagacggccatccctctgcggtacaccccaaggaagtttgtgattctaccaaagaaaaaatatattgctgtcattgagagtgataagggcgcgttcagcgcagaagagcgagaagctgctaagaaagagtgcctcgaggcttctggtgcagcagagaatggaaatgcaaataatggcgatccaatggagaatggtgatggtcaagaagatggtgctgaggagggcaacacatttcctgatgaacaatatggttatccaaaggctgaatcagagaggtgggtttcctgcattaggatccttgatccaaggagtagggacacaacctgtcttctggaattgcaggaaaatgaggctgctgtcagtatttgcactgtgaatttccatgataaggagcacggaactctactggcggttggcactgccaagggattgcagttctggccaaggaggacccttgctggtggattcatccacatatataagtttgtggacgaagggaggtcacttgaacttctacataaaacgcaagtggaggaagtacctcttgcactgtgccaattccagggacgattacttgcaggtgttggttcagtgctcagactatacgatctggggaagagaaaattgctcagaaaatgtgaaaacaagctttttccaaggacaatagtgtctatccatacctaccgtgataggatctatgttggtgatatgcaagagtcatttcactattgcaagtacagacgagatgaaaaccaactctatatatttgctgatgatagtgttcccagatggcttacagcggcacaacacatagattttgacactatggctggagcagataagtttgggaatatatattttgctcgtcttcctcaggatatctcagatgagattgaagaagacccaactggaggcaagattaaatgggagcaagggaagttaaatggtgcccctaacaaagttgaagagattgtgcagtttcatgtcggtgatgttgtaacatgtttgcagaaggcctctttgattcctggtggaggggaatgtcttatttatgggactgtgatgggcagtgtgggagcactgcttgcattcacctccagggaagatgttgacttcttttctcacttggagatgcatcttcgtcaggagcatccaccattatgtggaagagatcacatggcttacagatctgcttattttccagtgaaggatgtgatagatggtgatctctgcgagcagtatccctccctcccagctgatatgcagaggaagattgctgatgaactggacagaactcctggtgagatcctgaagaagctagaagacatcaggaacaaaatcatctaataa

SEQ ID NO: 365 - DNA, 986 bp, Sorghum bicolor
tggcgatggaagaaaccctagccgtcgaatccgccgccggcgagacggcggccgcgcaggcgcctgagcggaaggaagagacgctcgaggaggtgctctcgaggcacaggaaagagaaatcaaaactccaggataaggaaacaagcctcaagaaagctgctgcaaaaggaagcaaagctgagcagaaggcaaagaaaaagcaggtagaggaagagattacacgcctctcaagagagttagaggcgaatcatgctgcagagcttgcttcctttgggtacaaaccctctggcagctcagagaagggaaaccttgacaacttagtgaaggccatagctggtgtttcagtttccagcaattcggattctgcaaagcccagcaagggaacacgacggcgagagaagaaggcgaaggaggaagctgctcgagagcagcggatccaagaagaacaaagcaatctcgtgagcgaccgcatgttagaaaacgagaagcttgaaaggaagcttgagcccttggggctgaccattcaagagataaagccggacggtcactgcctgtaccgtgctgtcgaaaaccagctattgctccattccaatggtgctgcacagtacagttaccaggacctacggcaaatggcagccaagtacatgagggagcatgctgctgatttcctcccattttacttagcagaaggcaaggccgatattggaccagatcccatggagagcttcgagaggtactgtgaggagatggaatccactgcagcttggggtgggcagctcgaacttggtgcactgacccactgcctgaagaaacatatcgtggtctactcaggctccttcccggatgtggagatgggcaaagaatacaaatctggatctggaggtagtgatgccggtgatgcaagcatcaggctgtcgtttcacaggcatgcctatggtctaggcgagcactacaactcggtgattccagccgaatcatcttaataa

SEQ ID NO: 366 - DNA, 1633 bp, Sorghum bicolor
gtttactgttgccatggtgttggtctgacggcccatcaaggttttgtgaaagatgtggaagcagttcctcagcaagctgccccggaagtcgtcggcctcgggggattcaggccagtgcagcaatggcaccgggatacagcgcacgagcagctgcagcagcatcccgtctggccgcccggcttcagccatccggcgcatgtcatccgccgtcttcccatctagtgttgtggctggtatcgagccgctggtctcgttcaaggatgtccccaactcggagaagcagaacctgtttgtgagcaagctgagcctgtgctgtgttgtctttgatttctcggacccgaacaagagttctgtggagaaggatatcaagaggcaggcattgctggatcttatagagtttgtcgagtccaccaatactcgcttctcggaggcggcgatcgcggcctgctctaggatgtgtgctatcaacctgttccgggcgttccctccaaactgcaggtctggctcatcaggtggtggcgagggcgacgaggacgagccaatgttcgatcctgcttggtgccatctgcagcttgtttatgagctgctactgaaatttattggatcatcatccttggatgcaaagatagggaagaagcactttgatcactcattcattgtgaagctcctgaatcttcttgactcagaggatccaagagaaagggattgcttgaaaactattctgcacagggtatatgggaagttcatggtgcaccgtcctttcattcgcaaagcagtgagcaacatattctaccagtttgtctttgagactgatcggcacaatgggatcgcagagctgctggaggtctttggcagtgtcattagtggttttgcattgcctctgaaagaagaacacaagatctttctttggagggttttggttcccctacacaaaccgaaatctgttggtgtgtatcttcagcagctgacctactgtgtaacacagtttatagaaaaggacccaaagcttgcaagctcagtgataattggtttgttaagatattggccaataacaaattgtcagaaggaagtgatgtttctcagtgagattgaagagattttggagtctaccagccaggcagaattccagaaatgtatggtaccattgtttcggagaatcactcattgtatcaccagttctcacttccaggttgctgaaagagcgctcttcgtatggaataatgatcacattatcagcttgattgcacaaaaccgccaagtgatcatgcctcttgttgttccagcactagagcagaatattcagaatcactggaaccaagcagtcctgaatctgactgtgaatgtcaagaaaatgttttctgagatggacgatgatctcttctcatcatgcctggccaagtacaaggaggaagaagaaaaacgtgtgtcgctagaagcgaagcgtaagcttacctgggagaagcttgaggcagctgcagctttccagccagtgactggccatacagccgtcctagtaggccaccagccatcagcaaatatgatcgccaccctgatctagctcatgcatgccgcacaagcaaaggtgctcttcccccttttggtgaagcgcagcaagtgtagtgttccctgttag

SEQ ID NO: 367 - DNA, 887 bp, Sorghum bicolor
agatcatgggggacgccgcagagaccaccagcaagactcttcacaactggatggccgagccgaggccgaggccgagcggccagggcgacgacgaggagacgcttcagctcagcctcggcctccccggcggcggcggaggaaatggagctggcgctgggctgccacccgccgccgcctggagaatgctgccggccagagacaaggagatgcactccgctgctgctgctgtcgacacctcctccatgctctcgctcggctactccgccccagctttctcgcccgcccgctcaccaggcaaggcaaaggggtccccagcagcggctacagagaatgcccggcttgcatccaccaacaacgcctcccaggcaaggcaaagatctccaaataccccagttattgggtggcctccggttcgtgcattccgaagaaatctggctacctctagcaaagcatcccttgaacatcacaatgggaagaaggcagccagacctgaagagaccacaaaaagagctccatttgtaaagattaacatggatggcatccctattggtagaaaaattgatctgaatgcccttggcagttacgacgagctgtctctgtctgttgacaagctattccggggacttcttgcagcacaacaagaccctctggatgccagcacgaaggagtgttcacaggaagaggtggcaatatcgggtttactagatggaactggggaatacactctggtttatgaggattatgaaggtgatagggtgctggttggtgatgtcccctgggggatgtttgtttcttcggtgaagaggctgcgagttctgaagacatctgacctctcctcatctctaacagcatcaggccggaagaggacggtaactgagtgttgatga

SEQ ID NO: 368 - DNA, 1341 bp, Hordeum vulgare
tagccatgaagcctagcgttgccgccctcctcgtgtccttcgtggcgctgctcttggtcgccgccgtgcggggcgatgacgacggctgcgggtcgccggagtcggcggggcaggaccgggcgcgggcgaaccatctcaaaatcgcggccttcttctccatcctggtctgcggggcgctgggctgctccctgcccgtgctggggcggcgcgtgcccgcgctccggcccgagggcgacgtcttcttcctagtcaaggcgttcgcggcgggggtcatcctcgccacagggttcatccacatactccccgacgcgtttgagaaactcacgtcgccctgcctgctgccttccgacgggccgtggcacgacttcccgttcgccgggctaggggccatggtcggcgccatcggcacgctcgtcgtcgacaccgtcgccacggggtacttcacgcgcgcccagctgaacaaggacggagcgcacggccacggggcgataaccagcagcgccgccgtcgtggacgaggagaaacaggccgctgcggccgccagcgaggaagcccgccgtcacgagggcggggagcaagaggtacacgtgcacacgcacgctacccatggccacgcccacgggtcggcagcgctcgtggcggccgttggcggcgccgaggacgaaaaggacacgatccggcaccgcgtaatctctcaggtacttgagttgggtattgtggtgcactcggtgatcatcggcatctccctcggcgcgtctcaggacccggacaatatcaaacctctcgtcgtcgccttgagcttccaccagatgttcgagggaatgggccttggtggctgcatagttcaggcaaagttcaaggctagttccgtcgtgaccatgatcctcttcttctgcctcacaacgccggtggggatcgccgtcggctttgggatatcgcgagtgtacaacgagaacagcccgacggcgctggtggtggagggcagcctcaactcggtggcggcggggatcctcgtctacatggccctcgtcgacctcctcgccgaggacttcatgaaccccaaggtgcagagcagggggaagcttcagctcggcatcaacatctccatgctggtcggtgcaggcctcatgtccatgctcgccaaatgggcctagccgcaagcctacaacatgaaacagtttccctacaacatgaaccagttttgctccatgacatatatatgtacagacgtccccctattgggtcgtcgaatttgaaacgatataatctcccaaactaggtaatgccaacccagtagcttaggcatataaagaaaactagttctggactgaaagtttggga

SEQ ID NO: 369 - DNA, 974 bp, Hordeum vulgare
cgatcatggcggcgcgcgccattgttgtcctctcgctcatcctcgcgctggtcgccatctccagtggaggagcgtcggcgcagctgtcgtcgggcttctactcccacacgtgcccgggcatgctcaaagccgtgcgctcggcactgcacccggccatcggcagggagcggcgcgtgggcgcctccatcgtccgcctctacttccacgattgcttcgtccagggctgcgacgcctcgctgctgctggacgacgcgccgggcctgcgtggtgagaagaacgccacgcccaacaagaactccgccaggggtttcgaggtcatcgacgccgtcaaggcggccgtcgaggagtgttgtcccggcgtcgtctcctgcgctgacatcctcgccatcgccgccgaggagagcgttgtcttcctgggtggcccgagctgggaggtgaagatggggcggagagactcgacgacggccagcttcaacggcgccgagaacaacatcccaccgcccacgtcggggctcgcaaaccttacgtccctcttcgccgcgcaggggctctcccagaaagacatggtcgcactctcaggagcgcacacaatcggcctagcacgctgcacaaacttccgggaccacgtctacaacgacaccaacatcgatgccgactttgccaggagccaccagtcaggctgccctcgcgccacaggctccggcgacaacaacctggcgccgctggacctgcagaccccgaccgtattcgagaacaactactacaaaaacctcgtccagaagaggggcctcctgcactcggaccaagagctttttaatggtggcgctgctgacgcgctggtccgggagtacgtcagtagccagagcgtcttcttcaaggactttgtggagggaatggtcaagatgggggacatcatgcctctgacgggatccagtggacagatcaggatgaactgcaggaggatcaactaataa

SEQ ID NO: 370 - DNA, 1746 bp, Phaseolus vulgaris
gagaacactgtgctgtgctgtgctgcttctaccatggaccctctctctctcctccaagttcttcagtcacactcctttgcaactgtgcttgctgtgggtgcttcatctcttctgttcctcatcctcaaactccgactcactggcagacatgcaagacttccttcagtaccagctgttcctggacttcccgtcgtagggaatcttctgcagttgaaggagaagaaaccttacaagaccttcgcacggatggctgaggaacatggacccatctattccatcagagccggttcttccactatcattgttgtcaactccgccgctattgccaaggaggccatggtgaccaggtttaattcgatttcaacaaggaagctatcaaaggccctgacgattctgacttctgataaatgtatggttgccacaagcgactacaatgattttcacaaaacggtcaaaaaacatattcttgcaaacgttttgggagccaatgcacagaagcggcaccgtctccacagagaagacatgttggaaaatattctgagcagtttcagtgaacatgtgaagaggttctctgatcaggcagttgattttagaaatgttttcgtatctcaactttttatattagcactgaagcaaggtctgggacgtaatatagagtccatttatgttgaggagcttgagcgcacattatcaagagatgacatatacaagattctagtgcttgatatgatggagggagccattgaggtggattggagagatttctttccatacttgaagtggattcctaataggagcgtggagaagagaattcagaatttgaatttccggagaggagttgtcatgagggccttgatgaatgagcagaagaagagaatggcttcaggaaaggtagaaaattgtttttatgactacctggtaaccgaagccaaagaactgaatgaacatcaaatttccatgctactctgggagacaattgttgagacatctgatactacattagtgacatcagaatgggctatgtatgaacttgctaaagacaaaactcgtcaggcccgtttgtacaaggagctccaaaatgtttgtggacaagaaaaggttacagaagagcacttatctaagctaccttacttgggagcagtattccatgaaacattaaggaagcataatccagctccaatcgtgccaataagatatgctcatgaaaatacagaattgggaggatatcacattcctgctggaagccagattgcaataaatatatatggatgcaacatggacaagaataagtgggaaaatcctcttgagtggaagcctgagagatttcttgatgagaaatatgacccctcagatttatacaagaccatggcctttggagctgggaagagggtgtgtgcaggttctcttcaggccatgttgatagcctgcacagcaattgggagatttgttcagcaatatgagtgggatctgggacaggggcaggaggagaatgtggatacaatgtgccttaccacccacagactccaacccctgcaagtaaaactcaggccaagaaaggaatacacgaagtaggtgcatttggtgttgctgccttctgaaggggacctaaagaataaaaccagtgaataagactttttatggtgtttggtgttttgtgttttgtgttttgttttgttccattcgaagtttgttgaactgaggtggtttcttatttactatagccagcagagtatgtctggtggtatg

SEQ ID NO: 371 - DNA, 1811 bp, Setaria italica
ttgatagacagacacaggcacaggcagctgtagtgagtgagtagtgagaccggccgggcagggcagcagcggagaagagagcttgagagttgagacatggccatcggaggcggcggcttcgctgaaggccccgccggcgccggctacagcggccgggtcacctccttcgtggtgctctcctgcatcgtcgccggcagcggcggcatcctcttcggctacgacctcggcatctcaggtggggttacctccatggagtccttcctcagcaagttcttcccggacgtgtaccaccagatgagaggggacaagaaggtgagcaactactgccgcttcgacagcgagctcctcaccgtcttcacctcctccctctacgtcgccggcctcgtcgccacgctcttcgcctcctccgtcacaaggaggttcggccggcgcgcctccatactcatcggcggcagcgtcttcatcgccggctccgtcttcggcggggcagccgtcaacgtctacatgctgctcctcaacaggatcctcctcggcataggactcggcttcaccaaccagtcaattccactgtatctatcagaaatggcgccaccgcagtaccgtggagccatcagcaatggcttcgagctctgcataagcattggcatccttatcgccaacctcatcaactacggagtcgagaaaattgcagatggatggggctggagaatctctctctccttggcagctgtgccagctgcattcctaaccattggcgcaatcttcctgcctgagacacccagcttcataatccaacgggatggcaacattgacgaggcaaagatcctgctccagaggctacgtggcacaactagaatccagaaagagcttgatgatttggtctctgctagcaatatctcgaggacaataagacatccactccggaacatattcaagaggaagtacaggccgcagcttgtcatagcacttttgattcctttcttcaaccaggtcactggaatcaacgtcatcaacttctatgcgccggtcatgttccggaccatcgggctcaaggagagcgcatccctcatgtcagcggtcgtcacacgcatctgtgcaacagttgctaacattgtcgcaatggtcgtcgttgacaggtttgggcgtaggaagctctttctagtaggtggcgttcagatgatcttgtcacagatcatggtaggggcagtcctagctgcaaagttcaaggaccatggagggatggaaaaggagtatgcatacctagtcttgatcatcatgtgtgtgttcgttgcaggctttgcatggtcatggggacctctgacctacttggtcccaaccgagatttgcccactggagatcaggtcagccgggcagagtattgtcattgctgtaatcttcttggtgacatttgtgattggccagaccttcctcgcaatgttatgtcatctcaagtttgggacattctttctctttggcggatgggtgtgcgtgatgacagtcttcgtatacttcttcctgccagagacaaaacagctgccaatggagcaaatggagcaggtctggaggaggcactggttttggaaaaggattgtaggggaggaagaggaagagagagaggcaggaagcatagctttgtccaccacatagtgacttttcttttggggtcaaatctttttggtgaaacctgcagaaatggtacaccattttgattagtataaatatgcatgcatgatcaaagtatattgtatagctgcacaaattgtatcctaactagtaactgcattagtctcctaatttgatgcttctggcat

SEQ ID NO: 372 - DNA, 899 bp, Setaria italica
ctccaatggctggcctgtctcttcagcacccactggctttcgcctttggcctcctcggtaacatcatctccttcatgacctacctggccccactgccgaccttctaccggatctacaagaacaagtcgacgcagggcttccagtcggtgccgtacgtggtggcgctcttcagcgcgatgctatggatctactacgcgctgctcaaatccaacgagtgcctgctcatcaccatcaacgccgcaggctgcgtcatcgagaccctctacatcgccatgtacctcacctacgctcccaagaaagcaaagctgttcacggccaagatcctcctgctcctgaacgtgggggtgttcgggctcatcctcctcctcaccctgctcctctccgccggccagaaccgcctcgtcatcctcggatgggtctgcgtcggcttctctgtcagcgtcttcgtcgcgccactcagcatcatccgtcaggtggtgcgcacgaggagcgtggagttcatgcccttctccctctccctctccctcaccgtcagcgccgtcgtctggttcctctacggcctgctcatcaaggacaaatacgtcgcgctgcccaacgtgctgggcttcagctttggcgtgatccagatgggtctctacgcgctctaccgcaacgcgacgcctagggtgccagccaaggaggtcgccgacgacaaggaggacatcatcaaggtgcccgagcacgtcgtgaccatcgccaagcttggcgcaccggccgtggagctcaagacccacgaggtgcgccccgtggagtctcctcccatggaggaggaggtgaagccggagagcggcatggctgcagccgagaaggagcaggacaaggtgatgaacaaaggtggcaacgccgatcaggcctagtag

SEQ ID NO: 373 - DNA, 956 bp, Zea mays
aagcgggagggagatgaggggttcgtcgcggaggccggttgccgtggtgatggcctgggtgcgtcgccagccgcccaaggtcaaggccttcctcgccgtcgtcgcggggatggccgcgctcgtcttcatccgcttcatcgtccacgaccacgacaacctcttcgtcgccgccgaggccgcgcacgcgctcgggatcgccgtgctcatctacaagctcaccaaggagaagacctgcgccggattgtcactcaagtctcaagatttgactgccttatttctggctgttaggctgtattgtagttttgttatggagtatgacatccatacaattctagatacagctacacttgcagctactctttttgttatttacatgattcggttcaaactgaggtcgacatatatgctggataaagacaactttgccttgtactatgtggtattgccctgtgctgtgctagcgctacttgttcatccttcaacatcgcacaacattgtgaacagaatctgctgggccttctgtgtttatttggaagcagtttcagtgttgccccagttgcgcttgatgcaaaataccaagattgtggagccgttcacagctcattatgtgtttgcgctgggtgttgcaaggtttcttagctgtgcacactgggtccttcaggttttggacacccgaggcggattgttgactgcgctgggctacggtctgtggccttcaatggttctcctctccgaaatcgtccagacattcatccttgcagatttctgctactactatgtgaagagtgttttcggcgggcaactggtgctgcggcttccgtccggggtggtctgaaaaactgcagcgagatagaaaagcataccgttcgttccttctgtgttagatcatacaaagcgacagtcattgtgctcctagcgcccaaacttttgcactcgtaaagtggattagcagaggg

SEQ ID NO: 374 - DNA, 1895 bp, Oryza sativa
atcctcgcaaccactgtctcgctctccgccgccatcgccgccgccgccttcctctccgccgccgccgttggtactcgcgcttgccgcccgtcgagctcccctcaccgataaaggctcaccgaaggtttcgtcgtcgaccccgggagtttcaaatatgtctggccgaggactgatgaagcaggacttaagcaagcttgacgtgacgaagctccaccctttatcacctgaagttatctcacgccaggcgacgatcaatatcggtaccatagggcatgtggcccatggaaagtccactgttgtgaaggctatatctggagttcagaccgttcgcttcaagaatgagctggagcgtaacatcactataaagcttggctatgctaatgcgaaaatctacaaatgtgaagacgagaaatgtccacgaccaatgtgctacaaggcttatggaagcggaaaagaagatagccctcactgtgatgtgcctgggtttgaaaacactaggatgaagctactgagacatgtttcttttgttgattgtccgggacacgatattctcatggctacgatgcttaatggagctgctatcatggatggagcattgcttctgatagcagcaaatgaaagttgcccacaaccccagacatctgagcaccttgctgcagttgaaatcatgcgtctccagcatatcatcattcttcagaacaagattgatcttatccaggaaggtgcggcgatgaatcagcatgaagcaatccagaaattcatccagggcaccattgctgaaggtgctccagtggtgccaatatctgctcaactgaagtacaacattgatgtgatctgtgaatacattgtgaagaaaatccccattcctgaaaggaacttcacttcccctccaaacatgattgttattcgctcctttgatgtcaacaagcctggttcagaggttgatgaaattaggggtggtgtagctggtggcagcattctcagaggagttttgagggttaaccagaacattgaagttcgcccgggaattgtaatgaaggatgagagcggcaacatcaaatgcaccccaatctattcgaggatcgtttcactctatgctgaacagaatgaactccaatttgctgtgccaggaggtcttattggtgttggaacaaccatggatccaactttgacacgtgccgatagactggttgggcaggttctgggtgaagttggatcccttcctgatgtctatgtggagcttgagatcaacttcttccttcttcggaggctattaggtgtgaggacaaaaggcacagagaaggctgggaaggtctccaagctcaccaagggtgaaatcctcatgcttaacatcggatctatgtcgactggtgctcgcgtggttgctgtcaagaacgatctcgccaagcttcagctcactgcccctgtctgcacaagcaaaggtgagaaggttgccctcagccgccgtgtcgagaagcattggcgcctcatcggatggggccagatccaggctggcacgacgctcgaagttccaccatgcccgctctgaattgtgtttctccaggcagaaatcctaatctttgagagaagatagaagagatgtggaagggcagagagctcctaggcactatttttgtgaggtggatgagaaaacatgaatttgatttggaagccatgtcattgcgtgctatcgaattcagctatgctacaaaagttttgcttacatctgcattctgaattatggagaatcgttttttcaccatgttataatgaatttgaagtggggagaaacctactaattgatcagaattgcattattgcatttctcactgaatccaatcagtgatgtattattgcattgaacatgttgcaagaaaggaacatatcgctctgga

SEQ ID NO: 375 - DNA, 632 bp, Oryza sativa
atccgatgtgcggcggtgcaatcatctacgactacatcccggcgcgccgccgggtgtgcgcctccgacttttggcccgacgccgacgactccgacccccacacccccgctcccgagaaaccgccgcgcgcgaagagggagcggaagaaccagtaccgcgggatcaggcagcggccgtgggggaagtgggcggcggagatccgcgacccggtgaagggggtgcgcgtctggctcggcacctacccgaccgccgaggccgccgcgcgggcctacgaccgcgccgcgcgccgcatcaggggcgccaaggcgaaggtcaacttccccaacgacttcggcgccgcccccgcgccggccgcggcggcggcgaaggccgtccctcgcgtcgcgcccacgccggccgtgctcccgccgcccaagatggaggcggtgtccgagggcgccggcgcctgctcctccgacgaggtcaaggagctgtccgaggagctgctcgcgtacgagaactacatgagcttcctcggcatcccctacatggagggcggcgccgcctccgccgccggcgccgaggaagccgcggcgcccgccgggctctggaccttcgaagactacgagctgccgtcgctagcgctctagtag

SEQ ID NO: 376 - DNA, 932 bp, Oryza sativa
gggcaatggaggctagagcggggctggcgatgcagtcgcgggcggctgtcggggtcggagctggccccggcgtggggcggcggggccgcgccgtgatccgcgtggggaagcggccaaccgcggcgagcctgcgggtcggaggccccgccggaccggcggcggccaagcccctcgccccgctgtactgcctcaaggcgtccagaggccacgacagcttgcataactcagttgatgaagccctcctgttaaagaggaaatcagaagaagttctattctacttgaacggacggtgtatttatttagttggaatgatgggctcagggaagagtacagttgcaaagatattagccgaagttttgggttattcattctttgacagtgataagttggttgaacaagcagttggaatgccttctgttgcccaaatattcaaggagcacagtgaagcgtttttcagagataatgagagtagtgtcttgagggacttgtcctcaatgcgacgattagttgttgcaactggaggtggtgccgttattcggccagttaactggaaatatatgaagaaaggtctatctgtctggctggatgtgcctttggatgcacttgcaaggcgtattgctcaagtgggtactgcctctcgtcctcttctggatcagccatcgagtgatccatacacagcggccttctcaaaactcagcatgcttgcagagcaaagaggcgatgcttatgcaaatgctgatgctcgagtttctcttgaagaaattgcagctaaacaaggccatgacgatgtctccaaactaacaccgaccgatattgctattgaggccttactcaagattgagaatttcgtcaccgagcattccacatcaagtggcccagttggggacttaatagttgattcccagaatcgaaggacaaaggccttgtagtag

SEQ ID NO: 377 - DNA, 1491 bp, Oryza sativa
ctttgctctccagtctccacctcctcctcctcgctgccgcgccgcccatccgccagccatggcgatgtcgtcgtcccgctcggcggccgcgatccgggggcggcgggtcggggcgctggcgagggcgaggaggcacgcgacgagggcgatggcgtcgctgttcggccacgtcgagccggcttccaaggaccccatcctcggcgtcaccgaggccttcctcgccgacccctcccccgacaaagtcaacgtcggcgtcggcgcctaccgggacgacaacggcaagcccgtcgtgctcgagtgcgtgcgcgaggccgagcgccggatcgccggcaacctcaacatggagtaccttccaatgggaggaagtataaagatgattgaagagtcactaaagctggcatatggtgaggattctgatttcatcaaagataagaggattgctgcggtgcaggctctttcaggcacaggtgcatgccggctctttgccgatttccagaggcgtttcttgccaaattcacagatctacatacctacacctacatggtccaatcatcataacatttggagggatgctcaagtacctcaaaggacattcacctattaccatccagagtcaagagggcttgatttcgcaggactgatggatgatattaagaacgctccaaatggttcattctttttgcttcatgcttgtgcccataatcctactggagttgatcctacagaagaacaatggagagagatatcctaccaattcaagataaagaatcatttcccattctttgacatggcataccaaggatttgccagcggtgatccagagagagatgctaaggcaatccgaatcttccttgaagatgggcatcaaattggatgtgctcagtcatatgcaaagaacatgggactgtatgggcaaagggcagggtgcttgagtattctgtgtgaggatgagatgcaagcagtttctgttaagagccaattgcaacagattgcaaggccaatgtacagcaacccacctgttcatggtgcactggttgtctccataatccttaatgatccagaattaaagagtttatggttgaaagaggtcaagggtatggctgatcgaatcattggaatgcggaaggcactccgggaaaatctcgaaggcctaggttcaccattgtcatgggatcacatcaccaatcagattggaatgttctgctacagtgggatgacacctgaacaggtggatcgcttaaccaatgaataccatatttacatgacccgtaatggcagaataagcatggctggtgtaacaacaggaaatgtggcgtatttggctaatgctattcatgaggtcactaaaacgaaatgaagctacttcctcttccctcttcggccaatgaaatgaggcttgcaagcggcggcgttttttttttggggggtggtctattgacctttaagatggttgtactagagaaataatccagtgaacatgctggtgtttct

SEQ ID NO: 378 - DNA, 1900 bp, Oryza sativa
gaagtctgatcgtctgagggtgcatttgtggagaatgtcagagagcaatgtcgacggcatcgaaatatcagctagtaacgatgagaggagggacagaggggacgctgagatttcggaggatgagccaaggcagacgaggatacggtcgttgaagaagaaggcgctgcatgcatctacgaggctgacgcattcgctgaagaagagagggaagaggaaagtgggctgcagagtgccgaagatcacgatagaggatgtcagggacgcggaggaggagcaggctgtcagctcttttcgagaggttttgtttgccagggacatgctgcctgagaggcatgacgattatcacacgatgcttagattcttgaaagctaggaaatttgatgttgaaaaggcagcacatatgtgggctgacatgctgcactggaggaaggatttcgggactgacacaattttggaagattttgaatttcatgagctagaggaggtgctgcagtattatccccatggttatcatggtgttgacaaggaaggaaggcccgtctatatcgagttgcttgggaaagttgaacccagtaagcttgtacaaattacaacagtggaacgctatattaaatatcatgtacaggaatttgagagagcattccgagagaagtttcctgcatgctcaattgctgctaaaaagcatattgatacgacaactacaatactggatgtccacggtgtgggttggaagaactttagcaagatcgcaagggatttggtgcgctgtatgcagaaaatagatggtgattattatcctgagacactacatcaaatgttcattgtaaatgcggggcctggttttaaactgatctggagtactgtgaagggacttcttgaccccaaaacctcgtctaaaatccatgttctaggaacaaaataccaacacagacttcttgaagctattgactcaagccaactaccagagtttcttggtggttcttgcacgtgctctagccagggaggatgcctgcgatccaacaaaggcccctggagtgatcctttaattatgaagcttgtacattgcatggaatcatctgcgttgaaggacattggccaagtatctgatatagaagaagcaattacaggctctgtaagattgcgtgctctcaagttaccagaaagaattagttatacatcaaatgctgaatctggttcagatgttgatgatcttggatctcctataggacaggaagattttgagtatcatagtttggctccagttcatgaggaggccagggagtcaggatcaacatgcagtggttctgatgataaagttgttgagacgaatacaagatacaaccctcctggaaatggatcgggacagtacagcgcaagacaaaatccctcaataaacagagtttcgcctgagccaggtcacgtcccaaatgatggtgaaggaaatgcagatcatgggatcttgaaatatatttctaaaaaagttctcggtgtaattcttgaagtactctcttttttgcgtattttcatccgtcatcgacaacagttggaaaatgtcccccagcatactacaacagtgcacagtaatcaggcagatcttcagataattaaggaagatcgtgtaaatccttgtctagagcgtcttgaaagacttgagacaatgtttaatcagctcagcagaaagcctccagagattccacaggataaggatcgtgctatacaggattcttttgacaggataaagtgcattgaatttgatctggagaagacaaagaaggtattgcatgcaacagtgattagacaaatgcagatggctgagacattggaagctgtaaaggagtccgatcttaggagaagaaaattttgtacataataaacttagcagcaatgtacaggaacaaga

SEQ ID NO: 379 - DNA, 209 bp, Oryza sativa
tggcgatgctgcagctgctgatggcgctggccttctcggcggcgccgctgacgctgtacctgccgccggtgcggagcctcagcctcttcgtcgaggcgatcgaggccgtcttccgcgactgcgcgccgtactcccagggcgccatcttccgcttccgcctcggcctctcccgcatcctctccggcctcgcccgcgccctccgctagtag

SEQ ID NO: 380 - DNA, 1996 bp, Sorghum bicolor
gatatcgagaaggagaagcagcagtagccgcagggccgccaacgcccaacgccatggcggtgggcgcgaccgccacgaagctgcacctctcgtcggcggccgcggccgcgcgccgcccctcgctgctccacctcgcggccgtcgccgtcctctgctcggtgtcctacctcctcggcatctggcaccacggcggcttctccgcgggccccgccgccgccggcggcggcgtctcctcctcggtctccatcgccaccgccgtctcgtgcgccaccccagccctgacgaccgcctcctcgtctccccccgcggggccgctcgacttcgccgcgcaccacacggcggaggggacggaggcggaggccgcgctccgccaccgcagctacgaggcgtgccccgccaagtactccgagtacacgccctgcgaggacgtggagcgctccctgcggttcccgcgcgaccgcctcgtctaccgggagcgccactgccccgcggacggcgagcgcctccggtgcctcgtgccggcgcccaagggctaccgcaacccgttcccgtggccggccagccgcgacgtcgcctggttcgccaacgtgccgcacaaggagctcagcgtcgagaaggcggtgcagaattggatccgcgtcgacggcgacaggttccgcttccccgggggcggcaccatgttccctcgcggcgccggcgcctacatcgacgacatcggcaagcttatccccctccacgacggatccatccgcaccgcccttgacaccggctgcggggtggcgagctggggagcctacttgctgtcacgcaacatccttgccatgtccttcgctccgcgagactcccacgaggcgcaggttcagtttgctctagagcgtggtgtgccggcgatgattggtgtccttgcctccaatcggctcacctatccggcacgttcctttgacatggcgcactgctctcgctgcctcatcccatggcaactttacgatgggctatacttgatagaggttgatcgtatcctaaggcctggaggttattggattttgtctggaccaccaatcaactggaagaaacactggaaggggtgggacaggactaaagaagacctggatgcagagcagaaagccattgagtcagttgccaagagcctctgctggaagaagatcaaggaggagggcgacattgcaatctggcagaagcctactaaccacattcattgcaaggccatccacaaagttatcaagtccccgcccttctgttctaaccaaaacccagatgctgcctggtatgacaagatggaagcgtgtataactccactcccagaggtcagtgacttgaaggaggttgccggcggtgcgttgaagaaatggccggagaggctaactgcagtgccgccccggattgccagtggcagcatcgagggggtcacggaagagatgtttgtggaagatactgagttatggaagaagagagttgggcactacaagtccgtgattgctcaactcggccagaaaggccggtaccgcaacttactggatatgaatgcaaagtttggcggcttcgctgcggcattggtaaatgaccccttgtgggtcatgaacatggtccctactgtggggaactcaacaacccttggggttatatacgagcgtggcctcattgggagctaccaggactggtgtgagggcatgtccacttacccccggacctacgacctcattcatgcagattcagtgttcacactgtacaatggcagatgtgaggcggagaacattctgctcgaaatggacagaattctgaggcctgagggcacggtcatcatcagagatgacgtggatctgttagtgaagataaagagcatcacggacgggatgagatggaatagccagatcgtggatcacgaagatggtccgctcgtccgcgagaagctcctccttgttgtgaagacatactggactctcgatgacaacaaacaatagcaataacgtgggatatc

SEQ ID NO: 381 - DNA, 2153 bp, Sorghum bicolor
cgccgatggcggccacctcgggccacgccgtggtggtcgacatccacgacgaaccagccgccgccgagtcgacggcaaccgcgccgcagctccagccggtgatgctcccgccggtgccctacgtgctccgcttcaccgacctctcctacagcgtcaagaagcgcggcggcgggctggggttgggctgcctcccgacacgccgccccagcaaccgcctcgcgtccttggacgctccgaccaccaccaccaccaccaccaacaccaagactctcctcgacggcatctccggggaagcacgggaaggtgagctgttcgcggtcatgggcgcgagcggttccgggaagtccacgctcgtcgacgccctggcgggtcggatcgcgcgggacagcctgcgcggcggcggcgcgacgctgaacggggagccgctccacgggcggcggctgcgggccatctcggcgtacgtgatgcaggacgacctgctgtacccgatgctgacggtgcgggagacgctgctgttcgcggccgagttccgcctccccagggcgctgccggcggaccggaagcgcgcgcgcgtcgacgcgctcgtcgaccagctcggcctcgcccgcgccgccgacaccatcatcggcgacgagggccaccgcggggtgtcgggcggggagcggcggcgcgtgtcgatcggcacggatatcgtccatgaccccatcgtcctcttcctcgacgagcccacctcggggctggactcggccagcgcgttcatggtggtccaggtgctccgccgcatcgcgcagagtgggagtgttgtcatcatgaccatccaccagcctagtgctcgtatccttggtattcttgaccggcttctcctcctctcgcgtggacgcaccgtgtacgccggcacgccggccggattgaagcccttcttctccgagttcggcacgcctatccccgacaacgagaaccccgccgagttcgccctcgacaccatccgggagtacgagcgcagccccgacggcgccgccccgctcgccgacttcaacgtcaagtggcagcacggcagcagcgcgtcgtccggtgccggcgtggacaaggacaacaacaacaacaagctgatgccgctggagctggcgatcgccgagagcgtgtctcgagggaagctggtggcggggagcggcgggacgggcggcgggagcgcggtgacggtgccgacgttcgcgaacccgccgtggacggaggtgtgggtgctgatcaagcgctccttcaccaacacggggcggatgccggagctcttcgtgatgcggctcggcaccatcatggtgacggggttcatcctggccaccatcttctggcggctggacgacacgcccaagggcgtgcaggagcggctagggttcttcgccatgggcatgtccaccatgttctacgtgtgcgccgacgcgctcccggtgttcgtgcaggagcggcacatctacctgcgcgagacggcgcacaacgcgtaccgccgcatctcgtacgtgcttgccaacgccgtggtcgcgttcccgccgctggtgttcctgtcgctggcgttcgcggtcaccacgttctgggcggtggggctggccggcggcgcgccgtcgttcctcttcttcgtgctcatcatcctggcatccttctgggcgggcagcggcttcgtcacgttcctctcggcggtggtgccgcacgtcatgctgggctacacggtggtcgtcgccatcctcgcctacttcctcctcttctccggcttcttcatcaaccgcgacaggatcccggactactggatttggttccactacctgtcgctggtgaagtacccgtaccaggcggtgctgcagaacgagttcagcgacgcgtcgcgctgcttctcgcgcggcgtgcagatgttcgacggaacgccgatcgggcacatggcggagggcgtcaagctcaaggtgctggaggccatcagcaggacgctggggaccaacatgacggcaaccacctgcgtcaccaccggcgccgacgtgctggcgtcgcaggccgtcacggatattgggaaatggaagtgcttgctggtgaccgtggcgtggggcttcttcttcagggcgctcttctacgtcgtcttgctcgttggaagcaagaacaagaggaagtagtag

SEQ ID NO: 382 - DNA, 837 bp, Sorghum bicolor
tactacttggtgctccgtctccgtctccgtctccgtctcccacgccaccgccgccccggccgccggtaggtaatatcagttccaagggcactcaacatggcggccaatgttggggaatcaacaagcggcagcagcagtggcgctgatgctgggggtagctttgagtgcaacatatgcttcgagctgccacaggagccgatcgtgacgctgtgcgggcacctcttctgctggccgtgcctctacaaatggttgcgcatccactcgcactcccccgagtgcccagtgtgcaaggccatcgtcgaggaggacaagctcgtccccctgtacggccgtggcaaggaccgtgtggacccaaggtcaaagaacgtccccggggcggcagacatccccaaccgtccggctggacagaggcctgccacggctccgcaggtcgaccccaacacccacttccccaacgccaacccgaacccgtggttcatgggcgggggcatcccgctggcgaacgcgcggtgggggaactacaccttctcggcggcattcgggggcctgttcccgctgctcagcttccaggtgcatgggttcccggacgccaccgcctatggccagcctgctgggttcccttacggatatggccacggccatggccatgcgttccatggcgggcatgctggaggacatgcccacgccgccgcagctcctcggcatgggcagcagcagcagcaggcggatgtgtacctcaaggcgctgctcatcctggttggctttctggtgattgcgagcctcatcacgttctaggctttgcctgctggttggttggtgtcatattgctgttgctag

SEQ ID NO: 383 - DNA, 1813 bp, Sorghum bicolor
cccagcctccaaagtcactagatccgcggcgaccatgcggcgcggcggcggccaccggttccccaaaccctccctggcgccctccaccgcggccgaggccaccccagcgctggacgccagcgtcatccgcaacctcgactccgccttctcccgccgcgactccgacgccgccagcctctgcagcagccgccccgcttccgccgccggtgcgggcgtcggcgccgcccccaacttctccgaccgccccacgcaggccgccgcgctccgcgtcgtgaacagattcctcgcccccgacgtcgcgctccgggggcctctgcccgccgcgcgcgacatccaggcggcgctccgcctcctcgtcgaccgtctccacttgccccgcaacgacgccacgttcgaggatgacctcatccaggaccttcgtattctcggctgcccctacaaggtcaatcgctccgcactcaaggcccccggcaccccgcactcgtggccggtggtgctctccgtactccactggctcaccaccctctgctacgcccaaggagacgacctggatgccccattcaacgatctcttgctctacaccacccagagctactcccacttcatgtcggggaacgacgacgccgttgcggcccttgacgaggagtacacctccaaagcccggatgactggtgaggcgtccgttgaaacagttcgtgccctggagaaagaggccgaggaactggagaccgaggtgaataagctcatctccggtccctcgcggcggggagcactggaaacagagaaggaagccttcactgctgatgtttgcaagtttgatgctgtggtgaatacttggaaaaggaagatcaacgaaaaggaacaggcgttggggaatttggagaaagagttggaggccaaagtgttggacacccagcgctctgctgctgaagttcaggatctattgaaacaagtggatgctcagccagtggatgtgaggggtatggatagaatgcgtagggagatgcaggcaattgaaaatgatattgccaacgctgagaaggggaaagcagcactggaggataaggtctgggaagttgaagctaagctggttaccaagcttgacgagcttgagacgcttgctgagcagtgcaaccaggccctcaaaaagttgaaacctactgttccttttcagtacatgataaattcaaaaggatcttctcctgctgagatgctaggtagtggttacaaaacagtactaaaacctgcacttgtggctcgtgctgaggagaacaaaaggatctgtctctcaaatcttgaaagcctaaatgatctaaagaagcagctgcaaggaaatgttaaggttctagaggaggaaaggaataatatttccagcttccaggcaaaaaatgacgaaatggttgctcgtttgaattcactggatcttgaaattataaatgatgactcgagattcacatctgaagctagacaaatgagagatgagttggagaaaaagaagaatagtttgatttctcttgaaaaggaggcagatgatttttttaagatatcggagaagaggctccaagatgcaaaacttaaagctgaagaagatactgaggtggctgctaaggatctgctggagcttcttgattccatggctgaatataaagagtcaatggaaacaacaattgctcagaggaggaaggatctctatgaaactgctgattatatagcaggcctgttcgctggaacttctcagtagcaaaaaacagccattgtgcagtgctagcagagagagcacagctgctgttgctgcaaataagctccggtactt

SEQ ID NO: 384 - DNA, 888 bp, Helianthus annuus
tccattcatcactgcaatcttcaaaaatcaacgatgatcggaccacagaggccacaaattgtgttgttcggttcatcaattgttcagctcagtttcagcaacgacggttggggcgccattctcgctgacgtctacgctcgtaaggcggatatagtgctacgagggtactatggatggaattcccgacgtgctgtcaaggtccttgatcaagtatttccaaaggatgcagctagtcaaccttcactaatcatcgtttactttggtggtaacgattcaatgggacctcactcatctggtctaggcccccatgtcccgcttcctgaatatattgaaaacatgagaaaaattgctactcatctccaggggctttcagacacaacgcgtttaattttcctcacttgcccaccagtggatgaggtcaaacttaatgaaaacaccagctcaatctttagtgaacttgttagaacaaatgagctatgccgggcttattcagatgcatgtgtagagctgtgcaatgagatgggaataaaagttatcgatctttggactgcgtttcagaaacgagataattggttgactttctttacggatggagtgcatttatcaggtgagggtagcaaggtagttgttgaggagatactaaaggtgcttaaagaagcagaatggaaaccgagtctacactggaaatctatgcccaccgagttttcagaagactcaccctatgatttagtctatagcgatggcaaaactaccctaaacccgtctgactggactttccacagagaaatacagtgggagtaataagatagtttcattcgtaactgcagaacacgagcatttgtaagtaatgcaatactttctattgcaacaactgagatttgtaccagt

SEQ ID NO: 385 - DNA, 2084 bp, Helianthus annuus
accacccgtctcctttaatttcttctctctttatatgaacttattcactcactctcatcacatctcaccggaaaacaatgtcactttacaccgtcaaagtcgaggattcaagagcggcagccggagacgtgccgtcggcaggaccggtttataggtgcatttatgccaaggatggtcttatggagttgcctcccggttatgactctccctgggactttttcagcgaatctgcaaaaagaaacccaaagaaccctgcgcttggtcgtcgtcaaatcatcgatggaaaggctggtggctattcatggctatcatatcaagatgcctacaattcttcaatcagaattgcttccgcaatcagaagtcgatctgttaatcctggagatcggtgcggcatatatggaccaaattgtccagaatggatcatttccatggaggcttgtaacagcaatggcataacctatgttcctctatatgatacacttggtgctaatgcagttgaattcatcatcaaccatgcagaaatctcattagtttttgttcaagataacaaaatacctgctattctatcatgtcttccaaattgttcatcaaatctaaaaactattgtgagctttgggaatatctccgaatcacagaagaaagaagccatggaacatggtgttgattgcttctcttgggaagaatttgcttccatgggaaatttggaagatgaactgcccgcaaaacataaaaatgacatatgcacaataatgtatacaagtggcacgaccggagaaccaaagggtgtcatactaagtaatgctgctttcatgtctgaagtcttgtccatgcatcaattacttgtagaaacagacaaaccgggcacagaagaagatacctacttctctttccttccattagcacatatattcgatcagatcatcgagacatattgcatctacagtggggcctcaataggattttggcaagcagatattagatatttgattgaggaccttcttgtattaaaaccaacgatattttgtggtgttcccagagtttatgaccgcatttataccggtataatggctaagattttagctggaggcactgtaaagaaggcgttatttgattttgcatacaactataaattgagaaaccttgaaaagggaatacaacaagacaaatcagctcctctgttggataagctagtgtttgataagattaaacaaggatttggaggacgggttcgtcttatgttatctggagccgcacctttgccaaaacatgtggaagaatttttgagggtgacatgttgtacagtcctttcacaaggatatggtctcacagaaagctgtggtggatgctttacatccatagcaaatgtgtactctatgataggaactgttggtgtacctatgacaaccattgaggcaagactagagtcagttccagagatgggatatgatgcgctcagcagcgtgccacgtggtgaaatttgtctcagaggaaacacattattttcggggtatcataaaagagaggatcttactaaagatgtccttgtcaatggctggttccatacaggtgatattggggaatggcaagcggatggtgcaatgaaaataattgataggaaaaagaatatattcaagttgtcacaaggagaatatgtcgcggtggaaaacattgaaagcgcatattcacggtgccctctggtgaccgcgatttgggtgtacggcaatagttttgaatcttttctcgtagcggttgtggtccctgatcgaatggcaattgaagaatgggcaacaaagaataatgaatcaggagactatatttcattgtgcaagaatccaaatgttagaaaatatgttcttgatgagcttaattctgaagctaagaataacaaacttcgtggatttgagatgctgaaagccgttcatctagagcctgttccattcgactttgagagagatttgataaccccaacatttaaactgaagaggcagcaacttctaaaatactacaaggattgtattgataaactatatgctgaagcaaaggcatctaagaaatgaacgttaaacacgcacctttcatattag

SEQ ID NO: 386 - DNA, 863 bp, Solanum lycopersicum
gggaaatgaaacgtggaagcggattctcgttccacgtcaccgtcgtcatagccgccattgcattcatatacttctcaacggtgttcgtcttcattgatcagtggtttgggctttggtcgtcccctggaatgcttaacgccgtcttcttcaccgtagttgctgttatgtgcatttccaattatgcccttgccatctacaccgatccgggtcaggttcctagctcatttgtacccgacgttgaagaccctgataatattgttcatgagatcaaacgcaagggtggagatttgagatactgccagaagtgctccctttataagcctccacgtgcacatcattgtcgtatatgtaacaaatgtgtactacgaatggatcatcattgcgtgtggatgaataattgtgtgggccatgcgaactacaagatcttcttcatctttgttatgtatgctgttgtttcttgcatatattccctggttttgcttgctggtagcataaccataaactctccaaaggatgaccagcaaagtgaaggctctttcagagttgtatatattatctcagggcttatactagtccctctaagtttggcgctgggctttttcctgtgttggcatttttacctgattttgcaaaacaaaacaacaattgagtaccaagaaggtgttagagcgatgtgcgttgctgaaaagggaggttatgtctattcacatccatatgatcttggtgcatatgagaatttgatagcagttcttggtccaaatgtcctttgctggctgttgccctccacaaaacatatagactctggccttcgttttcggacatcatttgataacgtaccgaggacgcctgtatcaaaatgatga

SEQ ID NO: 387 - DNA, 798 bp, Triticum aestivum
caagtagtggagttcgattcaggggttcagccatggcagctccgagagcactcgtcctcggcgtcctgctgctgatcgccgtctccaacaccgaggcggcgtccgtcgtcgtcggcatggccaagtgcgccgactgcaccaggaagaacatgaaggccgaggaagccttcaagggtcttcaggtggcgatcaagtgcaagagcgtccacggcgactacgagagcaaggcggtgggtgccctcgaccgcaccggcgccttcagcgtgcccctggccgccgacctccacggtgccgactgcgtcgctcagctccacagcgctgcctccaacatgccgtgcctcggccaggagccatccaagatcgcgccggtgtccgagggcaccaccttcggcgttgtcgccggcgccaagaccaacgtgttggcatcgccagagtgtgcgtcggcgaccctgctcgggccgatcaagaagcacatcatcgagcacttccaccacaagaagcccgtgccaccgaagccggagcccaagccccagccccacccagactacggcccggtacccaagcctgagccgaagccgcagccccacccggactaccaccccatccctcccacgcccacctacggcggcggcggcggtggcggtggataccacggacaccactaactccgatctgccaccgtccggcccaacactgaaatttcatcaccgggttcagtgagtgatcgaggtcgttgctttggtcttctgccattcgctgccccgttctagtatctgcactgcagagttgagagttcag

SEQ ID NO: 388 - DNA, 1531 bp, Triticum aestivum
acgagctcatagacccaaggagcggcgccatggtgatctcggtccccagccaccggcgctccatgcgcgacgcaatgctcggcgggggccgccagctccacaagccccttcgctgcgccttctacgacgggattcccggcgaaggcctcgccgccgcgctcgccgaggccactgggagcgtttccctctcccgcacccccgccaccgacggcagcgtaagtgggaaggcagtgaggaacgtgctcatcctcatgagcgacaccggcggcggccaccgcgcctccgccgaggctctccgcgacgccttccgcctcgatttcggcgacgcctaccaggtgttcgtcagggatttggggaaagagtacggcggctggccgctgaacgacatggagcggtcgtacaagttcatgatccgccatgtccggctctggaaggtggccttccatggcacctccccgcgctgggttcacggaatgtacctcaccgccctcgcctacctctacgccaacgaggtggtggccgggatgatgaagtacaagccggacgtgatcatcagcgtgcacccactcatgcagcacatcccgctgtgggtgctcaagtggcagagcctgcagcccaaggtcccgttcttcaccgtcatcaccgacctcaacacctgccacccgacatggttccaccacggcgtgacgaggtgctactgcccctcggccgaggtggtgaagagggccctgacccgcgggctcgacccgtcacaaatccgcgtgtacgggctgccgatcaggccatccttctgccgcgccgtgctcgacaaggatgggctgaggaaagaacttggcctgcaccctgaactgcctgctgttctactgatgggaggcggtgaagggatgggcccggtggaggagacggccaaggccctcggccacgagctctacgatcaccggagacgccggccggtcgggcaggtcgtggtcatatgcggcaggaatcaggcgctgcggtccaccttgctgtccctgccatggaaggtccctgtcaagattagagggttcgagaagcagatggagaagtggatgggcgcttgcgactgcatcatcactaaggctggccctggcacaattgcagaagccttgataagaggacttccaattattctcaacgatttcatacccggacaggaagtagggaatgtgccttacgtggtcgacaacggcgccggtgtgttctgtaaggacgcaggtgaagctgcaagacaagttgcccgatggtttaccacagaaactgacgagctcaggaggtactcccgcaatgcgctgaagctagcgcagcccgaagcagtgttcgacatcgtgagggacatccacaagctccagccgcagcctgccgctctaacccggatcccctactccttgacctcatcgttctcataccatatatgaacccgcggaacctcttgcagaatatactctgcaaagtgaatatgccttcaaacttggctgtgcctgggcttggatgcctgctgaagaacctgtat

SEQ ID NO: 389 - DNA, 1739 bp, Hordeum vulgare
cgtccatggcgactccgccgtcgccgccgccgcccacgcgcgcctcctgcggctcctttctccaggaactgcaggaattatggggagaaataggcccggatgaactagagagagataggatgatcttgcaattggaggaggactgcctcaatgtttacaggaagaaagtggaacaaactagaaagcaaaagacagacctgcttcaagtgatgtccttgggtgaagccgagataggaaagatcctttctgctctaggagagcgtgaatccttttccagggcggagaagctcgggggtacattaatggaacaacttgcaaaactggaaccagttctggacgatctgagacggcggagagacgagcgcataaatgagtttttggctgttcagctgcatattgttcgtctacaagctgagatttcaggaaccattaatcacggggatcctgcagctcctttagtggatgagactgacctatctacaggaagactggctgaactgaaaactcagcttaatgagctccagacagaaaagaatctcagactgcaaaagattgatggtcagatcaagtgtattaatgaaatgtgcaacatgatgtctcttgatcttaagaagacattatatgaagtccatcccagctttgttgaattggaaagaatcaaagccatgagtataagtgatagcacacttgataggcttgcaggaaaagttcatgcactaaaccaagaaaagaaacagaggctccggaagctacaagatcttggaagcacactcattgagttatggagtctaatggacacaccattacatgaacagaaatgctttgatcatgttacttctttgatttcagtctcacccaatacagtgatgccccaaggatgccttgcacatgaccttattgagaaggtagaggttgaggttaagagactgaagcatttgaaagctagtaaaatgaaagagcttgtcttgaagaaaatgactgagcttgaagaaatctacagaagtgttcacatggatattgatagcgatcatgagtggcggattctcaccgaacttattgattctggtagagcagatctctcagagctgcttacggatatggatgaccgaattacagaagcaagagatcttgctctaagcagaaaggacattctagaaaaggtggaaaaatggacattagcaactgaagaggagggttggctcggtgaatatgagggggatcaaaatcgctataatgctggtcgaggagctcacataaatctcaagcgtgcggagaaggcaagggtattggtcagcaaaattccatccctgctggagaatttgactgctaaagttagagcttgggaaaaggagaagggcgcgccatttctgtataataagatgaggcttttggatagcttggacaaatacacctctgaaaggcaacaaaaggaagaggaaaaacgccgatcacgggaacttaagaaactacaagagcagtttgcagcagaacaaggtgcaacctatggagcgaagcctagtcctatgcgcccgctttcggcaaggaaacctcttgggcagagtactaatgtcaacattgttggtggaactcctaacaaccggcgtgtgtctaccccaatttcacgcaagggaggcttgtcttgtggaaagatgaaggacactggcaagacagctgcttctataccggcaaattatgtttctcttcccaaggattgctccgacaattcttgcatgtgatga

SEQ ID NO: 390 - DNA, 1298 bp, Setaria italica
cacccatggcgcggccgcagcgagtgtacgaggcttggaaagggaacaataaattcctctttggtgggaggctcatattcggacctgacgccaagtccctgatcctgtctgtttcgctcatcgtggtcccggtgctggtattctgcgcgtttgttgctcggcatctccgccaccatttctcggcgtacaatgcgggatatgccattcctgcggtagcgttagtgtttatgatctatgtgcttgtgctgctcttgattacttcagcccaggatcctgggattgtgcctcgcgcagcacacccaccggaggaagagttctcgtatgggaatgcattgtctgggggcacgcctgggaggctgcagttcccccgtgtaaaggaagtaatggttaatgggatgcttgtgaaagtgaagtattgcgatacctgcatgatttacaggccccctcggtgttcacactgttcaatatgcaacaattgcgtggagcgctttgatcatcattgcccctgggttggacagtgcattggacagcgcaattaccggtactttttcatgtttgtttcttcctcgactcttctctgcatttatgtatttgcaatgtcagccttgtacatcaagtttctcatggatgagggttatccaacagtatggaaggctttcaaacactctccagcttctttggggcttttgatatattgtttcattgctctctggtttgttggtggacttactggatttcatctgtacctcattagcactaaccagaccacgtacgagaattttcgatacagatcagacagcaggcctaatatctataatcaaggatgcctgaataacttcctagaagtcttctgtagcaagacaaaaccttctaaacacaagttccgagcctatgcacaagaggaagtgcgacctccaacagttagctttggtagggaggtcgaagaggaaccagttggtggtcctcggtcgaaagttgaagatgatcttgaaattggtagcgatcttttgaagatctctcagcggcgaaattatgaggacgttgatgtagaaatgggaggtcgtcgcagcaatgagatggaaggaatggccagtgggaaactagtaataggttcagaatcacatattcctgcagttgggagtgatgtacgggtacgacactcaagctgggatcggcgaagtgggaactgggacatgtcatcagatgtacttacaagaagtgcatcagatgtaattgaacgtagtgtgtttgccaccgaggctgcacatccatctcaagcagaaactcacaagtgatga

SEQ ID NO: 391 - DNA, 1714 bp, Setaria italica
acacacgcccacacctcccccacagcccgcacccctcgccggcggccgcattgcccctgccctgccctgcccccagcccggacggacggaccgagcgatggacgcggcggcggggacggcggcggcgctgccggaggcgtggtcgcaggtgcgcgcgccggtgatcgtaccgctgctgcgcctggccgtggccgtctgcctcaccatgtccgtgctgctcttcctcgagcggatgtacatggccgtcgtcatcgccgtggtgcgcctcctccgcctccgccccgagcgccggtaccgctgcgagccgctccccgaggacgaccccgagctcggctcctccgcgttcccctccgtgctcgtccagatccccatgttcaacgagcgcgaggtgtaccagctgtcgatcggcgcggtgtgcgggctgtcgtggccgtcggaccggctggtggtccaggtgctcgacgactccacggacgaagtgattaaggaaatggtgcggatggagtgcgagcggtgggcgcggaaggggatcaacatcacgtaccagatccgcgacgaccggagggggtacaaggcgggggcgctcaaggccgggatgaagcacgcgtacgtgcgggagtgcgagtacgtggccatcttcgacgccgacttccagcccgacccggacttcctcaagcgcaccatcccctacctcgtgcacaacccggagatcgcactcgtccaggcgcgatggagattcgtgaacgcggacgagtgcctgatgacgaggatgcaggagatgtccctggactaccacttcacggtggagcaggaagtgagctcctccgtctgcgccttcttcggcttcaacggaaccgctggcgtgtggcgcattgccgcagttaatgaggccggagggtggaaggacaggaccacagtggaggacatggaccttgctattcgggcaagcctcaagggttggaagtttgtctacctcggtgatgttcaggtaaaaagtgagctgccgagcaccttcaaggctttccggttccagcagcacaggtggtcgtgcgggcccgcaaacctgttcaggaaaatgctcatggagattgtgacaaataagaaagtgacgatctggaagaagatccatgtcatctacaactttttcttgatacgcaagattattgcacatattattacattttcattctactgcctcatcatcccggcaacgatcttcgtccccgaggtccgcatacctaagtggggctgtgtctacattccctcggccatcacccttctcaattctgttggcactcccaggtcctttcacttgcttttcttctgggtcgcctttgagaatgtcatgtctcttcacagaacaaaagccacattgatcggcttgttagaggctggcagggccaacgaatgggtcgtgacagctaagctcggcagcgctatgaagatgaaatcagctaataaaggaggactcaagaaacagttcatgaggatatgggagaggctgcacattacggagctcggtgtgggaaccttcctcttctcctgcggatggtatgatctcgcgtatgggagggaccatttttacatctacctcttcttccagtccatagctttcttcattatcggttttggctacgttggcacaatcgtcccgcagtcgtaacagaagtgttcagatcatccgcctccggcttctgcattgtcttcagcataa

SEQ ID NO: 392 - DNA, 1715 bp, Setaria italica
agacaatgacagaggagagcgccaagaagagcaagctttcgtggtccaagtccctcgtgaggaagtggttcaacatccggcccaaggcgcaggacttccatgctgattccgacgccggccagggaagggatggaggtggtggatcatggaggcccaggtgctccgcgagcgaagcaagtgcaagcacggccaagaaaagcagaactgaccggtcatcatccaagcggagtgccgaacgcgctcgccgagggaagaataatttcgatgtagcacgcctgactgaagtccaagattacaggatctttgctgcgacgtggaatgtcggtggtaagtcaccaccaagggggctgaatttagatgaatggctccatacctctcctcctgccgatatctatgtactagggtttcaggagattgttcccttgaatgctggaaacgttcttggcactgaagataaccttccagccaagaaatgggtgtcccttatcaggcgtacactgaacaagaatcctggagctagtggttgtggtggctatcataccccttcaccggtcctggatccagttgtagaattagatgctgattttgaggggtctgcgagaaggcaggagaattttcctttcttccaccggcggtcgttccacaacctcagccgtagtttaagaatggatggggactacatgttcccacagccaagactggatcgcaggtttagcgtttgcgatccagtcaacttgggaggcagacctagcgattttgatggaaatttgagatgccctggatcacctgatgaggagattatagatatggaagtgagcgatgctgcgcaattttcaccattccctcatagctacactgcatctgcaccttctgaacagaatgatgagcaatcaaacagctctaggtattgcttagttgccagcaaacaaatggttggcatatttctcacagtttgggtacgcaatgaaataagagacgatgtgagaaacttgaaagtttcttgtgtcggcagaggattgatgggctatcttgggaataagggttcaatttcaataagcatgtctttgcaccagacaagcttctgcttcatctgttgtcatttgacctcaggggaaaaggaaggtgatgaactgcgcaggaattccgatgttctggaaattttaaggaagaccagattccctcgggttcgtggttctggtgatgttaagtcacctgaaacaattcttgagcatgatcgtattatatggcttggggatttgaattatcggattgccctgtcgtactgttcggcaaaagctcttgtggaaatgcataactggaagcaattattggagaaagatcagctccgcatgcaacaaaggtatggacgagttttccaaggttggaaagaaggaaggatatattttcctcccacatacaaatattcattcaactcagatcggtatgctggagagggtatgcaccccaaagaaaagaggagaacaccagcatggtgtgatcggattctctggtatggtaacggcctcaatcagctgtcttatgttcgtggagaatctcgtttctccgaccataggccggtgtacagtattttcttggcagaggttgacattgtacaccagaggaggagaaacatgggctatttcagttctagaattgaggtggaagagctcttgccgcattctcagagctacagagaaataaagttttactgatga

SEQ ID NO: 393 - DNA, 1475 bp, Setaria italica
cacccatggcgaccgccgcggcagggagcaagaggggcggcggccggggccgcaaggcgctcgtggccgtgctcgacaacgacgccaacatctccgccgggaaggccgccaaggccggggacctctcggcctcctccgcgccgaaggcgaagcgggcgcccgccaggagcggcaaggccgccaaggccgcggcggctgcggcctccgtagtggacgacgtggcggagctccaggggatgctggagcggctgcggctggagaaggagaaagcggaggagatggtgagggagcgggacgaggtcatccggaagaaggaggaggagatcgagaccaaggagaaggagcaggagcgcctccaggccgagctcaggaaggtgcagcgcgccaaggagttcaagcccaccgtgagctttcctctcgtcaagtcgctgcttgagaaggagcaggacgcaggcgacaagggcaagaggaagaaggggaagggcaaggccgtcccggagaggaagaagccctgcacggcgtacgtgctctggttgaaggaccagtggaccgagatcaagaaggagaaccctgaggccgacttcaaggaggtgaccaacacgctgggcgccaagtggaaggcgctgggcgccgaggagaagcagccctacgaggagcggtaccggcaggagaaggaggcctacctccaggtggtcggccaggagaagcgcgaggctgaggccatgaagctgctcgaggagcagcagatgcagtggaccgccaaggagctgctggagcagtacctcaagttcaggcaggaggccgaggagggcgacggcaagaaggggaagaggaagaacagcaagaaggtcaaggaccccgccaagcccaagcagcccatgtcggcctacttcgtgtacacgcaggagaggcgcgccgcactggtcgctgagaagaagaacgttcctgagattggcaagatcactggggaggagtggaagaacatgacagaagcccagaaggctccctacgaggaagttgcgaagaagcagaaggaggagtaccacaagcagatgggggtttacaagaagaagaagattgaggaagctgcgagcctggagaaagaagaggaggagcagaagaaaatcatgaagcaagaggctctccagctgcttaagaaaaaggagaaggcagacaacatcatcaagaaaaccaaagaaaagcgccagaagaagaagcaggagaatgttgatcccagcaggcccaagaagcctgcctcttccttcctcctcttcagcaaggaagcgaggaagcagctactcgaggagcgcccgggcatcaacaactcgaccctgaatgcacttatctcggtgaagtggaaggagctgagcggtgaggagcggcaggcgtggaatgataaggccgcacctgccatggcggcatacaagaaggagatggaggagtacaccaaggctcacagctcgtccgcttgataa

SEQ ID NO: 394 - DNA, 2345 bp, Setaria italica
cggagatggacacgcccgaccgtgccgccgcgcagcccgcggcctcgcgcgccgaggactcgccagttttcagcttcatcaacaacctgtctccgattgagcctctcaagtcggcctacaacgccaatagcctccagggataccagtccatcaacataacctccatttcctccatcttcacttccccgcatgacaatgcgcacaaggaaccaaggctcccgaagagctctcttggtgaaatttcggaaagtgaggtctgtgctgacggcaagaatacaaacaagccaactaagtcttcaaatgctgtcaggttgtttgcctgcactagcactgtcactcaagaaacccacacggttacatgttcagatgtggttgatcctcccaccgtgccatgcaatttggctcagcctgctcagttcgataacggcagtccagatcataacaccactccctgccatggtgtcagatcagaccttaagcaggacaaatgccggaaactagatgttgtccaaaccgttaaaagtacagtggagaaaaggaaatgcttgttttccactgaaatccagctcctggatggtggccagcctgtgaatgacaacaatgaagtcttgggatgtgaatggtcggacttaatcgccacaacctcgggtgagcttttggcctttgactccactatggatgaccatcacagaggaatgcacctggcggctaaaaatgcggaatcttgtggatacttgctgtcaaaacttgcaggagatggtgaaatttcagagagagcatatcctaatgcatctggtcaagtatactatcaagaactcgtgatgggagaagaccagacagaaaatgcccaaatatttcaggatggccaacaaacaatctcgactgaagaaattcaggataatatttatgaagcaaatggatgtattccattagactacaaggtggagagccaacaacaacgtggcgtacgaagacgctgcctggtattcgaggcagctgggttttcaaatagtgttgtgcagaaagagagtgttgaggatctctctgtctcaacatgtaaaggcaaaggccatgtgcaaactcagccccgtggattgcgcggtataggtctacatttaaatgcccttgcattaacaccaaaagggaaaatggcctgtcaggatcctatggcttctgctttgcttccgtcatcagcatctgaaaaggatgcacatggcaaattgctctgtgcaggagagaattttacacactcaggtggtgaactgttagaatttcccatggatgattgttcatctggaggttttcctttaaatgatcatgtttcaagtcaaagtgtcagccctcaaaagaagagacgtaaaacagataatggtgatgatggtgaggcatgcaagcgatgcagctgtaagaagtcaaagtgcctgaaactttattgtgagtgctttgctgctggtgtatactgctctgaaccttgttcatgtcaaggatgtctgaacaaacccatacatgaggaaattgttctctccactcggaagcagatagagtttcgtaatccactagcatttgctccaaaagtgattcgtatgtctgatgctagtctggaaactggggaagatccgaacaatactccagcttcagctcgtcacaagagaggatgcaattgcaagaagtcaagctgtcttaagaaatactgtgaatgttatcagggaggtgttggatgctccagcaactgcagatgtgagagttgcaaaaacacttttggcagaagagatgctgagactgaactcactgaagaaatgaaacaagaaggtgaacaaacagaaaacagtggaaaagaaaaggagaatgatcaacaaaaagcaaatgtacagagtgaagatcatcctctcgttgagcttgtcccgataacacctccttttgatctttccagttctctgctcaaactgccaaatttctcaagtgcaaagccaccaagaccttccaaagctcgcagtggaagctcccgttcgtctgcttcaaaagctaccacaacattgcagtcttgtaaatcatccaaggctgcaggtagtggtatcgatgaggagatgccggatattctaaaagaagctgattctcctagccgtgtcaagactacttcacccaacagaaaacgagtctcgccaccgcataatgcactcagtatttccccgaaccggaaaggtggcaggaagttaatattgaagtcaatcccctcatttccatcacttacgggagactcaaacagtggttctgcaatgaacaacaccgataacacattcagtgcatcgcctctcgctttaggaccatcttaaagctgtgaagtctaa

SEQ ID NO: 395 - DNA, 2706 bp, Setaria italica
tcataagatgctgtcaagctgccgtcgaccagcgacctcgctgctgctgctgctgcgctagttcacctcgccgtgatggcgcccaaccaccggctccccctccgcctcgccgtggttctccttcttctcctgcttctccccgcggcctcccgcgccagggacaccatctcgccgggccagccgctccggggcaacgacaccctcgtctcctcgggcaccggcaccttcgcgctcggcttcttctccccgccgggctccaacaacacctacgtcggcgtctggtacgccaagctgcccgtccgcaccgtcgtctgggtcgccaaccgcgccgaccctgtccccggcgcggtgtcgcacaacgccgatgccacgctctccgtgtccgccggctgcgcgctcgccgttgcggacgccaacggcaccgcggtgtggtcgtcgccggccccgccgcccgacacggcggggaggccgtgcacggcgcggatccgcgacgacggcaacctggtggtgtcggacgggcgcgggcgcgtggcgtggcagggattcgaccaccccaccgacacgctcctcccggggatgcgactcggagtggacttcgcggcggggaagaacatgaccctgacggcgtgggtgagcccctccgacccgtcgccgggccccgtcgtggcggcgatggacacgtcgggggacccggaggtgttcgtctggaacgggcccgccaaggtgtggcgctccggcccctgggacggcgtgcagttcacgggcgtccccgacaccatcacctacaagcccctgggcttcagcttccgcttcgtcaacaccccccaggaggtcacctacagcttccaggtccgcgacgccagcatcgtgacgcggctggcgctcaacggcacgggcggcgccgccgggctgatgcagcggtggacgtggctggagaccgccggcgcgtggagcctctactggtacgcgcccaaggaccagtgcgacgccgtgtcgccgtgcgggcccaacggggtgtgcgacaccagcagcgtgcccccctgccggtgcctccaagggttcgcgccacggtcgccggtgacgtgggcgctccgggacgggcgggacgggtgcgcccgggcgacgccgctggactgcggcaaccgcaccgacggcttcgcggtgctcccgcacgccaaggtgcccgacacgacggaggcggtggtggactacgggtccagcctggagcagtgccggcagcggtgcctgaggaactgctcctgcacggcgtacgccagcgccaacctcaccggcgggccgggccgccgcgggtgcgtcatgtggaccggcgggctcgacgacctccgcgtgtacccgggctacggccaggacctctacttccggctcgccgccgccgacctcgctccaacaagcaagtcaaagaagaaggtcaatattgtgattgcagttgttgtcagcataactgcactgacaattcttctagcagtcgcagggtttttcatttggaaagcaaagaaaaccaaagcaagaaaaccaggatcaagcacatggagagctggtccacgcagtaaggaggggagtgaaggaaaggatcatggggatgatctggagctgccagtatacgattatgagacaatagcaaaagccacagaggatttctcaactgagaacaagcttggtgaaggcggtttcgggcctgtatacaagggcaagcttgaggatggacaagaaatagctgttaagacactttcaagaacatcaacacagggtcttgaggaattcaagaatgaaattttgttgatagctaaactccagcatcggaatcttgttcgattgattgggtgcagcatttctggacccgaaaagatacttatatatgaatacatggaaaacaaaagcttggactgctttctgtttgacacaaccaagagcaaactacttgactggcaaacacgatatcatataattgaggggatcgcccgaggtttactgtatcttcaccaggactcgagatatagaatcatccacagagacctcaagacgagcaatattcttctggatgaggagatgactcctaaaatttcagacttcggcatggctagaatgtttggcaatgacgatacagaaatcaatactctcagagtagttggtacatatggttatatggctcctgagtacgcaatggatggagtgttctcggtgaaatcagatgtatttagctttggtgtcatagtgctggaaatcattactggtataaggaaccgaggtgtctacagctactctggccacctcaaccttctagcacatgcctggagcttgctgaatgaggggaagggcctagatttagtcgatgaaaatctggatggctccttcgattcagatgaagtgcttaaatgcctcaaagtagggcttctatgtgtgcaagagaaccccgacgaccgtcccctgatgtcccaggtgctgatgatgttggccagcactgacactgcctcgttgccaactcccaagcagccgggcttcgctgcaagaacagctgctgccgaagacaggtcgtggagcaagcccgactgcagcattgtcgacagcatgaccatcaccatggttgagggtcggtaggaggctgggtctcctacttatcatagcacgagatgagatgtatatcttagagtactagagtggcattggttcctttgctatcttgttcgg

SEQ ID NO: 396 - DNA, 1502 bp, Setaria italica
actcgatgggcgagaggaggcggcgcgggagcgccacagctgctgctgctcccggagctgctgctgctgctgcgcgggctgaggaggagaaggccgcgtcggcggcggcggcggggaaggctccgccgccgacggtgtggttcgcgctgaagcggtcgctacactgccgctccgagccatcggatgtccacgtgccgcgggccaaggccggtcccgccgcggtcggcggcggcggcgggaacctgtcgtcgatcgtgaccaagcgcgcggccccgcggtcgggctgctcgcgctccatcgccaacctgcgggacgtcatccacgggagcaagcgccacccggggcagccgccaagctgcagcccgcggtccatcggcagcagcgagttcctcaaccccatcgcgcacgaggtcgtgctcagcaccaactcccgctgcgagctcaagatcaccggcttcggcggatgcggggggctcggcgccgtcgggaccgccgccgcgcacgacgccgacggcggcgggggatctgacggcggcgtcgtgtcgtccttcgtcggcacgctccgccccggcacgccgggacccgcgtgggccggccacggactgccgtacagcggctccatgcggggcggcgtgcgctgcacgccgccgaggtccccgaacgtgctgctggagcggaacggctccctggcggtcggccaccgcgcgtcctgcgaggacaccgccaaggccggcgccggcaagggctccggcgggctcagctgccaccggtgcggcgagcacttcggcaagtgggaggccctggaggcgcaccacctctccaagcatgcagtgacggagctggtggaaggcgactcgtcgcggaagatcgtggagatcatctgccggacgagcctgctcaagtcggagagcagctgcgtgcggatcgagcgggtgttcaaggtgcacaacacgcagcggacgctgtcccgcttcgaggagtaccgcgaggccgtgaagctcaaggccagcaagctgcccaagaagcacccgcgctgcctcgccgacggcaacgagctgctgcgcttccacggcgccacgctctcgtgcgcgctcggcgccggctccggcgcctccagcagcctctgcgcctccgacaggtgcgccgtgtgccgcatcatccggcacggcttctccgccaggaaggaaggcaaggccggcgtgggcgtgttcaccacctccaccagcggccgcgcgttcgagtccatcgaggcgccgccccccgcctcctgcggcgacgacggggcggacccggccgccgcgccgcgcaaggcgctgctggtgtgcagggtcatcgcggggcgggtgcacaagccactggagaacctgagggagttcgcggggcagacgggcttcgactcgctcgccggcaaggtcgggccctactccaacatcgaggagctgtacctgctgaacccgagggcgctgctcccgtgcttcgtggtcatctgcaaaccgtagtaa

SEQ ID NO: 397 - DNA, 3519 bp, Setaria italica
gcaacacggagaggttgagggagatgcaacacgacatggcggaggtggacggggacgccccgatcccggcgttcgcggtgtccaagggcggcgtcgtgctcaagcacatcttcctcaacgcgcccccttcgtcgccggatcgcggcggggcggtgggtggcggggaggagcaggaggaggaggacccgccggtgacggtggggcggcaccccgactgccacgtgctcgtcgaccaccccagcgtcagccgcttccacctccagctccgggcccgccgccgccagcgccgaatcaccgtcaccgacctccgctccgtgcacgggacatgggtgtccgggcggcggatcccaccccacacgccggtggatctggtcaacggtgacacgctgcggctcggggcctcgaagagggagtacaggctgctctggctgtcgctgcgcgaggcgcttgagatggaggatgcgccgtacatgccgccgctgcctgaggacaaagaggagccacatgcttatcaggaggccagcagccagttggtggttcctgagcagagggagtcagcagacatggaggcccatcaggagacaagttcaagaaaaaagatacaggagacaagtcaacaaatcatattagaagatattgattttccagccaaagtgatcccctcagcaccaccattacctgactttgctcattccttttctgtggaaaaatcccatgagaacattgagggagtgacagaggatatgttagtcgacaagaatccaatttcagaatcttttggctctttgatcatacaggaaatgccagctgcattgacaaatgctggaagaccagccctgtcagacaagcgggatacatcaaaccaagtgtccaagagatccaagttaaagtcagtcaaatcacttcgtattgacactggcaggagcaaggatagaagcagtgcactgaactacagctctcagaaaggagaccaaaatgagattcttgtatgttctcagagctgtggggtggagtgcgctgcctgcatagctttgtttggtatttctgaatttgaaagagctgaagaaaaggaagagatgattgcagaagataagggccatatgcatcccccagccagcattaccatggagggagataagaaagagccaaacactgagaattatggcccacaagattcagttgattcaaagttacagaagaggataggcttgtttgattctgctctccctttgtttggtatttctgaatttgaaatagctgaagaaaaggaagagatgattgcagaacataagggccatatgcatcccccagccagcattaccatggagggaaataagaaagagccaaacactgagaattatggcactcaagattcaattggttcaaagttacagaagaggataggcttgtttgattctgctttccctttgcatttcaaagatgatgccttcacagacaaagaaattccacagtggagttctgctactgttaatacagaatctgatcctgtttcagaaaatcttgcaacaccagaactgaagcatgatgacttggtccatcttaacttggaggaaagtttctcaaataaggagaacatggccccaaataagattgttgagggtcctgagaactatcagcttgacagcacagtttgtgggaatttatttgacaatttggatactgaagaaatcgaaggaaatgaagagatctgtccactggacaaggagaatattacccccagtctatcaggtagcataattatggagaggagccatataggtctgaaacctatcatttcccaagagttgatggattccatttcccctctgaatttagctcatgacaacttttcggaaaatgaaaagtccattctgaacactggaaatcagatgaaatcaaatgaacctatctctgagaatcttagtccgctaactccagctgataaaaaattgcagaagagccagatagagtgtatgcccatttcacatctggaattcaaagatgacatccttctggatagggaaaactcagtgctggcacctggaaagtatgatgccatctcccctgagaggcaggaaaatctgtcctcagacaaagagaacgtgactcctgcttctaaggtaaagcccactgttaggagagttcttggttcaaggatggataattcagtgtcagcaaagaagacttcaaataaggagaaatgcattgtgttgtcagcaaagtccgaaaaaatccacacaatagattatgatgttttctattcagataaggagaatttgacccctgtgtcttcaggaggcatgaaagcaaggaagtgtcttcccaagaatctcatagttgatgcagatcaagaccaggaagcattctgctctgacaaggagaacatgacaccacaatcttctgcagctcggaaaacaagggatatgtctgaaaaccgtgcacgagtagaaagtgcaatcacaaagaaaagggttgctgataggctccccttccagacccttctttcgaattctcctttggggccggctagctcgcttgattgtaactgtgttgttcctaggacagctgacatcgctgctggtgacttggcgatcaagttggaagataaacttaacaatcttgcacttcataagcaagaatcaggtagggctggacaacggatgaaatcctggaccatggtggctaacaccgacagccttcttgatgatgaatctaggaagtctattatgctgttaaaaggcataaaaggaactcacctgttcgtaccaaggattgtaatcagggagctagattccatgaagcagcgggagggcctgttcagacggtccacaaaggcgacctcggtactccaatggattgaggagtgcatggcgaccgagagctggtggatccacgtccagagctcatctgaaatgctcccagtcgcgccaaccccgcctgccaccccttcagcgcagcgcatcgacgaagaaatcaaggtcggttcagctggctccttcaacccaatggcagccttgttctccccgagaggcttcgagctcgcggacatagtctccccgaaacctgaggaccgcgtcctcgactgcgcgctactgttgaacaagctcaggagcgaccacaacgtcgtggtcctgaccgacagcgtggcgctcaagatcaaagccatggcagagggcatggtttgcgagggggcgagggagttccgcgagtccctgatgaacccttgctcgagccggttcatgtgggcggctagcgcgccgcgggggccggcctggtcgcgcctggacgcggcggcgctggcggaggactactacaacagccaccaccaccagcacggtgctcggaagcagcagcagcagcagaggaagcccgccgaggccgccgccaagggcctgaagctgatcctgcgtcacaattcgctgtacgcgcaggcgacgacggacgcggccaggatgacaccgctgccgctggtctccttggcctcggtgtgagtgtgagactgagtgctgtcgatcagtt

SEQ ID NO: 398 - DNA, 656 bp, Setaria italica
taaatatggcgggaaagtttggcgccacctgttcccgcgccgccgcctccctatttagcccgcgccaccgccgcctcctcttcccctcaactccaactcctcccagatttctccccttctcccaccgattgctcccgagaaccctctcgaccatcgccatgaccgctcccaacggcgccgccgacaccgacgccgtccacgagcctccccagaagatctccaagatcgcgcccctgctcaaggtgaagaagctctccgacaaggccgtcctgccgtcccgcggctccgccctcgccgccggctacgacctctcgagcgccgcggagatggtggtgccggcgcgggggaaggcgctggtgcccaccgacctcagcatcgccatcccggaaggcacctacgcgcgcgtcgcgccgaggtcgggcctggcgctgaagcactccatcgacgtgggcgccggcgtgatcgacgccgactaccgcggccccgtcggggtcatcctcttcaaccactcggatgtggacttcgccgtcaagcccggggaccggatcgcgcagatgatcatcgaggtgatagcgacgccggaagtcgcagaggtggaggacctcgatgccaccgtgcgtggcgagggagggtttggatccaccggcgtctgataa

SEQ ID NO: 399 - DNA, 1050 bp, Zea mays
tgcagaagaggttaaagggttgccgtgcggactccggagctgtgagaatctaccccgaggtaagctcttagagtcgtagtcaaagaggagaagccaggccgggaacaaacagaaaagagaagagcaacaggagtacaggactcagtgcaccaagaataggaaagagcaaagaccataacagttgaacttcaagatgcttgaagtgaggactgcaagaaggccggctctcgccgacatctctggtggtgggttctttatgaggacagtagaatcgccaggagctgtgctggtgaatggtgctgtcaagcggccggctcggcagtttctatcaccttcaagcaacaaggagaatgtgccaccagtgggagctttcagggctacaccaaagaggaggacccccttgcctgactggtacccgaggacaccactccgtgacatcacatcaatcgtcaaggcaattgagaggaggagaagtcgtctgcagaatgctgcagctcagcagcagatccagtggacagaagacccttcccgatctgtggatccaataactccagtacaggcagagcagggtggtgtgccaacaactgtggatggtcaaggtgttggaagccctgcaacctgtttggaggatggcaagctgaagacatcgtcctatccatcatctgactgctccttgcaggccactccatccaaaccaaacgatccagctctcgcagatctcgtggagaagaagctgtccagctcgatagagcagatcgagaagatggtgcggcgaaacctgaagagaacttcgaaggccgctcagccttccaagaggaccatccagaggcgcgtcctgatgtccatgcgatgagctgagaaagctatctgctctgccatggcttcccttgtctgctgctttcttagcagcaagtcgtaaccaaccattacgccagttttgcctgaaggaggggtggggccgtgggggctcctggttctctgcttgaggaccccggggtatgcggcttactactagctctctgcttgagggtacacattatggtgactgcg

SEQ ID NO: 400 - DNA, 1264 bp, Zea mays
actgtagcaataattggtcgctccccgatccatctgggtttcgcctgccagcggcgagatgtccttcttcttccgggccgcatcgcggcagcgcccgttgccgcaggagatcgcgcgctccatcaaggactccctcgttgccctcgacaccaagaccggcgccaaggctcttgaggatgctgagaaaaacatacttacattgaggcatacacttgctggtgatggagaagtggaaccaaatcaagagcaggttttgcagatagcccttgagatttgcaaggagggtgttctttccctctttgttcagaatcttccttcattgggttgggaggctagaaaggatcttgtccactgctggtgtattttgttgagacagaaggttgatgaaagctattgttgcgtccagtatattgaaaatcattttgatcttttggatttccttgttgtttgctataagaacttggaagtcgcgttgaattgtggaaacatgttgcgagaatgcataaaatatcctacacttgcaaaatatatattggagtcaagcagcttcgagttgtttttccagtatgttgaattgtcaaacttcgatattgcatctgatgctctgaacactttcaaggatttgctaaccaaacatgaagatgccgtctctgaatttctgagctcacattatgagcagttttttggactctacacaaaacttttatcttcaactaattatgtgacacgaagacaatcagtgaagtttctttcagagtttctgttggaggccccaaatgctcaaataatgaagcgttacattttggaagttcattacttaaacattatgatgggcctgctaaaggattcaagcaaaaatatcaggatatgtgccttccacatttttaaggtatttgttgccaatccaaacaagcctcgtgagattattcaggttttggttgagaatcacagagaagtgttgaagctactccacaatctccccacaagcaaaggtgaagatgaacagcttgatgaggagagagatttaattatcaaagaaatcgagaagcttgtgcggttgtcagtataaaccctcaggaaattcgaacgtatccttgaagacatactgtgcaatatgctgccttgtatagagcttgtttttcatgtatggaaaaaaaagtttggccacaaattgcatttttcgcgagaacacttagcatttctgtcagaaaattattgtcgtgtagcagaatttgcaacaggaataatctgcattatggtgtgg

SEQ ID NO: 401 - DNA, 1956 bp, Oryza sativa
gtgaggcagagtgaccacagcgacggctgcgtagccatggcgaccaggccgggccctttgaccgaatggccgtggcataggctggggaacttcaagtacgtggtgatggcccccgtggtggcgcacggcgcgcgccgggtgatgcgcaacgggtggggcgacctcgacatcgccttctccctcatcctgccgtcgctgctgctgcggatgatccacaaccagatctggatcagcctctcccgctaccagaccgcccgcagcaagcaccgcatcgtcgaccgcggcatcgagttcgaccaggtcgaccgcgagcgaggctgggatgaccagatcctgttcaatgggttggtgttctacgcggggtacctggcgatgccgagcgtgaggcggatgccggtgtggaggacggacggcgccgtggtgacggcgctggtgcacacgggccccgtcgagttcctctactactggtttcaccgcgcgctgcaccaccacttcctctactcccgctaccactcccaccaccacgcctccatcgtcaccgagcccatcacctctgttattcatccttttgctgaacatgtggtctatttcatactgtttgcaatccccatactgtcaacaatttatttgggaaatgtttcggccatgggcattgtggggtacattgcttacattgacttcatgaacaacatgggacactgcaattttgagttggtgccagagtggattttccaaatctttccaccccttaagtatctgatctacaccccatcgttccattctcttcatcatacgcagttccgcacaaactactcgctattcatgccattttatgactacatatataacaccatggacaagtcatctgacgagctgtatgaaagctcactgaaaggaacggaagaaacacctgaccttgttcatctcacgcatatgaccaacttgcaatcagcctatcatctaaggataggaattgcatccatagcctccaaaccgtacagtgactctgcgtggtacatgtggacgttatggcccttggcatggctgtcaatggtacttgcatggatttatgggtcctcagcatttgtcgttgagagaattaaactaaacaagatgaagatgcaaacatgggcaataccaagatacaacttccaatatggccttacgtgggagagagaaccaatcaacgacttaattgaaaaggcaatattggatgctgatatgaaaggggttaaagtgattagtctaggactactgaatcaggcaaaacagctcaatggaaacggtgaactatttagacagaagtatccaaaattaggagttcgaattgtcgacggaagtggcttagctactgcagtggtgctaaaaagtattccttcagatgcaaagaaagtttttcttcgtacaggcacttctaagatagctcgtgccattgccattgcactatgtgacagaggtgtccaggtgatcatgaatgaaaaggaggtataccacatgctcaagtcacaaataccagagaacagggcaagctatttgaaactctcgagcgacaacgtacctcagctttggatagtacacaatattgacgacaacgagcaaaagatggcgccaaaaggaacaatttttattcccatatcacagttcccccttaagaaacttcgcaaggactgcacttacatgagcaccccagcaatgaggatcccggaggaaatgaagaatatccactcctgcgagaattggcttccaagaagggtgatgagtgcttggcacattgctggaatacttcatgctctggaaggatggaacatgcacgagtgtggggatgagatgatggatattgagaaatcatggtcagctgccattcggcatggattccttcctctcactaaagcttgacacctctggaagcatggatggtgtattccatgctagtagatgatgctatgatttccagca

SEQ ID NO: 402 - DNA, 2862 bp, Oryza sativa
cacgaagaagaaggagaagctgcgatttctcaggtcgctcgattccctatgcatctctccctatggaagcccctgtcccactgcgccgccgtcctcctcgccaagaaccaccgccgccgcggcggcggcggcggaagcaatggccaccgcggtgacgacccggcgtcgttcctccgccagctgcgcgacgcgctcgacgccgcgtcggaggatggctcgctgtgcccgcccccggacgccgcgggcgcgggcgcggacgccgacgcggacgccgccgtgtcgcgctcccgctcgctcgcgcggctccgggcgcagcgcgacttcctccgcgccaccgcgctcgccgcggcgggcggcccgttccgctcgccctccgacatcccgctcctccccgccgccatcgccgggttcctcgccatgtacccggactacgccaccacgtccgacgtcgaccgcctccgcgtcgagcactactcccacctcgacgccgccgcccccggcggcggcgcgggcggcagggtctgcctcgactactgtggtttcggcctcttcgactccggctgggactcctcctcctcgtccttcacattgtccgagctcaatgccaacctcagcaaccacgcgctctacggcggcgccgaggccggcacggtggagaacgacatcaaggagaggatcctcgagtacctgaacgtgccggcgagcgagtacgcgctggtgttcaccgtgagccggggctcggcgttccggctcctcgccgagtgctacccgttcgagaccaaccggaggctgctcaccatgttcgaccacgagagccagtccgtgagctggatggcgcagagcgcgcgggcgaagggtgccaagacgcgcaccgcgtggttccggtggccgacattgaagctctgctcgacggagctgaggaaggagatcgtcggtaagaggagagggcggcgacgggattctgcggttgggttgtttgtgttccctgcacaatctcgggtgaccggcgccaagtactcctaccagtggatggcgctggcgcagcagaatggctggcatgtgatgcttgatgcaggcgcactgggccccaaggacatggattctctggggctctcgctgttcaggccggatttcatcataacctcgttctaccgggttttcggtgcagacccaactgggtttggttgccttctgattaagaaatcagttattgggagcttgcaggggaggaatgggtgtaatgcttctgggatggtgaggattgttccagtgtttccgcaatatctaagtgattctgttgatggatttgatgcaatggatggtctcgaagatgattctggtgtccacaaagatgagaagccagcgtctgatgcccgtaatggttcgcagctgccagcattttcaggtgtgtacacatctgctcaggtcagagaggcatttgagagtgatcctggccgtgacagcagctcggacagggatggggcgagcaccatttttgaagaaactgagagcatctcagttggtgaggtcatgaggagcccggctttcagtgaagattgctcttcagagaattctttctgggttgatgttggccaaagcccattggggtcggagaagggtggtcatttcaagaaagggaaacttggatccccattaccatcttcttggttcgctggcagaaagagtaacaagaggatgtcaccgaacctaacatccaggatatcaagaagccctctttatgatggtcaggtgatatcttttgatgcagctgtattatcagtttcacatgacgcggactgcctcaaggaagaccctgaagaagaaatctatgagaatggtcggcggaatcacttcaggcaagttagtgaaattcaagaggagccagaggttgaagaagttgtatgtcaacatgctatgaatggcggtggggatcacaaagaaagtgcgataagaagggagactgaaggggaatttcggcttttgggagggagggatggaaacagcagatttgctgggggtcggctcttcggtgttgaagagattgatgcaggtttaagcatgggccgtagggtttcattcagcactgaagcaaatattattgcggatagactacaccgggcctcagatgctgctgaagcttctggatatgcattccgtgatgatgatggttgtgtaagtgatgggtatgatgatgctcaggactggggcaggagagagccggagataatatgcaggcacattgatcatgttgatatgatggggcttaacagaactactcttagattaagatacctgatcaattggctagtaacttcactgttgcagctgaggttaccaggctcaaaaggtggtgatggagacccccttgtccacatttatggcccaaagattaagtacgaaaggggagctgctgttgctttcaatgtgaagcaaagtgatggcacttttgttaatgctgaagttgtccagaagattgcggagaagaatggcatatctcttggcattggttttctcagtcatataaaggtggacctgaaccacaaacagttaaatggagcattcgatatacctgaggcttccttctataagaacggccgcaaagacagtaaaaaggtgaccataagagttgaagttgtgactgcttcccttggcttccttactaattttgaagacgtgtacaatatgtgggcatttgtcgccaagtttctggatccttcatttctagaaagtgagcgcctcaccattgctgctgaccactcagagggacaaacttgagctttatctgtaatttgcattcagcaaaggagaggaaggtgatttttctcctttatgccttggaggagtatttggtagtggatttag

SEQ ID NO: 403 - DNA, 1429 bp, Sorghum bicolor
tcgacgttcactgtaactaatcgactataagcgtggtgaccactgacgagatgatgccggtggaggcagcggcggcggcggcggcggatgactggtcggagtgcgcgttctcgctgacctgcgaggaagactgcgccgacctcggcgacggcgtcgtagacgacggcgagttcttcccgctctacaatgccggcgacgaggaggaagaggagtacttggagcagctggtgtttaaggagaccagcttctgctcctcctcctccgactcaggcgccgactgcgacggcgacggcgacggagacggcgaaggagacgaagagtacccctcgctcgcctccgaggagtggttccggcaagctcgcctcgccgccgtcaagtggattcttgaaacccgcgggtgcttcggtttcggccaccggacggcgtacctcgccatcgcctacttcgatagcttcctcctccggcgacgcgtcgatagggaggcgatgccgtgggcggcgcagctgctgtccgtggcgtgcgtgtccgtggccgccaagatggaggagtgccaggtgccggcgctgtcggagttccacgccggcggctacgatttcgactcggcgtccatccggcggatggagctgctggtgctgtccacgctcgggtggcgcatgcgcgccgtcacgcccttcgacttcctcccctgcttctcctcccgggtccacccgcacggcggcgccggcgccggcgccggcggccacgtcgccctcaaggccatcggtttcatcttcgccacggctgaagctggtagcgtgcttgatcacaggccgtccactgtggctgcagctgcaatcttggctgcaacctatggacctctgctgaccaaagaagcactgggttccaagatgagctacctttctccatcttgtcttattgagaaggagcatgtacatgcctgctacagtatgatggttggggacatgaacaggagaggtagcaagagatcattgccatgttcaggcaccaacgagattgccactagtacatatgattctgttcttgttgatgatgacgttacggacaccgcggcagccgccattgccactgtagtggcggcgaggaataagcggatcaggctggagctgacgggcatccgttgagaaagctagcaccaccggggacacaatttttagccagatgtctaggggggggcttggtttgatcttccctttcattttctttccttctttttttaacttatatgtttgcaaaaaaaaaaaaagaagagattttttaggttctttgagccattgccatgggttggcattggctgttgtcagattggattggtttggtttgtgagaggtggaagagatgaatgaacaaagcagagggctgagctttcctatggagaggagagcttaggttaataagcccaatgccagtg

SEQ ID NO: 404 - DNA, 1967 bp, Sorghum bicolor
gcgcgatggcgggcggcggcgatcgccagggcgcgaagaagcgcaagcgcgagcatgcggaagggaaggccaagcctcggccgcaagttaagggaggtggggacggagggaagcggaagaagcactcggccgcagatggcggggccggagaggctgtggcgaggaagaagactccggttacccacaaggagaagcgcatcgcggccaaggaaatgtcggaggccaggaagatgaagaggaaacggcattacagccttgagaaggaactaacgaaactgtgggaaaagatgagatgtcacgatgtgagcaaagaagagaggtccaaggtagtaagtgaggctatcaagaaaatggatgggaaatatttggatattgccacatcacatattactgcacgtgttcttcaaacatgtgtaaagtggtgctcgcagtcagagagggatgctatttttgatgttctacatccacatttgctcgatctttctcgcaagaaatatgctgttttccttgtaaagaagcttatagaactcgcctctaaaaaacagtttgccagtttcatctcttctcttcatggtcgtgttgccaaacttcttcatcatactataggagctgcagttgttgattatgcatttcagcggggaacaaaacgtcagaaaaaacagttgttgctggaactgtactccactgaacttcagctattccaggatctgactttgcaaagttcctgctgtttgatagatacaatttccaagcttgggttgcagttatcatctgtcctgcagtacatgactattgtgattcataaaatcttggagaaaggtactgttgagtattcaatagtgcacacggccatattggagtactttacaattgcagataagacctcagcctcggacgttatttgtcaacttatcccccttcttactcaaggagcattaatcatagatggagatgaaccatcaaatgctccggagctaccaaagaaaacaaaagctaagaagaaaaggtcgaaagagccacttatcgttaggatcatgcagacaagggaaggtttaaaactaggaattggttgcctcaagcatggcagtgcaaaggacaggaagaagatcattaaaagtttgaaggggcacattctgaagcttgctctaagtgattttggatgccttttccttatctgcattctttccattgttgatgacacaaagcttgtttctaagattgtcattcaagagctggcaaaacatttaaagcaactcatttttgacaagaatgggagacggccattgctgcaactactaaaccctctttgctcacgctatctttctccggatgatctggcttgtctgaactacaatgtgccgtctcttagtccaaaagagggtgacacatcagaaaacgtagtaaatggtatgactgatgaagaccctaatggcttagtagtcatgcaaattgtgtctgagagcaagaaggatccattacaaaggcgacatgaactgttggtgaaaactgagctggctgaggctctcatccaatcatgccttgaaaatgttggagaattacttcgaacaaattttggcaaagaaatattatatgagattgttgttggtggtaaagacaatattttggagggcctcactgataggatccacatgttgcatgatgcaatagtgtctgatgcagcccaaccgaagactgaagatattgaacatgcatttgagaatttcttttccagtcgtgtaatcagaagaatgataattgactgtccagcatttgcagtcactctctggagaaaggttcttgaaggaaagtgcaagatatgggctgaaggatacagctcgaaggtggttgcaggtttcctggaatcgccaagtaaggaggtcaaggatcttgcaaaacctgagctgcagccactggttgatgctggcatccttaaagtgccagaccctaaggttgttcagaaataataa

SEQ ID NO: 405 - DNA, 2102 bp, Sorghum bicolor
tgccaatggcgccgtcgtggtgggggagggacgcgagggccaatggcgtcgttagcggcggcggcggcacgcccgtggtggtgaagatggagaacccgaactggtccatctccgaggtcgccgcatccgaggtgtcgccgggctcgccggcgggtgccggcgggggcaaggccgggcgtggcaagaacgcgcggcagatcacgtgggtgctgctcctgcgggcgcaccgcgcggcggggcggctgacgggggcggcgtcggcggcgctggccgtcgccgccgccgcgcgccgccgggtggcggcggggcggacggactcggacgcagccccgggggagagcacggcgctccggacgcgcttctacggctgcatccgggtgttcctggtcctctcgctgctgctgctcgccgtcgaggtggcggcctacttccagggctggcacctctcggtttccctcgaggaggaggtggacgcgggcctccaggccgtcgacgggctcttcgccgccgcctacgcggcgtggatgcgcgccagactcgactacctcgcgccgccgctgcagttccttaccaacgcctgcgtcgtcctcttcttgatccagagtgtcgaccgcatcgtgctttgcctgggctgtttctggatcaggctcaaggggatcaagcctgtgccgctagccgccgccgacaaggaggacgtcgaggccggtcccgaggacttccccatggtgctcgtgcagatgcccatgtgcaatgagagggaggtgtaccagcaatcgatcggcgcagtgtgcagcctggactggccaaggtcaaatttcctggtccaggtgttggatgattctgatgatgctaccacttcggcacttatcaaggaagaggtggagaaatggcagcgagagggggtgcgcatagtttaccggcaccgggtcatccgggatggctacaaggctggaaacctgaaatcagccatgaactgcagttatgtgaaagattatgagtttgttgtcatctttgatgctgatttccaaccacaagcggatttcctgaagcgcactgtaccccattttaagggaaaggatgacgtcgggttggttcaggcaagatggtcttttgtaaacaaggatgagaacctgctgaccagacttcagaacataaatctttgcttccactttgaggtggagcagcaggtgaatggggcgtttctcaacttcttcgggttcaatggcactgcgggagtgtggagaattaaggcacttgaggagtctggaggatggatggagaggacaactgtggaggatatggacatagctgttcgggcacatctcaaggggtggaagtttctcttcctaaatgatgttgagtgtcagtgtgaattgccagaatcctatgaagcatacagaaagcagcaacaccggtggcactcaggtcccatgcaattgtttaggctctgctttgtggatataatcaaatctaagattggattctggaagaagttcaatctcatatttcttttcttccttctccggaagctcatcctacccttctattcattcactcttttctgtgtcatccttcccatgacaatgttcgttcctgaagctgaactccctgcatgggtagtatgctacattccagcaacaatgtccattctcaacatcctcccagccccaaaatctttcccgttcattgttccataccttctgttcgagaacaccatgtcggttaccaagttcaatgccatgatttctggcctgttccagctcgggagtgcctacgagtgggttgtcaccaagaaatcaggtcgttcttctgagggcgatctcttagccctcgttgagaaacactctaagcaacaaagagtaggttctgcacccaatcttgatgcactaacaaaggaggagtcaaatcctaaaaaggacaccaagaagaagaagcacaacaggatctacaggaaggaactcgcgctgtccttccttctgctaacagcagccgcccgcagtttgctgtctgcccagggcatccatttctacttcctgctgtttcaaggggtttcattcttggttgtcggcctcgacctaattggcgagcaagtggactgataa

SEQ ID NO: 406 - DNA, 2908 bp, Sorghum bicolor
taatcatgccgagtggtaaagcaaaagctccaaagggtggggaggatcctggaattccgccagttccttgtgaaggggaaattagccatgagccacagagacaacggtcgctcaacgggaggactactggtccgacccgccgttcgaccaaaggaaattggacacccgaagaggatgctatattgtcccgcgcggttcagacgtaccaagggaaaaactggaaaaagatagcggaatgttttccagacagaaccgatgtacaatgtttgcacaggtggcaaaaggttctaaaccctgaattggtcaaagggccatggtccaaagaagaagatgaaatcatagttcagatggtaaacaaatatgggccaaagaagtggtcggccattgctcaagctttgcctggacgcataggaaagcaatgtcgagaacggtggcacaatcatcttaacccagccataaacaaggaggcatggacgcaagaagaggagattactcttattcatgctcatcggatgtatggaaataaatgggctgaactgacgaaatttttacctggaaggacggataatgcaattaaaaatcactggaacagttcagtaaagaaaaaggttgattcatacatatcttctggcttactttcacaagtcccatgcctccctctgattgaatatcctgcacaatgcgattctttatcatctatggaccaagaaaacaacggagatagtgtttgcaatgctcagaacactagcatggccttgagctctgatttacaagtaaatgtggatgccaacaagagagaagcacaagactctcactcgtccttgtgtcaaggggcatgctatccttccacagaggctgtaggatctgttttgcctgatgagaaccaccatgttccttcatctttttctcaaagaatggacctgcagatggatatggatgaaggatcaggaaattctatgtttgcagatgatcaaactctttgtagcacatcaaatcaagaaaagtctatggtgccatttgttgttgcacaggaaatgcctgtctctgtgctatcaggtgtttctagcgctgagcagaaactgcacttaatctctgatgctgaaagtttgaaatctgaactttggaaagatgtttctttgcaaactcttatttcaggagttacagttgacgctgatgcttcaagattaaatcatccagattcttccaaaatggacaccaattttttgacacaggcctacccattacacacatcaaatccatccggtgtgatggaaactgtgtatgaaccgatgccgtcggagacaatctctccctcttttatatgttcagatggtttgtctgttgcacccgaaaatagatctgagccaagagaaatgccagactgtgaagcacagatggccacatcctcaaacattttttgtgatggcgatcaatctgctatacctggcagcagtgatgacaggccagaggctttcacgatgactgagagcattacaaactgtgggggtcaacagtcaacagatgccgaagaacctatggccactacagcaaaagaacagttatcgaaagacattgagactgtgccagatgaaaagaagggtgagggagctctattctatgaacctcctcgattccctggtttggatgtcccatttatcagttgcgatcttgtaacttctgctgatctgcaagaatttagtccccttgggattaggcagtggatgcggtcgaccatgaatgtccccactcctttaagattatggggctctccaacacatgatgaaagcccagatttgctaaagagtgctgctgaaagcttcccatgcacaccatcaataatgaagaaaagacagagaggtctattgtcccctactccagataaaagaattgagaagaaatctgggattgcaaagggggtgacagatatctcctatatgatcacgaccacatgttccatgaatgcaaccaacgatggagacattgttactgaatcagttgtgtgtgctgagcaaccttcttttaaacatctagacaagaaacttgagttctctaatatcaacatggaaaactctgatggagcatctaaacaggccaaagatccacaaaatgcagggaacaaacgactcgtggaggagtcctcgccaaacgttgcaaatcctaacactgatctgcaagacaatatacaacctgtacggattcttgttgagcacagcagcaataaccttattgctgctgatcatggtgcaaagccatcttgtaaggaagtaattagttcaaaatcaaagcctacagaactacttgttgaaaaatcatcaccatgtatcaatgcggattacgaatatgtgaacttattggctgataccccaggtgtcaaaagaggtttggaatctccttctgcatggaagtctccttggtatattgatatgcacatgcactttcagggttttgtcagcccagcagacagaacttatgacgcattaggattagtgaagcatttaagtaagcacagtgctgctgctgcagtggaggcctgtgaggtgctagcaagtggcaacaggacttctgataaggaaaacaaggataatactgatggcaaggagccagtggcaagaaaatcacaggtcaaaatcatggccgaggcgcgagtcctggatttcgacgaatcttccacacctgcaaggacagcagataagaaatttggcagctgtctcgggagatctgttagctcacccattcttccctcccccaacctgagaagtttccgataggtagaattctgagagatacaccagatatggtataattatacattagccatatgtacatgtatatgttcctagagcgcattgttctttcattactctatgttaccatgatgtcagcgtacagtcagcccagaaactagcat

SEQ ID NO: 407 - DNA, 1787 bp, Solanum lycopersicum
tatcaatggagggtcgccattctcatccatctactccaatccccgaagattttgttcagaagcgtggcaagaaacggggaagctataactgtggtagatgtggacttcccaaaaaaggacatgtttgtgatttgactaaggagtttagtgaagttcctactccaacatctagtgatgctaagtcatttgttttgccttctcagctttctgttattcgttctaaccctaccccacctttacctccgccacgtcagccggttgtgcagctccggcgggcgctttcgtttgatgatattggtgttactgacgaatcgcctggatctgatgatgagggggagggggagtttttggattttgagagtgagttggatttaggtggatctgggaagttgccggcgaattgtttgtgggaagtgcttaagagattgccaccgtcgtcgttgctttcttcggcgaaggtgtgtaagggttggagggatgtttctaggaggatttggaagtcggcggaggagcttagacttgaggttcctatgaaagctcagattggacttgttggatcggtgttgcagaagtgtcctggacttgttaagctttctcttagaatgaaaagtgatgtggatgccacaatgctggcctgcattgcattttcctgccctaatctggattcactggagatcctcacttccgatacctcagtcaatcgaatcactggggatgacttaggtcgttttgtagctgataaaaggtgtcttaccaatcttaagatggaaggctgctcaaatcttggaggctttactctttcttcaaccagcctttccactctttgccttttggaactcttttgtcactctaagatggtcttcaactgccccaatttgaaggaaatctccctgattttttcttgccaagagaatgaaaacactgatcttacagctatggtgaatggtcttggaaggagctgtccaagactacagaacattcatgttgcctcagttcggctgacacatgctgttgtgcttgctctaacagcagcaaatttaaggggattaagaatgctttcacttgtactaggatcagaaattactgatgcatctgttgctgctattgtttcgagctactcaaggcttgagttacttgatttgagtgggtctagtattagtgacagtggcattgggatgatatgcaatgtatttccggagacattgttgaaactactccttgctctctgtccaaacattacgtcaagtggcatacaatttgctgcagctcagttgcctaacctagagctaatggattgtggaatgagcatatgcgatccagatctagacagtccagcagcacaggaaaatgataatgttgatatacaaagaacaccaagtagtaaattacaccttatttatcagaaactgattattaagcacagccacttgaagaaactcagcttatggggttgctctggcttagatgcattatatctcaattgtccggagcttaatgatttgaacctgaactcttgtatgaatttgaatccaggaagattgctactccagtgccccaatctggaaagtgtacatgcatcaggttgtcaagacacattggttgaagctcttcagaatcaggtttgtggtgattttatggttgaagacgatcattttccttgtaaacgtcttcctgatggctcaaaaaggatcagagttcctcattcatacagtccccagccatttgatgatggaaagagaaagagaaggctttcaaagcaacgttgtgcagtgcttgtttattagtag

SEQ ID NO: 408 - DNA, 620 bp, Arabidopsis thaliana
aaataatggggcgtatggattatctagcgatgaagaccgacgacgtcgatacggtggcgttagtcaattccgatatggaagagctcaaggtcgctgcgaagaaactgtttagcgatgtttcgaagcttggtggattaggcttcggtgtttcttttctcaaattcctcgcttctttcgctgccatttacttgttaattttggatcgtaccaattggaaaaccaagatgcttacatcactcctaataccatacatcttccttagccttcctagtgtcattttcaactttctcagtggagatgttgggaaatggattgctttcgttgcggttgttctcagacttttcttccctaagcatttcccagattggcttgagatgccaggttctctgatcctgctactggtagtttctccacacttccttgctcaccatatacgtggaacctggataggcactgtaatcagccttttcattggatgttaccttcttcaagaacatattcgagcatcgggtggattcaggaactcattcacacagccccgtggagtatcaaacactttagggatcattcttcttttggtctaccctgtctgggctctaatcgtccgtgtcatgtaatga

SEQ ID NO: 409 - DNA, 1283 bp, Hordeum vulgare
cagtaatccagagacaccgtagcgagagaggagacgcggcggcagccatggcgatccccctcgtgctcgtcctactcccgctcggcctcctcttcctcctctccggcctcgtcgtcaacactgtccaggccgtattgttcttgacgataaggccattctcgaagcgattgtaccggcagatcaacgtattcctggctgagttgttgtggcttcagctgatctggcttgtggactggtgggcaggtgttaaggtacaggtgtatgcggatccagaaacttggaaagtaatgggcaaagagcacgcccttctcatatccaatcatcgaagtgacattgattggctggttggatggattttagcacagcgttcaggatgtcttggaagcgcaatagctataatgaagaaatcttcaaagttccttccagttattggttggtccatgtggtttgcagaatacctctttttggagagaagctgggcaaaggatgaaaaaacacttaaatcgggtcttcaaaggttgaaagacttccccagatcattttggcttgccctttttgtagagggtacaagatttactccagcaaaacttttagcagctcaagaatatgcagtttcacagggtttgacagcgcctaggaatgtgctgattccacgaactaagggatttgtatcagctgtaagtatcatgcgtgactttgtcccagctatctacgatacaacagtgattattccggaagattcgcctaaaccaacaatgctgcgtattcttcagggacaatcatcagttgttcatgtccgcataaaacgccattcaatgagtgatatgcctaactcggatgaggatgtttcaaaatggtgcaaagatatatttgtagcaaaggacgcgttattggacagacatataacaactggtacttttgatgaggaaattataccaattggtcgtccagtgaaatctttgatggtggttctgtcttggtcatgtctcctcctatatggcgctcatagattcttacagtggacccagctcttgtcaacgtggaaaggagtgatcctctttgctactggattggcaatggtgaccgccgttatgcatgtattcatcatgttctcgcaggccgagcgctcaagctctgctaaagcagcaagggaccgagtgaagagggattgatagcccgtgtgaaattcagtctataggggaactgccaatttattatgttcagaatatatgtagacacaggctccatgggtcaaaatctagtatgtccttgttgtcctcggt

SEQ ID NO: 410 - DNA, 1544 bp, Setaria italica
cgtagatgcacaggctctccctcaccgtcattgacgccgccgccgccatgcccgcggcgctccggctcggcggctccccggcgctccgcctagccgccgcgcgccgccctggcccgcggcccccgccgtggctgcgcttcggtgtgggcggcggggccgtggcgcgaagggggctgctctgctccgccgaggccgccaggcggggcggcgagggcgaggacacggaggtggaggatgcgcggaggggaagcgggagccgcgcgggggcggagaggaggacgaggggcgggagcgcggccgccgcggtggggacgagcgtcgagcttctggcgattcccggggtcgggccgcgcaacctcaggaagctcgtggataatggcttcgagggcgtcgcgcagctcaagcagctctacagggataagttctttggcaagtctagtgagcagatggttgagttcttacagagttctgttggcattgtacataagaaccatgctgagagtataacatcatttattaaagagagtgtcgatgaggagctgaaggatacagattcatctaaacccactcaaaagaagaggttgaccttttgtgtggaagggaatattagcgttggaaagaccactttccttcaaagaatagctaatgagactattgaactgcgtgatcttgtagagatagttcctgagcctattgataagtggcaggatgttggacctgatcacttcaatatattggatgccttctatgctgagccacataggtatgcatacactttccaaaactatgtgtttgtgacgagggtcatgcaagaaagggaatctcaagctggaataaaacctctcagactgatggaaagaagtgtattcagtgatcggatggtgtttgtccgtgctgttcatgaagctaattggatgaatgagatggagatcagtatctatgattcctggtttgatccagttgtgtcatcactcccaggtctcattccagatggatttatctatctaagagctagtccagatacttgccacaaaagaatgatgcatcgcagaagatcagaggaaggtggtgttacacttgactacctgcaaggtttgcatgagaagcatgagagctggttgcttccttcaaaaggatcaggtcctggtgtattatcagtcagtcaactgcccatgcatatggagggctccttgcctccagaaatacgggatcgtgtattttacttggaaggaaatcacatgcactcaagtatccaaaaggtccctgctcttgtcttggattgtgaacctgacattgatttcaacaaagacatagaagctaaacgacaatatgctcggcaagttgcagagttcttcgaattcgtcaagaaaaagaaggaagaagctccgtcggatcaaacaagtgctgacaaggaccgcatgaacccgcatgtcatgcttcctaacagaggtcggctatgggtccctgacggcaaccccttcacaggctcccctatgaatctggatttcagaagagccatgtcttcgtacctctcaacctaataa

SEQ ID NO: 411 - DNA, 1544 bp, Setaria italica
cagcgatgcacaagctcctcccccgcgccgcctccgtcctctacgccgccgccgcggccccactgctgctctcctccccacgcatgcctgcgctgtgcctggccggcagcccgttcgcaacctcgcgtccagtcgcgaatcctagccgcatccgctccccgccgtggctgcgctgtggcggcgggaggaggggactctgctcggccgaggcggcgaggcgcgggggcgatgcggaggaggagaaggagaagggtggcgggggtcgcgcggtgccggagaggaggcagcgaggtcggagtgatgcgctgggggaaagtggggagctgcttgccattcccggggtcgggccgcggaacctgaggaagctcgtcgacaagggattcgatggcgtcgcgcagctcaagcagctctacagggataagttctttggcaagtctaacgagaagatggttgagttcttgcaaaattcagttggcatcatccacaagaaccatgctgagagtataaccttgttcattaaagagagtgttgatgaagagctgaaaggcactgatacatctaagcttcctaaaaataggaggctgaccttttgtgttgaagggaatatcagtgttggaaaaactacctttcttcaaagaatagccaatgaaactattgaactacgtgaccttgtagaaatagtacctgaacctattgcaaagtggcaggatgttggccctgaacacttcaatatacttgatgctttctatgctgagccagagaggtatgcatacaccttccagaattacgtatttgtgacgcgggtcatgcaagagaaggaatctgcatgtggaatgaaacctctccgactgatggaaagaagtgttttcagtgatcgaatggtttttgttcgtgctgtccatgaagcaaactggatgaatgagatggagatcagcatctatgactcctggtttgaccctgttgtgtcatcactcccaggtcttatccctgatggttttatttatctaagagctagtcctgacacttgccacaaaagaatgatggtgcggaaaagatcagaggaaggtggtgttactcttgattaccttcgaggtttgcatgagaaacatgagagctggctgcttccttccaagggaggagcttctggtgttttgtcagtcagtcagcttccagttcatttggagggttccctgcctgcggatatacgggatcgggtattctacttggaaggagatcacatgcattctagtatccagaaggttcctgctctggtcttggattgtgagcatgacattgattttaacaaggatattgaagccaaaagacaatacgctcggcaagttgcggagttctttgaatttgtgaagaaaaagaaggaatcttcaacagcagagacgattgatggtgataagagtataaacaagcagattatgcttccccagagtggtggtttgtgggtacctggaagcagccgtttgccagaatcagctctgaagtcctttgatttcaggaggacaatgtcttccttcctctcaacttagtaa

SEQ ID NO: 412 - DNA, 1358 bp, Setaria italica
gctccatggccggcggctgcgccctctcggggggctgcccaacagacttcgccgccttcgccattgcctccgcggttcttgctttgctcattttccgtgctctctttcccttcatctatcggaagggcaaaagaactggtgtttggcttgtaatagttcaaattattggaagcactgatctgttgctctcactggtgatgtcaatgaactttctgaagttaaagcttgggcatccttggaaatcatgttatctctgggcagtttgggcagaagggccttttggatttggattgttgatcagttgccgcattgtacagggatttcagttatatcacgtttttgttaagcaccggttgccaccgatcaggccttccattattttagtagttatactccttccatggatatgtggagctgctgtttttcattggaataaacctttgaatcaccggtgtcacatgcaggctcagtgggtgattccagtaatgtgtatacatggattttatattgctggtttaattgtcatcacattatccattcgacatattgaattcagattcagtgaatttaaggatcttctacaagcaattattgtttcaacaatagcagtaggattttggattgttgcatatgtcctgaatgaaattcacgaagatattgcatggattcaagttttctctagattttcccttcttgtcatggcaagtattctggtgctgctattcttctcaatgtctatttctcaacctctgcattcacaaataagtctaggaaagcaagagtcgactgcctttatgactatgggtgaagcattaggtataactgataggggttcagtaaagaagattaatgccactcattttgattcgaatcaaccattggacaagctgcttgaggacaaaagattccggatgtctttcatgtcatttgcggacagttgcttagctggagagagtgttcatttctatgaagaggtgtatgacctgaagaagatacatctggatgattccattagaagaatatacatggcaagacacatcattgaaaaatatattgacgcaggtgcagaaatggagataaatatttctcacagaactcgccaagagatactaggaacacctgatctaactcatccaaatctgtttgacagtgcagtgagtgagatattgcagctgatcaaaatgaatttggcaaaggattactggtcatccctgcactttgctaagctgaaggaagatatagagagagggcccaacggccctgagctcatgccattggattactccccaagagttacttttgtgcggtgtactgatgatcccttttacgaagaacacgctgcgacttgtaattgatga

SEQ ID NO: 413 - DNA, 1505 bp, Setaria italica
ccacgatgatgcagcagatgcagcaggagccgtggaacgccgccgccgtggggctcctccggccgaccaagtcggcgccctgctcgcccatcaagccggcggcagcggcgggcatggtccggacccactccgactccttccacgtcgcgcacaaggtgcccgtcggcgacacgccctacgtgcgcgccaagcgcgtccagctagtggataaggatccggagaaggcgatcgcgctgttctggtcggcaatcaacgccggcgaccgcgtggacagcgcgctcaaggacatggccatcgtgatgaagcagcagaaccgcgccgaggaggccattgaggccatcaagtcgctgcgcagccgatgctccgaccaggcgcaggagtcgctcgacaacatcctcctcgacctctacaagagatgcgggcgactggacgaccagatctcgctgctcaagcacaagctgcagctgatccaccagggccatgccttcaacggcaagcgcaccaagacggcgaggtcgcagggccgcaagttccaggtcaccctcgagcaagaagccaccaggctcctcggtaacctgggatgggctctgatgcagaaggagaactacacggaggcggagggggcgtaccggcgggcgctgctcatcgggccggacaacaacaagatgtgcaacctgggcatctgcctcatgaagcagggccgcgtgcttgaggccaaggacgtgctcaagcaggtgcgccccgcggcggtcgacggcctgcgcggcgccgactcgcacctcaaggcctacgagcgcgcgcaggagatgctgcgggacctcgaggccaagctcgtcggccgcccgcgcgccgatcagctcgacacgagctggctcttcgacgcgctgctgctgggatcgtcgtcaagtatctggcagccgcagccgtgcatcgaccacttgctgccaccttcagctccggcacctgtcccggccccggccccggcgcggcgcgaccacttcgccgatgagaacgcctgcgtgagcaagaagctggcggcgctccaggcgaacatgctcaatgttgacgcgcagcccttctactctctgcggatgccgccacttgcgacgaagccccagaacacagtgcagcagcagccgcagcagaagccaactcccgtccatgatcccttgggcaacctgaagaggacacggtccggcaattgcatggacaaggcaggagcagtggtggacaaggagcagagcaccgacgagaacagcggcaggaggaagtcgctctcggctgaggacagatggccggaactgcccgaccacagcgcattcgacgaggctctcgtcgcggctgtcctagccccggtgctcgacgacgaaccagcagccaccgaagggaacggccatggcaagctgccggcgagctgcggcacgagcccagtggtgaaggagaagatcggcaagaggctgaggatcttccaggacatcacacagacagtgaacaacttctgataa

SEQ ID NO: 414 - DNA, 827 bp, Setaria italica
cggcgatgaggtacggcgaggtggcgcacttcagccacccgcagcaccggctccggctggagcaccacgacacgccgttccggtgcgacgggtgccgcgaggtcggcatcggcgcgcgcttccgctgcccgtaccctggctgcgaccacgacctccaccgccagtgcgcgctcccgctctcgccgccgccgccgccgctccggcacccgttctacccgcgctgcgccttcgccttcctcccgcgggcgcctggcgcgccgggctcccgctactgcaacgcgtgcggccgcgacgtcgccggctacgtctaccactgccgcgcgtgcgggttcgacctgcacccgtgctgcgccgcgctcccgcacgcgctcgacgccggcggcggcgtcaggctgcgcctccacccggactccagggccaccggcgtcgcggcgtgccaccggtgcggccaccgcgggcgcagctggagctaccggagccagtgcgggagcttcagcctccacgtggcgtgcgtcatggacatgctcgtcgagagctggcacggcatcggccgccacaagggcgtcgccggcgggggcgggaacgtgtacgacggcgggatgctggtgcccgggtgcggcgggtacagggttccggcgatccggggcgcggcgaagagcgcccacgcgagcaggggagggtactcgacttggggcaggaagaaaggcaaggtgaagcgatgctgcgagatcgccgggttcgcggcgcaggtggtcatctcggcggtgctcggcgaccccaccgcgctcatcgccggcgtcatagggtcgctcatcgcgcggtgataa

SEQ ID NO: 415 - DNA, 3803 bp, Setaria italica
ttgcgatggcggagtcggctttggcggacgggaaggcggagaaggcggccagtggaggagggggcgatgcggcgggggaggggaagaagagggccgaccaggccgtggcgttccacgagctgttctcgttcgccgacaagtgggacctcatgctcatggcggcgggcagcctgggcgcgctcgcgcacggcgccgccatgccgctcttcttcctcctcttcggggacctcatcaacggcttcggcaagaaccagacagacctccgcaccatgaccgacgaggtcgccaagtatgcgctctacttcgtctacctggggctggtggtctgcgtctcctcctacgcagagatcgcgtgctggatgtacaccggggagcggcaggtgatcgcgcttcggaaggcctacctggacgccgtgctgcgtcaggacgtggggttcttcgacacggacgcgcgcacgggcgacatcgtgttcggcgtctccaccgacacgctgctcgtgcaggacgccatcggcgagaaggtcggcaactttatccactacatcgccaccttcctggccgggttggtggtcgggttcgtatcagcgtggcggcttgcgctcctcagcgtggccgtcatccccgccatcgccttcgccggaggcctgtacgcgtacacgctcaccgggctcacttccaagagccgggagtcctatgcaaatgcaggcgtcgtcgcggagcaggcaattgcccaagtaagaacagtgtactcttttgtcggagagagcaaagcacttaattcctattctgaggcaattcagaacacactgaagcttggttacaaagctggtatggccaaagggcttgggatcggatgtacttacggaatagcatgcatgtcttgggcactggtattctggtatgctggtgttttcatcaggaatggacagagtgacggtggcaaggcttttactgcaattttttctgcaatcgtcggtggcatgagccttgggcaggctttctcaaaccttggagccttcagcaaagggaagattgctggttacaaattgctggagatcatccgccagaaaccctccatagtcaatgatcataaggatggaaagtggttggctgaggtccatggaaacatagaatttaaggaagttactttcagttatccgtcaaggcctgatgttatgatctttagggatttctctctcttcttccctgctggtaaaactgtcgcggtcgttggaggcagtggttctggaaagagcactgttgtggctttgatagaaaggttctatgatcctaatgaaggccaggttttgctcgacaatgttgacataaagacactccaactgaggtggttgagagaccagattggtttagtaaaccaagaacctgctctttttgcaaccactatccttgagaatatactgtatggaaagccagatgccactgttgcagaagttgaggctgcggcgactgcatccaatgctcatagttttatatctcttcttccaaatggctacaacacaatggttggtgagcgaggcacccagctgtctggtggtcagaagcaacgtatagcaatagctcgtgctatgctgaagaacccgaagattctactccttgatgaagctaccagcgctttagatgcagactcagaaagcatcgtgcaagaagctcttgaccgtttgatggttgggaggacgacggtagttgttgcccatcgtctgtccactataagaaacgtgaacatgattgctgtgattcaacaaggccaagttgttgagactgggacacacgatgaactcctagcaaaaggaagcactggagcatatgcctccctggttcgttttcaggaatcagcacggaatagggatcttggaggtgcatctacccgcagatcacggtcaatgcacttgacaagctcactttccaccaaatctctcagcctcaggtctggaagtctaaggaacttgagctaccagtacagtactggagcagatggacgcatagagatgatctcgaatgcagataatgaccgcaaatacccagcaccacgtggttacttcctgaagctcctgaaattgaatgcacctgaatggccttatgctgtattgggcgccattggttccgtcctctcgggatttattggtccaacatttgccattgttatgggtgaaatgctggatgtgttctactacagggaccccaatgaaatggagaagaaaacaaagctatatgtgttcatctacatcggcacaggcatatatgctgttgttgcttatcttgtgcagcattacttcttcagcatcatgggagaaaatcttacaaccagggttaggaggatgatgttatccgcaatacttaggaatgaagtgggttggtttgacgaagaagaaaacaactcaagtcttgtggctgctcgtctagcagtcgatgcagcagatgtgaagtcagctatagctgagagaatatcagtcatcctgcagaacatgacgtcccttatgacttcttttgttgttggttttatcattgaatggagagtggcactccttatcctggccactttccctcttcttgtgcttgccaactttgcccagcaaatttcaatgaagggctttgctggtgacacagcaaaggcacatgccaagagcagtatggttgctggtgaaggagtgagcaatattcgcaccgtggctgcattcaacgctcaaagcaagatcttgtcactcttcagccatgaactgcgcataccagagcagcaaatccttcgtcgtagccagacatcaggtcttctgtttggactttcacagctatgcctgtactcctcggaggcgctcattctctggtatggttctcatctcgtccgatcacatggatccaccttctccaaggtcatcaaggtgtttgttgtccttgtggtgactgccaactctgtagctgagactgtgagcctagccccagagatcgtccgtggaggtgaatccatccgatccatctttggcatcctcaacagggcaacaagaattgagcctgatgatcctgagtcagagcgtgtcaccaccatccgaggggacattgagttgcggcatgtggactttgcctatccagcacgcccagacattcaaatcttcaaggatttcaacctgaagatccatgctgggcgtagccaagctctagtcggagccagcggttcagggaagagcactgtcattgctctcatcgagcgtttctacgatccgactgggggcaaagtcagtattgatggcaaggacatcaggaggctgaacttgaagtccttgcggctcaagatcggccttgtgcagcaggagccggtcctcttcgctgcgagcatcctagaaaacattgcgtatggcaaggatggtgcgaccgaggaggaggtgatcgaggcggcaaagacagcaaacgttcacggcttcgtcagccagcttcccgacggctacaagacggcagtcggcgagcgtggcgtgcagttgtcaggcgggcagaagcagcggatcgccatcgccagggcggtgcttaaggacccggccatcctgctgctggacgaggcgacgagcgccctggacgcggagtccgagtgcgtgctgcaggaggcgctggagcggctgatgaaggggcggaccaccgtcctggtggcccaccgcctctcgacgatccgaggggtggaccgcatcgccgtggtgcaggacgggcggatcgtggagcacggcagccacaacgagctcctgacccggccggagggcgcctactcacggctgctgcagttgcagcaccaccgtgtctgatag

SEQ ID NO: 416 - DNA, 1370 bp, Zea mays
ctgagatgaaggagagaggcggctccagggcggcagtggacgagcgctacgcgcagtggaagtcgctcatccccgttctctacgactggtttgccaaccacaacctcgtttggccatccctctcctgccggtgggggccacagtttgagaaagctacctacaagaatcgtcaacgcctttacctatctgaacagaccgatgggagtgtgcctaatactctggttatcgcaaactgtgaagttgtgaaaccaagggttgcagctgctgaacatatctcgcagtttaacgaggaagcacgatcaccttttgtaaagaagtacaagactatagttcatcctggtgaagttaacagaatcagggagcttccacagaacagtaagatcatagccacacacactgacagtccagatgtacttgtttgggatgttgaagcacaaccaaatagacatgctgtcttaggagcttctgaatctcgtcctgatctgatattaacgggacaccaggaaaatgcagaatttgcgcttgccatgtgtccagcagaaccatatgtcctgtcaggaggaaaggacaaatttgttgtcttgtggagcatccaagaccacatatctgcccttggggattcctcgtcttctcccggagcatctggcagcaagcagtctggcaaaattgcaaatgaaaaggagagtcctaaagttgatcctagaggtatattccatggccatgacagtactgttgaagatgttcagttctgcccttccagtgcgcaggagttttgtagtgtgggtgatgatgcttgtcttattctgtgggatgctcgaactggcactgacccagctgttaaggttgagaaagctcacagtggagatgttcattgtgttgattggaatccccttgatgttaactatatcttaactggttctgccgataactctgtccgaatgtgggatcgtcgcaatctgggttcgggaggagctggttctccaattcacaaatttgagggccataaagctgctgttctttgtgttcagtggtcacctgacagagcatctgtttttggaagttctgcagaagatggtttcttaaatgtttgggaccatgagaaggttgggaagaagaaaaattctaatgtcccagctgggcttttctttcagcatgctggtcatagggataagatcgtagacttccactggaattcgtcagatccttggacaattgtcagtgtctcagatgatggtgagagcactggtggaggtggaacactgcagatatggcgaatgagtgatttgatctaccgcccagaggatgaagttcttacagagctggagaatttcaaggctcacctggccagttgcgctccgaggaattgatag

SEQ ID NO: 417 - DNA, 2093 bp, Zea mays
acgagatgcctgcgctcgccgtcgacgccgcgacacccgtggcgcacgccttcgcgtcctgcgacgcggcgcgcttccccgccccgcccgtggtgggccccgccgccgcggccgaggccgccccctggtcggccgacctctccgcggcgctctacaacgtggacggctggggcgcgccctacttcttcgtcaacgacgacggcgacgtggccgtgcgcccgcacggcgccgcgactctcccgggccaggagatcgacctggccaaggtcgtggccaaggccgcgggcccgcgcgccggaggcgggctcggcctgccgctgccgctgctcgtgcgcttccccgacgtcctgcgccaccgcgtcgagacgctcaacgccgccttcggctacgccgtccgctccaccggctacggctcaaggtaccagggcgtgtacccggtcaagtgcaaccaggacaggtacgtcgtcgaggacattgtggagttcggcgcgccctttgggttcggcctcgaggccggctccaagcccgagctgctgctcgccatgagctgcctcgccgcgcgcggcggcctggacgccctgctcatctgcaacgggtacaaggacgacggctacgtctcgctcgcgctcatggcgcgctccatgggcctcaacaccgtcatcgtgctcgagcaggaggaggagctcgacattgtcgtcgaggccagccgccgcctcggcgtgcgccccgtcgtcggcatgcgcgccaagctgcgcaccaagcacgccggccacttcggctccacgtccggggagaagggcaagttcggcctcagcgccgcgcagatactgtccgtggtcaccaagctcaaggccatcggtatgctcgactgcctccagctgctgcacttccacatcggctcccagatcccgaccaccgccctgctctccgacggcgtcggcgaggccgcgcagatctactgcgagctcgcccgcctcggcgcggacatgcgcgtcatcgacgtcggcggcggcctcggcattgactacgacgggacccactcggcgcagaccgacatgtcggtggcgtacagcctggaggagtacgcgggcgccgtggtggccgccgtgggccgcgtgtgtgaccgcaagggggtgcagcaccccatcatctgcagcgagagcggccgcgcgctggtgtcgcaccactcggtcctggtgttcgaggccttctcggctacggcgccgggacgcctggacgcggccacggcctacctcctcgacgagctcacggacgactgccgcgccgactaccgcaacgtgatggccgccgccgtgcgcggcgactacgacacgtgcggcctgtacgccgaccagctgaagcggcggtccgcggagcagttcaaggagggggtccttggcctggagcacctcgccgcggtggacgccttctgcgagctcgtcgcccgcggcatgggcgcgcccgagccgccgcgcacctaccacatcaacctgtccgtgttcacctccctgccggacatgtgggccatcgggcagcagttccccatcatcccgatccagcggctgcaggagcggcccgccgtcgacggcgtgctctcggacctcacctgcgacagcgacggcaaggtgagcgagttcatcggcgggaggcacagcctgccgctgcacgagctgcccacccacgccactcgcggctactacctgggcatgttcctcgggggcgcctaccaggaggccctcggcgggctgcacaaccttttcggcgggcccagcgtggtgcgcgtgtcccagtgcgacgggccccactgctttgccgtgacgcgcgccgccgcgggcccgtcctgcgccgacgtgctccgcgcgatgcagcacgagcccgaggtgatgtacgaggtgctgaagcagaggaccgacggcgccacggccgccgccctcgcccgggccttcggcgcaatgccgtacctggtgttcgaccccgaggccgccgtgatgtccggcggcgagagcagcgactcggagcggtcggccgccggcgccgccgaggaggaagacgatgaggagtgggagttcatgcgcgggctcaccgtctgatga

SEQ ID NO: 418 - DNA, 1598 bp, Zea mays
cggctatgatgaagtcgctgctgccgcagagccagctgcggcgctcggcggcggcggccgcgcggtcgtcggcgggcggcgccgcgggggcagacggggctatgtccgacggcggcggcgcggggccgcgggcgcccgcctcctccaccttctggttcctgctccacgcgctctgctgcctcatctcgctcttcctcggcttccgcttctcgcgtctcctcttcttcctgctcttctccaccaccgcgctctaccgctccagcacctcctcctcctcggccgcggtccttcgcgccaccaccacgacaaccaccaccacgaccaccacgacgacgacgaccaacaccttcacgctctccttcgccgccgccaacactcccccttccacccccgctaaccgcaccgcgctggatgtggccgacaagggggcggcgtccgggaacccacagagtcacgtcgtggtggggaggcacgggattcggatccggccgtggccgcacccggaccccgtcgaggtgatgcgggcgcaccggatcatggagcgcgtgcaggaggaacagcgccgctggtacggcgtcaaggagccgaggcaggtgctcgccgtcaccccgacctactcacgcgcgttccaggcgctccacctcaccggcctcctccactcactccgcaacgtgccgtacccgctcacctggatcgtcgtcgaggcaggcggcaccaccaacgccacggcgtcaatgcttgcgcgctctggcctcactttcgttcacatccccttccctgaccgcatgccccacgactgggccgaccgccacgccactgagaaccggatgcgcctccacgccctacgcgtgatccgcgagaggaagatggatggcgtagttgttttcaccgacgacagcaatgttcatagcatggagctgttcgatgaggtgcagaaggtccagtggatgggtgctgtatccgtcggaatccttgcgcatactggcacggcagaccaactacggctcagcgaggaggacaagcagaatatgcctcttccagtccagggccctgcttgcaactcctcagggcatctgattggatggcacacgttcaactcattgcccttctctgggaagacggccacagttgttggtgaagcagcccctgttctgcccaggggtttggagtgggctggttttgtgttgaactcaaggatgctgtggaaggaggctgacggcaagcctgactgggtgaaggatcttgatgctgtgggcgagaatggcgaggagattgagaacccacttactctgttgaatgatccgtcctctgttgagccactgggcaactgtgggaagaaggtcctactgtggtggcttcgtgttgaagcacgggctgatagcaagtttcctgaagggtgggtaattgagccacctttggaagtcgttgtccctgcaaagcgcactccatggcctgaaacaaccaccgagctgccagccgagttattggatgacaagcaagagcaggaggataggcgcttgtcaagagccaacaaatcatctcggccccgaggcaccacgaagcggaagggcgaccctcaaggacaagataactgataa

SEQ ID NO: 419 - DNA, 3587 bp, Zea mays
gagggatggtggcgatggagggtaagggggacgcgtcagtgacgccggtgaggactagtgaccggctgcggcagcgtccaaagtactatgctcgtggctatatgtactacaatccagccatgaggaagaaggttaagtctaagaagcgaactgctgcatcacagattgctaagaaactgcttcgcaagccagctgcacggccaccacctgccgattgtgttgcagcaaatttgcgccgttcaacgagaaagcgaaggatttctgtaaatctggagggctatgatacagatagttccagtatggaagatgacgatcttatgagacctagatatcgatcttcaaagagtaaggggggaaacaatgctgcacataatgaagtgtcagctagaccaaagcgccagaagttgtctaactccatacctcgtcgtgaaggtttacggcctagaagatctttgcgaggacaaagactgcatccataccatgaatctgaggatgaccaggaaagctctgatgaacaaggtgcagaagatcaaagagaaaatggcaatgagattgaagaggatgttggtgatgaggaggaggttgatggaggtgatgaagctgaaggagatggagatgacgaagatggtgaggaagagcaagaaggaaggaggagatatgatttaagggaacgttcagaggttcgtagaccatcccctcgtaaggaaggaaagcacagaccacaatctcctcgtagagtactagttcacggaattggtccaaagaacagcaagtatttaaaaaaaggtgggtcgcgcatgcataagcgccctcgtttctctttgccagatgattcagatgattcccttcttgtggatgagccggacgagggcccatccatgccatggatgcgcagtgggaggggaagtatgccatggttgatgggtgggttggacatgcatagtccagcagcatggggcctgagtgttggagcatctggttggggtcatcagggtgacacttctacttcactcatgcctggggtgcaaactgctggaccaagttctaagggaggagccgacattcaacctctgcaggttgacgagaatgtgagctttaaagatataggtggactttcggagtacattgatgctctaaaggaaatggttttctttccattattgtatccagatttttttgcaaactatcacatcactcctcccagaggtgttctgctttgtggcccaccaggcacaggaaaaacattgattgcccgtgccttagcctgtgctgcctctaaagctggccagaaggtcagtttttatatgcgcaaaggagctgatgttcttagtaaatgggtgggtgaggctgaaaggcagctaaagttactttttgaggaagctcaaaagaatcagccgtcaattatattttttgatgaaatagatggcctggcacctgtgaggtctagcaagcaagagcagattcacaattcaattgtttcgacattgcttgctttgatggatggccttgattcacgtgggcaagttgttttgattggagcaactaacagaattgatgccattgatggagcattgcgtagacctggccgatttgatcgtgagttttattttcctttacctggctatgaggctcgagcagaaatactggatattcatacaaggaaatggaaggatcctccaccgaaggaactaaagatggaacttgctgctagctgtgtgggctattgtggagctgatttgaaggcattatgtacagaagcagctattagagcatttagagagaagtatcctcaggtctacactagtgatgacaagtttgtcattgatgttgattcggtcagtgtcgagaagtaccactttttggaagctatgtctacaataactcctgctgctcacaggggatctattgtgcattcaaggccactttcaacagttatcgctccatgtctgaagagtcatcttgagaaaataatggaacatatttctgatattttccctttcctttcatccatagattttagcaagttctctgctctctcctatggatcttccatccctcttgtttatagacctcgccttttgatatgtggtggtgaaagtgtcggactggatcatgtgggaccagctgttttgcatgagcttgagaagttctctgttcactctttgggactgccgtctcttctctctgatccaagtgcgaagacacctgaagaagctcttgtgcatatctttggggaagccaagagaacaaccccgtccattctatacatacctcagttccatctttggtgggatacggcacacgaacaactaagggctgtgttgttgactctgttgaacgagttgccctccaaccttccagttttattgcttggaacatcatcagtggtttttactgaccttgaagaagagtgtgcttccatattctcttctcgcaatgtgtatcaagtggatcaaccaagttttgacgatagattgaggtacttcagtatattgtttgagtcattgctctctttccaaatggaagaatcaagaaacaagtcaaagaaacagaagtctgctattgaccttcccaaagccccgaaagaagtggagggccctaaggtttctgagctaaaggctagggcagaagctgagcagcatgctgttcgtcgaatgaggatgtgcctccgagatatctgtaatcgcattttgtacaacaaaaggttcaatgtatttcacttcccagtattagaagatgaggtgcctgactatcgatcaataatccacaagcctatggatatggctactgtcttgcagcgggtggactctggacagtaccttaccagggcagcatttataaaggatattgatcttattgtctcaaacgcaaagacttacaacggggatgactacaatggatctaggattgtcagtagagcatgtgaactcagagatgtggtccaaggcatgttgtcacaaatggacccatctttggtgtccttctgtgataaaattgcttcacaaggggggccactgcaggctgtggatgatgaagatagagctattcttcaagcagcacctgttgctcagctggtttctggtactagaataagtgcaaggcttcgaaatgtacagcctgaagtaaacctgtcacaaagttatgaagtgctaaggcggcaaaagaaaagtgcagaaaatgaacaaagcatgactagagatgaaaagtctcctgaagatgtagatttgtcgaagccaactgacgcagaagaagctgcaaaagaaccagagtcaaatggcactacgaaagaagccaacgattcaccagccaaagaaccagaagtatctacttcccctgaacccatggagagtgacaacggcaaaattgccgcggctactggcgacgacttgttagaacagctagaagccctgaagcaacgcttcatggaactcactgcaagctatggcgtgccgcagctcgagaggctgtattccaagataatgaaaggagcaatagagttgacaagtaaagaaagcaacgaggatcataggcggttagtagttaggtatttgtggacattcgttgagaacagcaacaatttttaataa

SEQ ID NO: 420 - DNA, 3342 bp, Zea mays
cttccctcaccttccagagcccactgctcctcggcggcggcggagatgagcgtgtggaactacgtcgtcacggcgcacaagcccaccagcgtcagccactcctgcgtaggcaactttaccagccccaaccagctcaaccttattatcgcgaaatgtacccggatcgaaatccatttgcttacccctcagggcctccagccgatgcttgatgtgcctatatatggaagaattgcaacgattgagctcttccggcctcataatgagactcaggactttcttttcattgctacggagaggtacaaattctgtgttctgcaatgggatgcagaaaagtcagagctaatcaccagagccatgggtgatgtttctgatcgcattggccgccctactgacaatggacagattggaatcattgaccctgactgtagactcattggtcttcatctctatgatggcttatttaaggttataccatttgacaacaaagggcagctgaaggaagctttcaatatcagacttgaagaacttcaagtactggacatcaaatttctacatggttgtgctaaacctactattgttgtcctctaccaggataataaagatgtgaggcatgttaagacttatgaagttgcactgaaggacaaagattttgttgagggtccttggtcccagaataatgtagataatggtgctggtttattaataccagtaccagctccacttggcggtgtgataataattggcgaggaacaaatagtttactgcaatgccaattccacatttaaagcgataccaataaaacaatccatcatcagagcttatggacgggttgacccagatggttctcgatatttactcggtgataatactggaattttgcatttacttgtccttacccatgaacgagaaagggttactggtttgaaaattgaatacctgggagagacttcgattgcatcatctatttcgtatcttgataatggtgttgtttacgtcggttcacggtttggcgattcacagctggtgaagctgaacctccaagctgatgcaagcggttcatttgttgaaattcttgaacggtatgttaatcttggaccgattgtggacttctgcgtggttgaccttgataggcagggtcaaggtcaggtggtcacttgttctggggcgtttaaagatggttcccttcgggtggttcgtaatggtatagggattaatgagcaggcttcagtagaactccaaggcataaagggattatggtcattgaaatcttcgatcaatgatccatttgacatgtaccttgtcgtgagctttataagtgagacacgattcttggcaatgaacatggaagatgaactagaagagactgagatagaggggtttgatgcacaaactcaaactctgttttgtcagaatgcgatcaatgatcttcttatacaggttactgctaattctgttcggttagtcagttgcacctcccgggagttagtgaatcaatggaatgcaccagcaggattctcagtcaatgttgcttcagctaatgccagccaggttctgttggcaaccggtggtggccatcttgtttacctggaaattagggatgctaaacttgttgaagtgaagcatgctcagctagaacatgagatttcttgtcttgatttgaacccaattggggagaatccacaatatagttccctagctgctgttgggatgtggacagatataagtgttagaatattttcgcttccagatcttgaattgataaggaaggaaaatttgggtggagaaattgttcctcggtctgttctgctgtgcaccttggagggggtttcgtatttgctttgtgctcttggggatggtaatttgttcagttttctactgaatgcaagtacaggtgaactgactgatagaaagaaggttaccctcgggacccaacccatcagccttcgtaccttctcatcaaagggtaccacccacgtgttcgcttcgtcagataggccaactgtcatctatagcagcaataagaagcttctctacagcaatgtcaatttgaaagaggttaatcatatgtgccctttcaatacagccgcttttccagacagtcttgcaattgctaaagagggtgaactttcaattggaactatcgatgatatacagaagcttcatatccgcacaatcccccttaatgaacaagcacgtcgcatttgtcaccaggagcaatcaaggacactagcattttgcagtttcaagtacaaccagagtgtggaggaaagtgagactcatttaatacgtctgctagatcatcagacgtttgagtccctgtgtgtatatcctctagatcaatatgaatgtggctgctccatcattagctgttcgtttgcggatgatagtaatgtttattactgtgtgggaactgcatatgttatacctgaagaaaatgaaccgacgaagggccggattcttgtatttgcagttgaagatggaagcttgcaattgatcgtggagaaagaaaccaaaggagcagtttattcgctgaatgcattcaatgggaaattgttggctgctatcaaccagaagattcaattgtataagtggatgtcacgcgaggatggttcacatgagctgcagtctgagtgtggccaccatgggcacatacttgccttgtatactcaaacacgtggtgacttcattgtggttggcgatctgatgaaatcaatatccttgctggtgtataagcatgaggaaagcgcgattgaagagcgtgctagggattacaatgcaaactggatgactgcagttgagatgcttgatgatgaagtctacgttggggcggagaatagctataacctattcacggtgcgcaagaacagcgatgcggcgacagatgacgaaagggccaggcttgaggtggtgggagagtaccaccttggggagtttgtgaacagattccgccacggttcactggtgatgcgccttccagactcggatatagggcagatccctacggtcatctttggcacaataaacggggtgattggcattattgcctccctcccgcacgaccaatacatcttcctggagaagctccagtcgacccttgtgaagtacataaagggcgtcggaaacctgagccacgagcaatggcggtccttccataacgacaagaagacggcggaggctcggaacttcctcgacggtgacctgatcgagtctttccttgaccttagccggagcaagatggaggaggtgtccaaggcgatgggcgtccccgtggaggagctgtccaagagggtggaagagctgacgaggcttcactagtgtagatggaacatggaagcgttgtag

SEQ ID NO: 421 - DNA, 1904 bp, Zea mays
tctacatggctatggtgccaagtgattcatcacatcatggagctgtggacaatagccctaatggattcacccagggtcggcgtgaggaagctaggaaacttgggccatcatggtatttcagtagaaaggaaatagaagaacattctccatccaggagggatgacattgatttgaagaaagagtgtagccttcgaaagtcgtattgcagttttctacaagatttgggcatgaagcttaaagtgccccaagtgacgattgctacagctacggtattctgtcaccgttttttccttcgtcaatcccatgcaaagaatgatagacgaataattgccacagtttgtatgttcttggctgggaaagttgaagaaacacctagacctttgaaggatgttatcctggtatcttacgagcttattcataagaaggattctacagctggccagagaatcaagcagcagaaggaaatatatgataaacaaaaagaacttattttactcggggagcgaattgtacttgtaacacttgggtttgacctgaatattgaccatgcttacaagcccttggttgaagcaataaggagattcaatgttggtagtaaaagttcgcttcctcaggttgcctggaattttgtaaatgatggactgcgtacttcgctttgcctgcaattcgagcctcatcatattgcagcaggtgctatctttttggctgctaaatttctcaaagtgaagcttccatctgatggtgataaggtttggtggcaggattttgatgtcacaccacggcagcttgaagaagttagcagtcaaatgatggagctgtatgttcagaaccgtacaccacaggcacaacaatcacagggaagcgaagctgaggggagctctgctggtgtgcgtaatcaacattcatctgtaaaatctgaaggaaactccaaggaaccatctgctcatggatatcatccggcattcaaaccgtcgaatttgcatcattcatccttggcaggtgctccaggtgaccatgacagtgggcattcaaattcagacaagcatgtttctggccacaaaatgcttcaaaatgataatggtaaccatgtcggtagcaaagaaaagaacaagagtggaggtaaatcggatgctggtatggatagattttgtcatgagaaatccccacctggacatcattattccaaggtcagccatgagtctcataatccagtggaagaacaaaaaccacatcaatcacatgataaccccaatgaaagaatagatggcattcttggtggcaacgaagttcctggtgtgtcgacctccaggatcgatgcaatgaataaaattgacaagggtaaggtaaaagcagctttggagaagcgaagaaaaacaaaaggtgatattaccacaaaggtagacgtgatggatgatgatgatctacttgagagagagcttgaacatggtgttgaattggctattgaggatgagaagattaagcaggataagatgcagaacttgtcccatattaaggacaagaagattacgcaggataatatgcagaacttgtcccatattaaggacgagcaggataacatgcagaacttgtccgacattaaggatgagaagattaagcaggatgagaggcagaacatgtcccatgctccagtggatcttcaaaccactgaccaagtaatggagaatggtcaccatgtcgagcctagtgtaccaacaactgtggaagacacggggtttccattggacaacaaagaacatcctccatttgataagcaaaatgatgttcctgagcacgagtcccagcagcttgaacacacattgaagcacgacctccctcagctggtaggggggcctgagcaggatgatggaacagactgtaaaaggcctaagctcgaagagtagtaa

SEQ ID NO: 422 - DNA, 1199 bp, Oryza sativa
gcgccatggacgccatgaggcagagcacgccgcgggccatgctgctcctgtgcgccgtgctgatgctggccgtggcgccgccgggcgcggcgacggcggcggcggtggccgggtgcgagtgcggtaatgcggcggcggcggcggtggcgggggaggacgcgcgcggggcgttgcggctcaagctcgtcgccatcgcgtccatcctggcggcgggcgcggcgggggtgctggtgcccgtgctggggaggtcgttcgccgcgctccggcccgacggcgacgtgttcttcgccgtcaaggcgttcgcggcgggcgtcatcctcgccaccggcatggtgcacatcctccccgccgcgttcgacgcgctcgcttcgccgtgcggcggaggcaggggcggcggaggcgggttcccgttcgccgggctcgtcgccatggccgcggccatggccaccatgatgatcgactccgtcgccgccgggtactaccgccggtcccacttcaagaagccgcgccccgtcgacgaccccgccgacgccgcgcgcgccgccggggtcgaggagggcggcgccgagcacgccggccacgtccacgtgcacacgcacgccacgcacggccacgcccatggccacgtgcactcgcacggccacggccacggccacagccacggcagcgcgccggcggccgccacctcgccggaggatgcctccgtcgccgaaacaatccggcacagggttgtctcccaggttctggagctgggaatcctggtgcactcggtgatcatcggggtttcgctaggcgcatcactgaggccgtcgtcaatcaggccactcgtcggagccctcagcttccaccagttctttgaaggcattggccttggtggctgcattgttcaggcaaattttaaggcgaaagcaacagtgatcatggcgactttcttctccctcactgctccggtgggcattgcactggggatcgcaatctcatccagctatagcaagcacagctcgaccgcacttgtcgtcgagggagtcttcaactctgctgcagcagggatactgatctacatgtccctggtcgatctcctcgctgcagatttcaacaatccgaagcttcaaacaaacacaaagcttcagctggcagtatacctcgccctcttcctcggcgctgggatgatgtctctgcttgccatatgggcatgataa

SEQ ID NO: 423 - DNA, 1852 bp, Oryza sativa
ccctgcagtagaagaggaggcggcgagcgagcgagacgccgagccgagcagcgccgcggaggcgtcgtcgtctccggtgggttgcaggaggcgaatgcgatggggtccaagacgaaggggtgctgcgggtggctgatcgtggcgctggtggcgtcgctggtggcgacggcggcggtggtggccatcatgaagaagaaggtcggcggggggagcgggcgcaagctcaagccgctgccggtgcccggcccgcccggggccatcgactccaagtacggcgacgcgctcggggtggcgctccagttcttccaggtccagaaggcggggaagctggagaacaaccagatcccgtggaggggggactcggcgctggatgatgggaaaccagcggggctggatctttccaagggaatgtatgatgctggtgatcatatcaagtttagtttcccgatggccttcacggcaacggtgctctcgtggtccatacttgagtatggagatcagatgagcgccacgaagcagctggaccctgcgcttgatgctctccgatggatcactgatttcctcgtcaatgcgcatccatctgacaatgtgttctacattcaggttggtgatcctgatctagatcacaactgctgggaaaggccggagactatgtctgagaaaagaccactcacacagattaacacaaagtctcctggatcagatgttgctgctgaggcagcagcagctatggcatcagcatcaattgttttcaaatccagagacactacatattctgattcacttcttcaacatgctcagaagttgtttacttttgctgatacttataaaggcctcgccagtgacacctatccaaagctccaaaactactataattctactggttatcaagacgaactcctgtgggcagcgagttggctctatcatgctacaggagaccaaacatacctcagttatgtgactgtagagaatggaaaagcttttgctgattggggaaggccaacatggttcagttgggatgacaaacttgcagggacacaggtgctcttgtcaagattaaatttctttggatccaaacagacatctaatgctgaaaacatgggactcaaaatgtacagagacactgctgaagccgtcatttgtgggctcctaccagattctccatcagctactgccagtaggactggtgggggattggtttggataagtggatggaattctctccagcatgccacaaatgcagcattccttgctgttgtttacagtgactacatgctcacatcgcaaacagcagcagtgcaatgcagtggaaagtactacagtcctacagatatacgcaattttgctatatcacaggctaattacatcttgggagacaacccaatgaagcttagctacctggttggatatgggagcagctacccacagcaggtacaccacagaggggcgtcgatccccgctgatgcaaagacaggctgcaaaggattccagtatcttcattctacgagcccaaacccaaacgtcgccatgggagccctcgtgggcgggccgttccagaatgacactttcgtcgactctcgggacaatgctgttcagacagagtcaagcacttacaacagcggcaccctcgttggtcttctttctggtctggtcacaacttcctctgtggcgcagtcgttcacctagagctctctcagagtttgggcaatggctttgaccaaccgggaggatatacatgtagccatgtacaatgagagatttttggcgtgaccaaaggcaatgtgccatcagcgaaacgccttcacggtgttcttcgttgttcatcttttgggtgatgggtggttagcagtag

SEQ ID NO: 424 - DNA, 1868 bp, Oryza sativa
gcgagatgagcatgtacgggagggacccgtggggcgggccgctggagatatgccacgactcggcgacggacgacgaccggagccggaacctggacctggacaggggggcgctgtcgcggacgctggacgagacgcagcagagctggctgctggccgggccgggggaccagggccggaagaagaagaagtacgtcgacctcggctgcctcgtcgtcagccgcaagctcttcgtgtggacggtcggggtgctcctcgccgccgccgtcttcgccgggctcgtcgccggcatcgccaaggccatccccaggcaccaccgcccgccgccgccgccggacgacttcaccgtcgcgctgcgcaaggcgctcatgttcttcaatgcccagaaatctggaaagcttccgaagaacaacaatgtgcattggcgtggtaactcgtgcatgaaggacggactctcggatccggcagtcgggcgcagcctcgtcggagggtactacgacgccggcgacgccgtcaagttcaactttccagctgccttctccatgaccctcctcagctggagcgtcatcgagtacagtgctaaatacgaggcagttggggaacttggccatatccgtgataccatcaagtggggggccgattacttcttgaagaccttcaactcaacggcggataccattgatcgtgtcgttatgcaggtggggagcggtgcaacatcacccggttcgactcaaccgaacgatcactattgttggatgagaccagaggacattgactaccctcgcccagtagttgagtgccatgcttgttcagatcttgcggctgagatggctgcatcattggcagcagcatcaattgtgttcaaggacaataaggcgtactcgcagaagctggtacatggtgctaccaccctcttcaagtttgcaaggcaaaaccgtggaagatatagtgcaggtggttccgatgctgcaaaattctataactcaaccagctactgggatgagtttgtatggggtggttcatggatgtatctcgcaaccggcaattcatcgtacctgcagttggcaacacaccccaagcttgcaaagcatgctggtgcttactggggtggtccagactacggtgtattcagctgggacaataagcttactggtgcacaggttcttttgagccggttaaggctcttcttaagtcctggttatccatatgaagagatcctcaggacattccacaatcaaacaagcattattatgtgctcttatcttccaattttcaagtctttcaacaggacaaaaggtggtttgatccagttgaatcacgggaggccacaacctcttcagtatgtggtgaacgctgcattccttgcttctttgtacggtgactatcttgaggctgcagatacccctggctggtattgtgggccccatttctacccaattgaaactctgcgcaattttgcaagaactcaaatcgaatacatcttaggaaaaaatcctttgaagatgagctatgtggttggttacggaaaccgttaccctaaacgtgttcatcatcggggtgcctcgatcccaaagaatggtgtccactacggttgcaaaggaggttggaagtggagagaaaccaagaaaccaaaccctaacatcatcgtcggagcgatggtagctggccctgatcgccacgacggcttcaaggatgttcgcaagaattacaactacacggaagcaactctagctggcaatgccggtctagttgcagcattagtagcattgtcaggtgaaggccatggcgtggataagaacactatgttttctgccgtgccgccgatgttcccttcgcccccaccgcctccggcaccatggaaaccatgataa

SEQ ID NO: 425 - DNA, 1424 bp, Oryza sativa
ccattgttgcaacaccaagtgtttgtggtcggaacgagatcgagcagcagccatccatggtgaggaaggagatgggcggcggcggcggcaggctcgcggcggagtaccagggcctggaggtgaaggtacccacgttcttccggtgccccatctccctcgacgtcatgcgctcgccggtgagcctctgcaccggcgtcacctacgaccgcgcctccatccagcgctggatcgactccggcaacaccacctgccccgccaccatgctcccgctcccctccaccgacctcgtccccaacctcaccctccgccgcctcatcgcgctctgggcctccacggccgcgccgtcgtcgccggcggcgccatcggctgttggccccaccccggctgctgcggcggcggagctcctccgccgggtcgcggcgcccggggtggacccgtgcccggcgctgcgcaagctcgcggcgttcctgtctgacgacgacgtcgacgagttcgacaagaacgcgctcgcgagggccggtggcgcggcggagaccgtggcgtcggtgctcaggaggagggggaagggtgatgatgatgatggcggcgtggaagccgtcgaggcggccgtccgggtgctcgcggtgctcgccacgtcggactgcatcgaggaggagaacaggaggcgcgtcgccgccgcgctcgccgcggggggcgccgcgccgtcggtggcggcgtcgctggcgcgcgtgatgcggagcgggagcgggctcgaggcccgcgtcgacgcggcgaggctggtggagtcgctgctccgggacggcgcgcgcggcgccaccgcgccgggggtgagggcggcggtcgccgagtcggaggagctggtcgcggagctgatccggctcgtcggccccacggacgagaagggcagcctcgacgcgcaggccgtggacgccggcctctcctgcctcgccgccatcgtcgccgcgacgcggcgcgcgcgcgccgagatggtccgtctcggcgccgtcccggccgccgtgcgcgtcctggccacggaccaccacggcgggtcgcacgcccaggcgctgcgcgtgctggaggccgccgtggggtgcgcggaggggcgcgcggcggtgtgcgaggtggcggaggcggcgatcccggcggtggtgtcgaggatgatgaggtgcggcgggatgggcggcgcggaggcggcggtgtcggtgctgtgggcggtgtgccaccggtacagggaccggcgcgcggtggaggcggcggcggcgtcggagggcgggctgacgaagctcctcctgctgatgcagagcgggtgctcgccggcggcgaggcagatggcgtcggagctcctcaagatgttcaaggtgaacgccaagagctgcctcgccggctacgactccaagaccacccacatcatgcctttctaataa

SEQ ID NO: 426 - DNA, 1550 bp, Sorghum bicolor
cagccatggagacggcctccttcctctcggtggcgctggccctggcggccctcgtccccgtctcgctgctcctcctgaaccggctcctctacggcaagctgcccccggggccgcggcggcggcccgtggtgggcaacctgttcgacgtgcggccggtgcggtgccggtgctaccaggagtgggcgcgccggtacgggcccatcatgacggtgtggctcggcaccacgcccacggtggtggtgtccacgtcggagctggcaaaggaggtgctcaagacccacgaccagcacctcgccgaccgctgccgggaccgctcgtcggagaggttcagccgcggcggccaggacctcatctgggccgactacggcccgcactacatcaaggtgcgcaagctctgcaacctcgagctcttcacgcagcgccgcctcgaggcgctcagacccatccgcgaggacgaggtcaccgccatggtcgagtccgtctacaaggccgccaccgcgccgggcaatgaagggaagcccttggtggtgaagaaccacctgtcgatggtggccttcaacaacatcacgcggctggccttcgggaagcggttcgtgaacgcggccggcgagctggacgagcaagggcgcgagttcaaggcgatcgttcacaacggcatcaaggtcggcgcgtccctctccatcgcgcagcacatcccgtggctgcggtggctggccccggtcgacgagcaggccttcaaagcccacggcgaccgccgcgaccgcctcaccgtgaagatcatggaggagcaagccaaggccctcaagcagcacggcgcccagcagcatttcgtcgacgcgctcttcactctcagggacaagtacgacctcagcgacgacaccgtcattggcctcctctgggacatgatcaccgccggcactgacacgacggtgatctcggtggagtgggcaatggcggagctgctgaggaaccccagggtgcaggagaagctgcaggaggagctggacgatgtcgtcggccgcgaccgtgtcctgtcggagacggacttcccgaacctgccgtacctgcaggccgtcgtcaaggagtccctccgcctgcacccgccgacgccgctgatgctgccccacagggccagcgccagcgtcaagatcgccggctacgacatccccaagggcgccaacgtcgtcgtcaacgtgtgggcggtggcgcgggaccccgcggtgtgggacgacccgctcgagttccggccagagcggttcctccgggagaacatcgacatcaagggcgccgacttccgcgtgctgccgttcggcgccggccggcgggtgtgccccggcgcgcagctcgggatcaacctcgtggcgtccatgatcggccacatggttcaccacttcaggtggacgctgccggaggggacacggcccgaggacgtgaggatggtggagtcccccgggctcgtcaccttcatggacacgccgctgcaggccgtcgccacgccgcgcctggacaaggaggagctgtaccggcgtgtcccttcggagatctgatga

SEQ ID NO: 427 - DNA, 1826 bp, Sorghum bicolor
ccaagatgattaccgcgacggacttctaccacgtcatgacggccgtggtgccgctgtacgtggcgatgatcctggcctacgggtcggtgcggtggtggcgcatcttctcgccggaccagtgctccgggatcaaccgcttcgtcgcgctcttcgccgtgccgctgctgtccttccacttcatctccaccaacaacccctacactatgaacctgcgcttcatcgccgccgacacgctgcagaagctcatggtgctggccatgctcaccgcgtggagccacctcagccgccggggcagcctggagtggaccatcacgctcttctccctctccacgctgcccaacacactggtcatgggcatcccgctgctcaagggcatgtacggcgacttctccgggagcctcatggtgcagatcgtcgtgctccagtgcatcatctggtacacgctcatgctcttcatgttcgagtaccgcggcgcgcgcttgctcatcaccgagcagttcccggacaacgcgggcgccatcgcgtccatcgtcgtcgacccggacgtcgtctccctcgacggccggagggacgccatcgagacggaggccgaggtgaaggaggacggcaagatacacgtcaccgtgcgccgctccaacgcgtcgcgctccgacatctactcgcgccggtccatgggattctcaagcaccacgccgcggcccagcaacctgaccaacgccgagatctactcgctgcagtcgtcgcggaacccgacgccacggggctccagcttcaaccacaacgacttctactccatggtggggcgcagctccaacttcggcgcggccgacgcgttcggcatccgcacgggcgccacgccgcgcccgtccaactacgaggacgacgcggctaagcccgccaagtacccgctccccgtggtgaatgcggcggcgcccgttcccggggcggcggcgggacactaccccgcgcccaacccggcggtggccgcggcgcccaagaagaaggcggccggcaccaacgggcaggccaagggcgaggacctccacatgttcgtctggagctccagcgcgtcgcccgtgtcggacgtcttcggcggcggcgcgccggactacaacgacgccgcggcggccgtcaagtccccccgcaaaatggacggcggcggagccaaggacagggacgactacgtggagcgcgacgagttcagcttcgggaacaggggcgcgatggacagggacgcggaggcaggggacgagaaggccgcggcggcgaccgcggttgctggcggggaccccaacgcggtagccgcgccgacggcgatgccgccgacgagcgtgatgacccgtctcatcctgatcatggtgtggcgcaagctcatccgcaacccgaacacctactccagcctcatcggcgtcatctggtcactcgtctgcttcaggtggaacttccagatgccggccatcgtcctgcaatccatctccatcctgtcggacgcggggctcggaatggccatgttcagtctcgggctgttcatggcgctgcagccgcggatcatcgcgtgcgggaacaaggtggcgacgttcgccatggcggtgcgcttcctgaccggtccggccgttatggcggccgcgtccttcgccgtgggcctccgcgggacgcttctgcacgtcgccatcgtccaggcagctctgccccagggcattgtccccttcgtcttcgcaaaggagtacaacgtgcaccctgacattctcagcacggcagtcatttttggcatgctcatcgccctgccaatcacgctcgtctactacatcctgctcggcctgtgataa

SEQ ID NO: 428 - DNA, 1820 bp, Sorghum bicolor
tgatctcaagttcttggcattgatgccgttctggtagccagccttctttaacccaccttaacaataactgcctgccgccctgcccccacctctcctctcgccctgcagctgaacctgagctgagctgattcgccgggctctgagcctctgctccacatccatccatccatccatccatccaccttcgcccaaccctgatccagaaccctgtcggtgtcggcgcgccgtgatccggcatcagcagcaggagcagcagcagcagcttccgcgcggggcaccggcggcgcggccatgggcacgggcgcgctcgcggtggcggcggcggcgccggcggaccgggccaacaagcagcgccgggccggcggcggcgcacacctgtggaagaaagcgctgctccacttctccctctgcttcgtcatgggcttcttcaccggcttcgcgccctcctcttcctcctcctggaaggccgccaccaccacccctcacccgccgcaccgtcccggggaccgcctcgccgcctcccgcgtcgccgtcgacgtcaacgcgcgcgccacccttccgccgcccgcgtccgccggcgatgcgctcggtgtcggcggcgccacggtggacgtgggcgacgagtacgaggagggcgacgccaacggccagcgccgacgcctcctgatcgtggtcaccaccacgcggtcgggccccggggagcgccggcggcggcggggcgagctgctgcgcctggcccacacgctccgcctcgtccgcccgcccgtcgtctgggtcgtcgtcgagcccgccgccgacgcgcccgccaccgccgtggtgctccgcggcaccggcgtcatgtacaggcacctcgccttcaagcccgaggaaaatttcaccaccgccgaagccgaggcgcacgcgcagcggaacgccgcgctcgcgcacgtcgagaagcaccggctcgctggcgtcctccacttcgccgacgccgccggtgtctacgacgttgggttcttcgaccagatccgacagatcgaggcgtttgggacatggcctgtggcaacaatgttggctggcgagaagaaagtggtagtagaaggtccgctatgcagtgcctcaaaggtcgtcggttggttctcaagggactttaacgatgggacaacccgttcagtgacgtataacacggaagttgacttgaatcctgctggtgctgctggtacacgagcccacacaattgacgtctcaggtttcgcgttcaacagttcaattttgtgggatcctgagcggtggggacggccaacctcattaccagatacttcacaggactccatcaagtttgtgcaagaagtggtacttgaagaccgagctaagctgaaggggatcccctctgattgctcccagatcatggtgtggcagtatagtgtgcccagctcacaatagagggcagtcgagatgttgcacaataggcgttgcagcctcgcaggaaggggaagaacagcgagtattggaccggagtcgatgtaaatgtggtgggtgataacaaaaggaaaggaagaaggttgattactaagttttttttttcctctcattctcctttggggttccctttttctttctctcagttttggttttcgagtttgggggccatgaatgatgaactgcctgtgggagaagttcgccccccaagcgggaaaatatgcgatagtatttattcagattcatttgtgattctttagcttggtcctgttgcgttcgcgaggcggtgccgcctcacgaatggccctcttgtgggttgcaataataccaatatgtgtagggaggaatgaacttgctgaaga

SEQ ID NO: 429 - DNA, 3714 bp, Sorghum bicolor
gtagctgctgcatccagttccgtcacccggaccggccgccatggcctccaacggcggcgggctccgccacagcaacagcaaccgcctctcccggatgtcctactccggcaccggcgacgacgcccgcgcgcaggccgccgtccccggcgaccgtcccatggtcaccttcgcccgccgcacccactcgggccgctacgtcagctactcccgcgacgacctcgacagcgacctcggcaacgccggcatcggcgacatgtccccggaccgcgacgaccagccgcagcagtacgcgagctaccacgtccacatcccgtccacgcccgacaaccagcccatggacccggccatctcggcgcgcgtcgaggagcagtacgtctccaactcgctcttcacgggcggcttcaacagcgtcacgcgcgcgcacctcatggacaaggtcatcgactccgaggcctcacacccgcagatggccggcgccaagggatcctcctgcgccgtcaatgggtgcgacgccaaggtcatgagtgatgagcgcggcgacgacatactcccctgcgagtgcgacttcaagatctgcgccgagtgcttcgctgatgccgtcaagaacgccggcgccgtctgccctgggtgtaaggagccgtataagagcacggagctcgaggacatcgtcggcgctgccaacgccggggccggagctaggcctacgctctcgctgcccccgccgcctggcgccgccgcgtctaggatggagaggaggctatccattatgcgctcccagaaggccatgactaggagccagactggagactgggaccacaaccgctggctctttgagaccaaggggacgtatggctatggcaatgccatctggcccaaggagaatgaggtggacgccggaggcgttggtggaggcggaggtggagctgatggccagccggccgagttcaccaccaagccatggaggccgctcactcggaagctttccatccctgctgccatactcagcccatacaggcttctcattcttatccgcatggtcgtccttgctctgttccttatgtggagaattaagaacaagaatgaggatgcaatgtggctctggggcatgtctgttgtctgtgaactctggtttggcttttcatggctgcttgaccagctgccaaagctgtgccctgtgaaccgagccaccgaccttgctgtcctgaaagacaagtttgagactccaacaccgtcgaaccctactggacgatcagatttacccgggcttgacatatttgtgtctacagctgatccagagaaagaacctccattggtcacagcaaacactatcctgtccatccttgctgctgactaccctgtggagaagctttcttgctatgtttctgatgatggaggggctctcctgacttttgaagccatggctgaagctgctagctttgctaatatgtgggttcctttctgtcgcaagcacaacattgagcctcgcaatcctgacagctacttcaatcttaagaaggacccttacaagaacaaggttcgccaggattttgtcaaggacaggaggagggttaagagggagtatgatgagtttaaggtcaggatcaatgcgctgcctgactcgatacgccgacgctctgatgcgtaccatgccagggaggaaatcaaggctatgaagaggcagcgagagactgctcttgatgatgcagtagagcctgttaagatcgctaaagccacctggatggctgatggcactcattggcctggtacctggattcaaccttctgctgagcatacccgtggtgatcatgctggaataattcaggtgatgctgaaacctcccagtgatgatcccttgtatggcagcactggtgacgaaggcagacctcttgatttcactgaggtcgacatccgtttgccaatgttggtctatgtgtcccgagagaagcgccctggttatgaccacaacaagaaggctggtgcgatgaatgccctagtccgttcatctgctgtcatgtcaaatggccccttcatcctcaacctcgactgtgatcactatgtttacaactcacaagctttccgcgagggcatgtgcttcatgatggaccgtggtggtgaccgtattggttatgttcagttcccgcagcggtttgagggcattgatccatcagatcgctatgccaaccacaacactgtcttctttgatgtcaacatgcgcgcactggatggtatcatgggaccagtctatgttggcaccggctgtcttttccgccgcgttgccctctatggatttgaccctccccgctccaaggaacatggtggctgctgcagctgttgcttcccccagagacgcaagatcaaagcttcagctgctgcaccggaggagacccgggctctaaggatggcagactttgatgaggatgaaatgaacatgtcatcattccccaagaagtttggtaactcgaacttcctcatcaactccattccaattgcagaattccaagggcgtccgctagctgatcaccctggtgtcaagaatggccgtcctccgggtgctctcactgtcccccgtgaccttcttgatgcatccacagttgctgaggccatcagtgtcatctcatgctggtacgaagacaagaccgagtggggccaccgtgttggttggatctatggctcagtcacagaggatgtggtcactgggtaccggatgcacaaccgtggttggaagtctgtgtactgtgtcaccaagcgtgacgccttccgcggcaccgcacccatcaatctgactgaccgtctccaccaggtgctccgttgggctaccggttcagtggagatcttcttctcccgcaacaatgctctgctcgcaagccgcaggatgaagttcctccagaggatcgcctacctgaacgtcggcatctacccattcacgtccatcttcctgatcgtctactgcttcctgccggcactgtccctcttctcggggcagttcatcgtgaagactctcaatgtggcattcctaacctacctgctggtgatcacactgacgctgtgcctgctggcggtgctggagatcaagtggtcggggatcagcctggaagaatggtggcggaacgagcagttctggctgatcggcggcacgagcgcgcaccttgcggccgtgctgcagggcctgctgaaggtggtggcgggcatcgagatctccttcacgctgacgtccaagtccggaggcgacgacgtggacgacgagtttgcagacctgtacatcgtcaagtggacatcgctgatgatcccgcccatcgtgatcatgatggtgaacctgatcggcattgccgtgggcttcagccgcaccatctacagcgagatcccgcagtggagcaagctgctgggtggtgtcttcttcagcttctgggtgctggcgcacctgtacccgttcgccaagggcctgatggggcggagagggcgcacgcccaccatcgtcttcgtctgggcaggactcctctccatcaccatctccctgctgtgggtcgccatcaacccgccatctgggaaccagcagattggtggatccttcaccttcccctgaagctcttgccagtttcattgtcgcatggaatggaatggaatggaattcttgctttgtaccagctccagcagcgtttcatcctcagactcagagctgctgcgggaagtgggattctgactgtcgaaatggctagg

SEQ ID NO: 430 - DNA, 950 bp, Sorghum bicolor
gcggtatggagcccatgaacgtagacaacggcggctgcggcggcctggacgcgcagatcgagcagctgatgcagtgtcgcccgctcgccgagcaggaggttaaggcactgtgcgagaaggccaaggagatattgatggaggaaagcaacgttcagcctgtcaagagtccagtgacaatatgtggtgatatacatgggcaattccatgatcttgtagagcttttccgaattggcgggaagtgtccagacaccaattacttatttatgggggattatgtagatcgtggctactattctgttgagactgtcactctgctagtagcactaaaagtgaggtacccacatcgaattacgatccttcgtggaaaccacgagagtcggcagatcacacaggtgtatggattttacgatgaatgcctacgaaagtatggcaatgcaaatgtatggaagacatttacggatctttttgattattttcctctgacagctctggtggaatctgagattttctgccttcatggtggtttatctccatcaattgaaaatcttgatagtgtgcgcagcttagatcgagtccaagaggttcctcatgaggggcctatgtgcgatcttttatggtcagatccagatgatcgatgtggttggggcatatcccctcgtggtgctggctacacttttggccaggacatatcggagcagttcaatcacacgaacaatctcaaacttgtagctcgggctcatcaattagttatggagggatataactgggctcatgaacaaaaggttgtcaccatattcagtgctccaaactattgctatcgatgtggcaatatggcatccattttggaagtcgatgactgcaacagtcacacattcatccagtttgaaccagcccctaggagaggtgaaccagacgtgacgcgaagaacaccggattatttcctttgatga

SEQ ID NO: 431 - DNA, 1300 bp, Sorghum bicolor
gcctagctatctatctatccaccgatatataaacctctctagtctagactagaaaccaacatctatctatccattctttgaagagatcgatcgaaggaccgatcgagatagctaggatgccaacagcagagacgacgacgcccgtgccgccagcgctctccgggcaaggccggacagtttgcgtcaccggagctggagggttcatcgcctcctggcttgtcaagcgcctcctcgagaagggttacacagtccgtggcacggtcaggaaccctgtcgatccaaagaacgaccacctgagggcccttgacggcgccgccgatcgcctcgtcctcctgcgtgccgatctgctggatccagaaagccttgtcgaggccttctccggctgcgacggcgtcttccacgccgcctccccggtcaccgatgaccctgagatgatgatcgagccagcaatccggggcacacaatatgtgatgacggcggcggcagacaccggcgtcaagcgcgtcgtgttcacgtcctccatcggcacagtgtacatgaacccctaccgtgaacccaacaagcctgtcgacgacacctgctggagcgatcttgagtattgcaagaatacacagaactggtattgctacgccaagacagtggcggagcagggcgcatgggaggtggcgcggaagcgaggcctggacctgatcgtggtgaacccggtgctggtgctgggtccgttgctgcagccaacagtgaacgccagcacggaccacgtgatgaagtacctgacggggtcggccaagacgtacgtgaacgccgcgcaggcgtacgtgcacgtccaggacgtcgcggaggcgcacgtccgggtgtacgaggcaccctacgcgcatgggcgctacatctgcgccgagagcaccctccaccgcggcgagctctgccgcatcctcgctaagctcttcccagagtaccccatacccacaaagtgcaaggacgacgtgaaccctccggtgacaggatacaagttcacgaaccagcggctcaaggatcttgggatggactttgtgccggtgctgcagtgcctctacgagacagtgaagagcctccaggagaaaggcatgctgcccgtgcttccgccaaaagacgaccaggaccaacaactccacaaatcatgattatttccaacgctgatactgctacaacatatcatatatatttatatataagctatagcggattgatataatgaacccagctttttatccacgatatatataaatgatgtacacgtggtgactttaactggtgcatgctttcc

SEQ ID NO: 432 - DNA, 2381 bp, Sorghum bicolor
gggccatggggtcgtctggctgtagctctgagatagttgagtccaccgaggaattcgacagtacaccctttggtggatccagcttgctgcatattaaactcaaagatgaagagaagcgcggcaaatgtcatgattatcctgtggaagatgacctcgaccagcttcttaaagctattgatagcaggaccttccgaagggcgcttagtcctggcagcacaggtggaaatgcgctggggaatagtgttctcaagaaaccagctaggtctgggttgtctcaaagtgcaggcatcgggatatcctctaagactgttaatatgaagcaagcgctgagaaggctatgcatttcccaggcatcggaaatggctgcaatgaagaggttgtcgatgtcacctggatcttcaagttcatccgaagctgggactatccacaggctttatgcctctttgatggtccaaagtagttctgagggtcttctgcatgatgatgagaagatgaacctgattgaaatatcgctcactccagagaagattggttcatctagaggtacgagtgagttcagcgaagactgtgaatttgagacagctgatggaagtgcagtcacctctacctctatctgttctgcttcgtcaacctccgctgagattaggaagatcagaatccaagatgtaatcagtggtgaccctatggataatgagagttccttggtggaaaatggtaaactaggaagtaaattttctgtagctactgatgatggctctcccagagtcccaatcttgagcaaacctatcactacatcccgacttgtgaagccagtctttcgatgcaagccttctggtaagaagaaagtgaaagaagaaccatcttcgttgggtgattcctccaatagtactaaattctgctcttcaaaggagtcaatctccctcgcatcaaccagctgctcttcaacatctagtgttacaaatcccaccagctgtgcagaagaagagaaatcaactccaggaccagaaaaatctgatggaacatcttctgagtggttggcagaggaaaagggcgagtgttcccagaattcaaagagcagtattagtgagtatggttgtagcacaagtatcagcggcgagagccaatttggattgtgtggctatagtaacaggccacacatggcaaaggatctgcggtggctaaccattcgtcagttggcattgcaacagggttccttaggactcgacaatttcaagcttctgaagaggcttggttgtggggacattgggactgtatatcttgctgagttggttgattcagattgcttatttgctttgaaggttatggacattgagtaccttattaatagaaagaagatgctacgagcacaagctgagagggagatattagaaatgctagatcatccatttctcccgactctttatgcccattttaccacggacaatctctcatgtttggtcatggagtactgtccaggcggtgatttgcatgttcttcgtcaaagacaacctggaaaaagctttccagagccagcagcaaggttttatgttgcagaagttctccttgctttggaatatcttcacatgctaggggtcatataccgtgatctaaagccggagaacattctagtccgtgaagatgggcatataatgttatcagactttgacctttcactgaggtgctcagtgaatccagtgctccttcggtcatcttctattacagcaaatcaccaaccaaggaaacttacaggaccttgtgcagagaactactgcatcaattcgtcttgcctccagcaaccctcttgtgcccaaacatcttgcttcacaccacgactaccatcaattccaaagcctcggaagcccaagtcctcccagaaaaggcttcctcagcttgttgtagagcctactgatgcacgctctaattcctttgttggcacacatgagtaccttgcaccagaaatcatcaaaggggatggccatggaagtgctgttgactggtggacctttggcgtcttcctttatgaacttttatatggcaagacacccttcagaggacctgggaatgatgaaacattggcaaatgtggtctcacagaatctccggttcccagacaatccatctgtgagcagcaacgccaaagatctgatcagaggtttactggtgaaggagcctgagaacagatttggatcgttgagaggagctgctgaaatcaagcagcaccctttctttgaaggattgaattgggctctgattcgttctgctgctcctccagagacacaaccttgcaacgtcgtgactcttgccaaagagcggaagaaagaaggcaaatgcctggagttcagaagcaactccgaggaccttgaatttgaagttttttagtaa

SEQ ID NO: 433 - DNA, 1751 bp, Sorghum bicolor
gccgcatggacatggacatcaaggagcggatccgccgctcgccgccgccgacgccgaaggcggtaggggaggcggcgtccgcgcccgggcacccgcgcgggaggaagggccgggtcgcgctgctgcccctgtcgatcgcggcgctcgtggcgtgcggggtcacgctgctgctgctcgcgggcggctccgcggcgaggaggggcggccaattctccggcgcggatcgtaccactctctccggcgccggcaacaacgaccgtggcggccttgaccaggccggaccgcgcgatggagagcatgaaactatggtgtcttccaaagttcaaagggacagactaattggtggcttgttagctcctggttttgatgaacagtcatgtctaagtagataccaatcagcattgtaccgtaaagaatcgccccatttgatatcatcataccttctggaaagactgagagaacatgaggttctccagaagaaatgtggcccgtatacagagtcatacaagaaagctattgagcaactaaaatctggtcaggatgttatggttggagattgcaactttttggtatgggtatcttatagtggtcttgggaacaggatcttgactattgcctcagcatttctctatgccatccttacaaacagagttttacttgtagatggagataaaggcactgcagatcttttctgtgaaccattccctgaaacttcatggttattaccaccggatttccctattattcaatttaagaacttcagtattggctcccccgagagtcacggaaacatggtgaaaactgaagctattcattctgatggttcttttaagggtcctaaacctgcctttctatatcttcacctggctcatgactatgatgattatgataaactttttttctgtgagcatagtcagcaacatcttcagaagatcccatggctgatcttaagatccgataattactttgtaccttcactttttctgatcccatcataccaagaggaactcacgaggctgtttccgcagaaagatgtcgttttccatcacttgggacgttacttgttccaccctaccaatgttgtctggggcttgattacaaggtactacgattcttatcttgccagagctgatgagaagttaggtatccagatcagagtcttcgatactgaaaccggtccatttcagcatgtcttggatcaggtccttgattgcacactgaaggaaaaattactaccagagattaacgcacaacagccgattatctcgacagggaacatcaggtccaaagttgttctgattacttctttgaactcaggatactatgaaagaatcaggaacatgtattgggaacatccaacagagagtggtgagataattagcttccaccagccaagtcacgaggagcatcaggattcagacaagaaaatgcataacatgaaagcattggcagagatttatctgttgagcttatctgatgttatggtaacaagtgcatggtcaacttttgggtatgtagctcaaggtctgagtggttcgaagacgtggctaatgttcaagccggaaaaccgcactgcgcctaatccaccttgccgtcaagttatgtctatagagccgtgctttcatgctccacctttctacgattgcaaaactaggaagggaactgatacaggaaagcttgttccacatgtaagacactgtgaagatatgagctgggggctcaagctagttgatacgggtgagctgtagtag

SEQ ID NO: 434 - DNA, 1523 bp, Sorghum bicolor
cccccatggcggtcggcggcgacgacgacagcatggagcgggacttcgctgccaggctgcgcctcgcgcattcgccctccccggcctcgcctgctgccgccgcttcctcctcccccaccgcagccggggggatcgccttccgcgcgccgcaggagcagttcaccgccgatgacttcgtactcggcaagatctacggcgtcggctcgtactccaaggtggtgcgggccacgaagaaggacacgggccgcgtctacgcgctcaagatcatggacaagaagttcatcaccaaggagaacaagatctcctacgtcaagatggagcgcatcgtgctcgaccagctcgaccacccgggcgtcatcaggctcttcttcactttccaggacacatactccctctacatggcgctggagtcgtgcgaaggtggggagttgttcgaccaaattgtccggaaaggtcggctctctgaggacgatgcacggttttatgctgctgaaatcgttgatatattggagtatttgcatggggtcggcctaattcatcgggacgtcaagccagaaaatctactgcttacttctgatggacacatcaagatcgctgactttggtagtgtcaagcctacaagggatactccaatcaaagttctcccaaattcaactactgaaagggcatgtacatttgttggaaccgctgcatatgtaccacctgaggtcctgaactctgccccagcaacctttggaaatgatttatgggcattgggatgcacactgtaccaaatgctttctggctcgtcgccgtttaaagatgccagtgaatggttaattttccagagaatcattgcaagggacctcaaatttccagagtacttttcagctgaagcaagagatcttattgacaaattgctggatgttgatccaagcaaaaggccaggtgcaggacctgatggttattcttccttgaaggcgcatcctttcttcagaggcatagactggaagaacctgaggaagacacgaccacctaagcttgcatttgatgcaaatgcaaatgaagatgaggatggccaggattcaaattggttggcacacatgggaactgtggcagtcaaccaacagtcaaatactgttggtaataatggtgccccatcatcatctgaagtgcgctcccatatatctaaattatcttccatcgactcctttgactcaaaatggcaagaattcctggaccctggtgagtctgtagtcttgatatcaaagctgaagaagattaataagctagcaaacaagaaggtccagttgatcctcactgacaaacctcaattgatatgtgttgacccttcaaaaatggtggccaagggaaacattatttggtctgatgacccaagtgaacttagtgtgcaagtatcagattcttcacattttagaatatgcacgccaaagaaggtgtcaacgtttgaggatgcgaaacagcgtgcctggcaatggaagaaggcaattgaagacctccaacgcggccaaaggaattgatga

SEQ ID NO: 435 - DNA, 733 bp, Sorghum bicolor
gatctcacctgacctcgtcgccgcctgccgtgggagggagaagaggaagaggaagaggaggcggcggagatggcaccggtgtcggcgctcgccaagtacaagctcgtcttcctgggggaccagtccgtcggcaagaccagcatcatcacccgcttcatgtacgacaagttcgacaacacctaccaggctacaattggtattgattttctgtcgaagacaatgtaccttgaagatagaactgtgagactccaactctgggatacagctggtcaggaaaggttcaggagtttaattccaagctatatcagagattcttcagttgctgtcatagtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcgatagaggaaggggaaggtaaggcgaaggaccttggcgtcatgtttattgaaaccagtgctaaagctgggtttaacattaaggcgcttttccgtaaaattgctgctgcacttcctggaatggagacactctcatcagcgaagcaggaagacatggttgatgtgaacttgaggtccggcaatgcaaactcgtcccagtctcaggctcaggctgggggatgcagttgttagttgcagtctctgacacttgctgctcatgatctctgag

SEQ ID NO: 436 - DNA, 1766 bp, Sorghum bicolor
ccccaatggcgtctgcttctcttgcgtcttctctcttgtgcagcagcagtgcttctaccagtagaagcgcagccatgccaagagtaatcaggatcccaattttctccaagaaccagtacagaccgcctcttcggcctcttaggagagtagttaggcgatcattgcagcaggagcaagagcagagggcgtcccccgtctccgtggcctccggcgagcaacaggaggaggcgacggcgtcgcatcatgtcggaggggtggacgaggccaaggcgtcgggtcatgttggagaggcagacaagggaggccaaggagaaggcgacggtgaggagaagaggagcaccgacgagcagcaggaggtggactggaagtcagacgaggagttcaagaagttcatgggcaatccctccatcgaggccgccatcaagttggagaagaagcgcgccgacaggaagctccgcgagctggaccgcgagcccgacgccaaccccgtcgccggcctgttccggggcttggcaaaggaccagctggcccgggagaagcagaggctggagctggcggagcagaccttcaaggcactcgacctcaacaagctaaagagctgtttcgggtacgacacgttcttcacggtggacgtccggaggttcggcgacggcgggatcttcatcgggaacctgcgtaagcccgtggaggaggtgcggccgaagctggagaagaagatctccgaggcggccggaacagaggtcaccctgtggttcatggaggagaagaaggacgacatcacaaagcaggtctgtatggttcagcccaaggcagagatcgacctccagctcgagatcaccaagctgagcacgccgtggggatacctcagcgccgtggcgttggcggtcacgaccttcgggacgatcgcgctcatgagcggcttcttcctcaagcccggcgcaacgttcgacgactacgtctctgacgtgcttcctctgttcggcggcttcctcaccatactcggcgtctctgagatcgcgacgaggctgacggcggcgaagtacggtgtgaagctgagcccgtcgttcctcgtgccgtccaactggacggggtgcctcggcgtgatgaacaactacgagtcgttgctgcccaacaagaaggccctgttcgacataccggtcgcgcgcgcggccagcgcgtacatcacgtcagtggtgctggccgtctcggcgttcatcgccgacggcagcttcaacggcggcgagaacgccctgttcgtgcggccggagttcttctacaacaacccgctgctgtcgttcgtgcagctggtgatcggcccctacgccgacgagctcgggaacgtgctcccgaacgcggtggagggcgtgggcgtgcccgtggacccgctggcgttcgcggggctcctgggcatcgtggtgacgtcgctgaacctgctcccgatcgggcggctggagggcgggcggatcgcgcaggcgctgttcgggcgcggcacggcggcgctgctgtcgttcggcacctccgtcctgctgggcgcgggcgccatcagcggcagcgtgctgtgcctggcgtggggcctcttcgccaccttcatccgcggcggggaggagatcccggcgcaggacgagatcacgccgctcggcaacgaccgcttcgcgtgggggttcgtgctcgccctggtctgcctcctcacgctcttccccaacggcggcggcacctactctgcctccttcctcggcgacccgttcttcagaggcggcatctgatga

SEQ ID NO: 437 - DNA, 812 bp, Sorghum bicolor
gtgcaatggagaggcctgcgcaggcgcccacgcagctgccgccggggttccggtttcaccccaccgacgtggagctggtagtgctgtacctccgccggcaggccctggctcgcccgctgccggccgccgtcatccccgtcgtccacgacgtcgccaggctcgatccatgggacctccctggggcaagcgaaggggagggctacttcttcagcctgctgcggcgagcgccggcgaccggccgtggcagccgcaggaggagagctggaagcgggtactggaaggccacggggaaggagaagccggtgttcctgcagtgcggcggcggcgttggcggcaaggggcagctgctcgtgggcgtcaagacggcgctcgccttccaccgcagtgagccgccggcgccgtcgtcgcggaccggctggatcatgcacgagtacaggctcgccgtgtcccgcggcgtggccgagcagagagagaagaatgcgagccagggttgcgttgctgcgccgggagagtgggtcgtgtgccgggtcttcctgaagaacggagcaagaagcaggccgaaccgggatgccaacagcaaagctctgggacaccgcgcctccgctgcgccgccgcagccgccaccgcagcaccgggaagatgtgggaggacgacggcagcagccgttgctactctcgtcgtcgcagtcgtcgtcctcgagctgtgtcaccggcgctaccgacttggcagaccaagacgacgaagtcagcggcggcggcggcggcataagcagagataccccagctgaccctcaaagagaggcctactagtaa

SEQ ID NO: 438 - DNA, 1147 bp, Triticum aestivum
cagcgagagacaagtgttgtgtctgcgttgagagggagaggcagggagaaaggcggccatgaccaccggcgggaacggggaggagcagcaggggcggaggctgttcggcgtctcgctcacggacaggcccgtgtggcagcagttcctcatctgctcctccggcttcttcttcggctacctcgtcaatggcatctgcgaggaatacgtctacaaccggctccagttcagctatgggtggtacttcacgttcgtgcagggcttcgtgtacctggggctgatccggctgcaggggttcacggtgaagcacatggtgaacccgtggcggacctacgtgcgcctctccgccgtgctcatgggatccaacggcctcaccaagggctccctcgccttcctcaactaccccgcccagatcatgttcaagtccaccaaggtgttgccggtgatgataatgggagcatttatcccaggattaagacgcaagtacccgttccatgagtacgtgtcagcggtgatgctcgtcatcggcctcatacttttcacgctcgcggacgcgcaaacgtcgcctaatttcagcatgatcggtgtggccatggtgtccagtgcactcatcatggatgccttccttggtaacctgcaggaagccatcttcaagatgaacccagacaccacacagatggagatgctgttctgctcaactgttgttggcctgcctttcctcgctgtgccaatggtgttaacaggggagcttacgacggcgtggagtgcgtgttctcagcacttgtacgtgtacgccgtgttggttttcgaggcgatggcgacgttcgtcgggcaggtgtctgtgctgtccctcatcgcgctcttcggggccgcgacgacggccatggtaacgacggcgaggaaggcggtgaccctgctcctgtcgtacctgatattcacaaagcccatgacggagcagcacgtcacggggctcctgctgatcaccatggggatcgtgctgaggctcctgccggaggacaaggagaagaaaggcatggccgagcgccagcaggcgaaggcgcagcgcggcgaggagaagcggcggggagacggagtagaggaggagacatcgcccttggtatgatcggtgacttggatgagctgaacgaat

SEQ ID NO: 439 - DNA, 1148 bp, Triticum aestivum
ggaggatggtgaaggccatggcggggtgcccggcgaagatggggttccggatgcccgccgagtgggagccgcacgagcagtgctggatgggctggccggagcgtccagacaactggcgggagcatgctgaaccagctcgaaaaacatttgagagaactgcaatggccatttcaaagtttgagcctgtcaccatttgtgcaagtgccaaacagtatcctcgtgtccacgagctgatggaacaccaaccgaacatcagggtggtcgagatgagcatgaatgattcctggtttcgtgacaccggtcccacttttattacccgtgaaggcggatcagatataggacttgcagagcaaacaatagcggggattgactgggaatttaacgcatggggagggctcggtggtggttgctttgatgattggagtcttgacagaagcattgccaagaagatagttgagattgagaggatccctaggtttgcacacacaatggttcttgagggtggaagcattcatgtagatggagaaggtacatgcattacaacagaagaatgcttgttgaatcctaacaggaaccctcacatgactaaactagagatagagaatgagctgaaggatttccttggagtcacaaagatcatttggatacctctggggctacacggtgatgaggatacaaatggccatgtggacaatctatgctgtttcatcaaacctggtgtgattctcttgtcgtggaccgatgacgagaacgacccgcagtacgagatatcggtgaaggcactatcagctctcactcaggcagtcgatgcgaaggggcggcagatagaggtggtgaagatccacgtgccagggcctctgtacatcacgaaggaagagggggaaggtgttcttgcaacggggcatgctgtaccgagggtaccaggcaagagattggccgcctcatacgtgaacttctacccggcgaacggcggggtcatagcgccagccttcggcgataagaagagggacgaggaagcgcgcgaggtcctccagaaggtgtttcctgatcatgaggttgtgatggtggaaggcgcaagggagatcgtgctgggaggtgggaacatacactgcatcacgcagcagcagccggtgcgcccgtcatagtaa

SEQ ID NO: 440 - DNA, 822 bp, Triticum aestivum
ggcacgagaaacagagagagctccggagatgtcggcggacgagttgcggctggacctggaggagctgctgcggctggagggcctcgccaagcgcccccgcgtcgtctccctcctctccaacgagatccgcagcgtcgacgccaagctggcctcgcgggctgcgcctgtgcctgtgccgacgcccgcgccgcaggcggtcgcggtcgcggcggcggcccctgctggtctgagctatgtcacgctggggtcattcagctgggaccaggacaatgagaagatcagggtctacgtattccttgagaatgtcgaccaagagaaggtggagactactttcaagccaatgtcagcggacatcaagtttcatgatgttaaaggcaagaactataggtgtgccatcccaaaactgaacaaagaaatagttcctgagaaatgcaaggttgtggtcaagcctacgaagattgtcatcaccctgtggaaagcttcttccggcaattggttggatctacactacaaggaagacaagtttaagccaagcatggacaaagagaaggatcccatgtcaggaattatggatttaatgaagggcatgtatgaggaaggtgatgaagatatgaagcgcacaatagccaaagcgtggtctgacgccaggtctgggaagacggctgatccaatgaagggattgccttgagctggtggtagttttggttccgagagctgctatatgtgctgagctagtccgtacattcagtgtggtttactagagtagtgtcatgagtatccgcatcgcatgtgtgagatcgatacctgtctgatgatgatggg

SEQ ID NO: 441 - DNA, 1799 bp, Arabidopsis thaliana
cggaaatggtgaggattaagaaagtagaatcgttctacgcgaagcttcgtgagtcagctacttcattatcttcacagaatccacttttgatatttccttcaacatctgatgttgattcactttgtgcgcttaaggttattactcatatccttgaatcagattcgattcagtattcttgtttccctgtatcgtcttttttggagattcacaagtatgctggtcctgctggtttgtgttctacttcgttggagagtcctcctgttactatactgttgattaattggggttgtcaccgtgatttgaagcttgtgttgaagttaggtccttcggctcgtgttttcgttgttgatagtcataggcctattcatttgcataatcttagtgattataatgagcaagttgttgttcttcatactgatgatgatgagaggcaaggtgatttggcttatgatttcgatgtgttgaaattggcgaatgagagctttcagttacgtgtagaagatgctggtgaagaatctgatgaggaggaggaagatgaggaagaggatgaggaggatgatgatgatgatgatggtgataggccaagtaagaggaggaaaatgggagatggtgtgaaggttttcaagaagctaaagagggattattacaagatggggacttttcatgggaagccatcggggtgtttgttgtttgagctatctcatatgttgaggaagaacactaacgagttgttgtggctggcttgtgtttctttgactgatcagtttgttcatgagaggttgactgatgaaagatatcaagctgcggttatggagcttgaacaacacatcaatagctcagggaatatagataagatcactagtgttactctgaaagatggaaccaaggttcgagcaccagactgttcaagaatctcttatgaagaagagcctaggcttatgcttcttagagagtggacgttgtttgactccatgctttgttcttcatacattgcgactaagttgaagacatggagtgataacggtatcaagaaacttaagcttcttctagcgcgtatgggatttgcacttatcgagtgtcagcaaaagtttccgtacatgagccttgaggtgaagaggaagatgaagcaagagtttgatcggtttttgccagaatatgggcttaatgatttctactaccggagtttcttgcggcttcatggttatagctcaagggtctctgctgcagatgttgtctatggtattacagcacttcttgaatcatttcttgggtcaggtggctcctctgcttcaaaacagtttggtgaagcttatgatgctctgtctttgaacaatttggataaacttcgatctgggatgcaacaagcaatcaaggttcaacgagcaattcttagacaaggaagtgcagcaatcactaaaagtggatgcattcgaagtggtaggaaattcagatgggtaaagattgaagattcaatggatgcgaagtatttgggatatcctcaggccttaacaaaattctgttactttctgatggatgctttgagagagaaaggagctaggatgaaaccaatgctatgtgcctgcgcatctcaacaacctgggaagatactcgtggttggggtttgtgggaaaccgaggctcggggcagtcagagggaatgcttttggcaatgctttcagaaaggcagctcaagaaagtagagctgattactttcacgagctattcgagtcttcttggattgtcttggatgcttctgcagttaactctttcatgattagattaaccgagaagctctgataa

SEQ ID NO: 442 - DNA, 1799 bp, Hordeum vulgare
ggtaccctgcaatggatgcgccaaaggacgcatctccggcaccgaagctgcacacgaggctgagggtgtgggagtttgcagaccgctatgtatttgagccggtcgatggccttgccgacctctacctctcagtaagccggaccaatggatctatgaacctagtgcaagagctgccaccgcgtggcccctcggcaaatccaaaagttaggatagtttttggtgtgataggagtgctcaaacttgcagtcggatcatgctgtctggtcatcactgaccgtgattgcgtcggatcctacatgggacatgctgttttcaaagttacaggactaaaggttctgccttgcactaccgcatcttcggccgagcagaaaaagatggagactgagttttcagacctcctggatgctgcagagaggagtataggcctgtacttctcctatgaggccaacttgacacttactttacagaggctatatgatcttggcgacacgttcaaggcacttccactttggagacaggcagaacgtagatttatgtggaatggttacttgttggagcctctcattgagaacaaactggaccaatacctattaccggtcgttcaaggaagttttcagaatatacatgcagaagttggatcagataaagtactagtaaccatgattgcacgcaggtgcacaagaaggataggtacacggtgttggagacgaggtgctgatccagagggctatgcagcaaattttgttgaatcagagcagataatgcaaacaaaaggatatacagcatcctatgtacaagtccgaggctctatgccttttctgtgggagcagatagttgatttgacatataaacccagttttgacgttgttagagtagaggaggcggctcgtgtgcttgagcgacactttcatgatttacaaaagaaatatggagctgtcgtggctattgatcttgtcaatacaactggtggtgaaggccgcctctatgaaagatatgcaaaatcgattgagcctattctcagtgaagatataagattcatacattttgacttccataaaatctgtggtcatattcattttgagcgcctttcacagttgtatgatcaaattgaagattatcttaagaagcataagtacttccttttggatgatcaaggcaagaaaattgtggggcaaactggcactgtcagaacaaattgtgtcgattgcttagatcgtactaatgtaacacagagcatggttggaagaaaaactcttgaaagccagctccagcaactaggtgttcttggtggtaacgatacaatcagcaattacccagcttttgatgcagattacaaagttttgtgggcaaatcatggagatgcaataagcactcagtactctggtactcctgctctgaagggagactttgtccggtatgggaaacggactactcagggaatttttaatgatctgtggaatgcacttgctagatactactttaacaattttgcagatggtactaagcaggatgccatggaccttcttcaaggacattatgtatcatcagttagtcgggacatcgcggttccaagcaaacccggagttatgcagtcctttcgtgttgcttttgcattgatattgtgcgctgctgtgttcatgattctgtcactacgacaagccaggaatgatcttcgccatttggtggtagcacttgtgtgggccggtctgtgcattggcattgcactatatgtcaaaaagaacggtaggaagttctgcaaccgacctcgtttttacctgtcacgcaattgaccgatgtag

SEQ ID NO: 443 - DNA, 1310 bp, Brachypodium distachyon
gtaccatggcgaccaggcatcagaacgcggctgccgctccgcagccggccaacagaggtgctgcagttccagcggcaaagcagaaggccgccgccgccggccgccctgaagcaaggaaccggcgcgcgcttggagatattggcaatttggttcatccccaggccctggactgcctgaaggagggaatcaaccgccccatcactaggagctttggcgcgcagctcttgaagaatgcccaggccaatggcgccgtagcaaacaaggttgccatagctcctgctcgtcaagcagcggcgcctaagccggccaagaaggcccctgccaaggccaagatcaccaccatccccgatcaggccaagaagccgtcagaggcagtggccagcagctctgcccaaaaggcttccaggaaaaaggtcgtggacacgctcaccaaagtgcttacagctcgttcaaaggtcgcctgtggccttactgggagacccaaagaacccgtggaggacatcgacgagcttgacaagaacaatgagcttgctgtggtggactacattgaagacatttacaaattctacatgaccgcccagcacgagagccgtcctgtcgagtacatggggaatcagcccgagatcaacccgaagatgagggcgatcctcgcggactggatcgtagaagtcacccacaaatttgagctgatgcccgagactctgtacctgacaatttacatcgtagacatgttcctctcggtgcagcaggtgcctcgacgggagctgcagctcgtcggggtggcagcgatgctgatcgcctgcaaatatgaagaaatctgggctcctgaggttaacgatttcatctctatctcggacaacgcgtactcaaggccgcaaatacttgggatggagaagagcatcctgaacaagatggcctggaacctcactgttcccacgccttacgtcttcctagtccggttcgtcaaggccgccggaaacgacaaggagcttgagcacatggtgttcttcttcgcggagatggcgctgaaggagtacaacatggtctccctgtgtccgtcgttggtggccgcctccgctgtctacgcggctcgctgcaccctgaagaagagccccatctggacagggacgctcgagcaccatactaccttcaacgagacacagctattggagcctgcaaaggtgcttgtgaacgcgcacgccgctgctcctgagagcaagctgagggcaatctacaagaaatacgccactgagcaatttgggcgtgtggctctgcacccaccagcagttgctgctcagggcgtttagtaa

SEQ ID NO: 444 - DNA, 1052 bp, Setaria italica
gcgaaatggcgatggcctccacctacgcgccgggcggcggcgcgggggcgctcgcgccgggaagggccagggtccgcggccccgtggggctcgttagcctcggccccaccaggctcggcggcctcccccgccccctcgccctcgccaggcggagccccgtcgcggccggcgccaggctgcggtgcgcggcgtcttcctcgtcggcggcgcgccccgtgacggcgccgcggttcatccagcacaagaaggaggccttctggttctaccgcttcctctccatcgtctacgaccacgtcatcaacccggggcactggaccgaggacatgcgcgacgacgcgctcgagcccgccgacctctacagccgctacctcaaggtcgtcgacgtcggcggcggcacgggcttcaccacgctcgggatcgtcaagcacgtcaacccggagaacgtcacgctgctcgaccagtccccgcaccagctcgagaaggccaggcagaaggaggcgctcaagggggtcaccatcatggagggcgacgccgaggacctgcccttccccaccgacaccttcgaccgatacatctccgccggcagcattgagtactggcctgatccgcagagaggaatcaaggaagcgtacagggtcctgaggatgggtgggacagcttgcgtgattggccccgtgtacccaaccttctggctgtcccgcttcttcgccgacatgtggatgctcttccccaaggaagaagagtacatcgagtggttcaagaaggctgggttcaaggatgtcaagctgaagagaattggaccaaagtggtatcgtggtgtccggaggcatggcctgatcatgggatgctctgtcacaggtgtgaagagagaacgcggggactctcctttggagcttggtccgaaggctgaggatgtcagcaagccggtgaatcccatcaccttcctctttcgcttcctcatgggaacgatatgtgctgcatactatgttctggtgcccatttacatgtggataaaggaccagattgtacccaaaggcatgccaatctgataa

SEQ ID NO: 445 - DNA, 1032 bp, Zea mays
tcatttctttactgcggctaggaggaggcggcggcggcgatgaagttcggcaagagcctgagcggacagatcgtggagacgctcccggagtggcgcgacaagttcctgtcctacaaggatctcaagaagcgcctcaagctcatcggcgccgggaacggggctgagcggcagccgaagcgggcccgccgcgacgactccggggaggctgacgcggccgcggccgcggcggcaatgacgccagaggaggcggagttcatgcagctcctggaggctgagctcgacaaattcaactcttttttcgtcgagaaagaggaggagtacatcatccgtcagaaggagctgcaggaccgggtggccagggcggccgggcgggagtccaaggaggagctcatgcgggtgcgcaaggagattgtcgacttccacggcgagatggtgctgctggagaactacagcgccctcaactacacaggattggttaagattctcaagaaatatgacaagagaactggagccctgatccggctgcccttcattcagaaagttcttcagcagcctttcttcaccactgatctcctgtataagcttgtgaagcagtgtgaagccatgctggagcagctccttccggttagtgaggcatctgtctcaagtgaagatggaaaaggagactctaatgatgaagagaagctggcgaagccaagttcttccttggtaaatggtggtggcatgccagagttagatgagatcgagtacatggagagtatgtacatgaagagcaccgtcgcggcccttaggtcactgaaggagatccggggcaagagctctactgtcagtatgttctcgttgccacctcttcagggcaacaatgcacaggacagctaccagatccgggcagagcaactagatgaggagccggagaggtggagcaaagtaacagtgatagagcaggcggccaaatgacagaccgaatgggcaaaacatctgatggctgaacttaaaaattttagacttggacatttgctggagatgggatag

SEQ ID NO: 446 - DNA, 1166 bp, Oryza sativa
aggagatggctgacaaggagaactccaccccggcctccgcggcgcggctcacccgctcgtctgcggcggctggggcgcaggccaagcgttcggccgccgcgggcgtcgccgacggtggcgcgccgccggcgaagaggaagcgcgtcgcgctcagcgacctcccgaccctctccaacgccgtcgtcgtcgccccccgccagccgcaccaccccgtcgtcatcaagccgtcgtccaagcagcccgagcccgccgcggaggcggcggcgcccagcggcggcggcggcggctcccccgtgtcatccgcgtcgacgtcgacggcgtcgccctcctccggttgggacccgcagtacgcctccgacatctacacctacctccgatccatggaggtggaggcgcggaggcagtcggcggcggactacatcgagtcggtgcaggtggacgtgacggcgaacatgcgggccatcctcgtggactggctggtggaggtcgccgacgagtacaagctcgtcgccgacactctctacctcgccgtctcctacctcgaccgctacctctccgcccacccgctcaggcgcaacaggctgcagctcctcggcgtcggcgccatgctcatcgctgcgaagtacgaggagattagccctcctcatgtggaggatttctgctacatcactgataatacgtacactaggcaggaggttgtcaagatggagagcgacatactcaagcttctcgagttcgagatgggcaatcctaccatcaagacattcctcaggcggttcacgagatcttgccaggaagacaaaaagcgctccagcttgttattggagttcatggggagttatcttgctgagcttagtctacttgactacagctgtctccggttcttgccatcggtggttgctgcctcagtggtgtttgttgctaaactgaacattgatccgtacaccaatccttggagcaagaagatgcagaagttgacaggatacaaggtgtctgaactgaaggattgcatcttggccattcatgacttgcagctcagaaaaaaatgttcaaacttaactgcaattcgcgacaagtacaagcaacacaagttcaagtgtgtctcaacattgcttccccctgttgatatccctgcgtcgtacctccaagatttaacagagtagtaa

SEQ ID NO: 447 - DNA, 1238 bp, Oryza sativa
tgctaatggcggcggcggcggcggacttcgcggcgagcaagcgggccatggcctacgcgctctgcaagcacctcagcctcgatccgaatacaatatccagtacaagtattgaagagagtgatattgccaccctgttctcacatattgtgaaatcgagtgaagatgaggtactgaaatgggttgaattttccagcaattttgttggaaaatgtggagaacagcatgcattgcttggtaatctgaatcaagacttgtcccagaaatcagttctgttgggtaatggttttaaaccatcagttgctgatattgttgtgtttgcaaccatacaagtttttgtgagtcatcttggtgaaaacgagttgcagaaatatccacatgtattgcggtggatggactatatccagaacatcgttgattttggcacaacagtacaaaaggttaacttgaccaaatctgtcttcgatccaccttctcatccaaagaaggcagataaaggtgacactgatccaagttcaaagaaagttgtttcaggacagaagaatgtgggcaaatcggatgcaaatgttgattccaagaaagctgcaccagagaataaagctcctgagaataaggcaaatcctactccagcaaaaaataacaaaccttctggggataaaaagaaagcccaggagaaatctgcaggaaaaccaaatgagggagttgcggataaagctccacagaaaactgcagaaaaggactcagaatgcaatgtcagtatcctgaatatacaggttggccttattcgcaaagcatggaagcacccatctgctgacagcctcttggttgaggagatagatttgggagatggcaatgtgcatcaagttgttagtgggcttgccaagttcttcagcccagaggaacttgttaatcggcatgttgtattaatcacgaatgtgaagcctgggaagctgcgagacgtaatgtctgccggattggtcttgtgtgcttcaaatcaagatcatacagttgtagagccattgattcctccagaaggagctaagcctggagagcgtatttcatttgcagggtttgatgggaagccagaagatgttcttaatccgaagaagaaacagctcgacaagatcacaccggatcttcacactgatggaaatggaattgcaacataccgaggggtacccttcactacatctgctggtccatgtagatcttctgttcctaatgcgagcattaagtgataa

SEQ ID NO: 448 - DNA, 1862 bp, Oryza sativa
gcggaatgcagcaggagcagcggaagaagagctctgcggaggagttttttacagagtatggtgatgcgaaccggtacaggatccaagaagtcattggtaagggaagctatggggttgtgtgctctgccattgatttgcacactagacagaaggtggcgatcaagaaggtgcacaatatttttgagcatgtctcggatgctgcgcgtattctccgtgagatcaagcttctgagactcctaaggcatccggacattgttgagatcaagcacattatgctacctccgtcaagaagggacttcaaagatatttatgttgtttttgagcttatggaatctgatctccaccaagttataaaggctaatgatgacttaacaaaagagcactaccaatttttcctttatcaattactccgggccctcaaatacattcatactgctagtgtttatcaccgtgatctgaagcccaagaacattttagcaaattctaactgcaaactgaaaatatgtgatttcggactagcacgagttgcattcaatgataccccaacaactgtcttctggacggattatgtagcaacaagatggtacagggctccagagctctgtggatccttcttctcaaagtatacaccagctattgacatttggagcattgggtgcatctttgctgaggtgttgacagggaagcctttgtttcctggtaaaaatgttgtccatcagttagacttgatgactgatcttctaggaacaccttccatggatacaatttcccgggttcggaatgagaaagcaagacggtacttgagcagcatgagaaagaaagatccagtccccttctctcaaaagtttcctaatgcagatcctttggcactaaaactcttgcaacggttattagcctttgatccaaaggaccgtccaactgctgaagaggcattgactgatccatactttaaaggcctttccaagattgatagagaaccatcatgccagccaatcagaaaactggagtttgaatttgagcagaaaaaattgtctaaggaagatataagggagctgatattccaggagatattggaatatcatccacaattgcagaagaactacagaaatggaagagagagagcaacctttctctacccaagtgcggttgatcagtttaagaagcagttctctaatcttgaagaaagcaatggaagtggctcagcaattccaatggaaagaaaacatgcatcgcttcctaggtctactactgttcactctactccaattcctcccaaggaacaacctcttgcggcctcattgaagagcagcaggcctgtctctgatgaaccttgtaaaaacccctgggtcatgggaggattttctggaaatattcccacttcttctcaggtttcacaagtggcaaaaccagtggcaccagggagacctgttgggtcagtatttccttatgagactggaagcaccaatgatccttatggtccaaggggaccagtgatgagttcagggtatcctccccagcaacaaatctcacaagcatatggttatcatcaagtgcctgcaaggatgaactgtgttgaacaatcacaagccatggatgcttataaaatgcattcacagtcacagacgcaggcctatgcttatccgaacagcaaagtcacggctgatgttgctctggacatgagaggatccacgttccatcattcagcaggatcaaagaacggctcgttagatagaatggtaacacagactgacatatacacaagatctcttaacggtattgttgctgccgcgacttcggcaggcgttggtactaacagaaaggttggtgctgtacccatcagcacctcaaggatgtattagtag

SEQ ID NO: 449 - DNA, 3247 bp, Oryza sativa
cgattagcttggtggatacttggattggatccaatggcgggtggtggtggtggtgccgccgcgtgctgctagatctcgggctgtggaggcaatggcgacgcggccggcttcgcggcagcggagggcgtcttcggcggcggcggcggtggcggtggtgaggagttcgccgcagccgcagcagcagcagcagcagcaactgccgataccgcagtcggggtcgccgacgtcgacgacgaccaccaccacgtcctcgtcgcggctcacgccggagctctcgctcgacgggcccgcgtcgccgctgttcgccgggcttgacgaggacccggcgcccaaggagaatgtcaccgtcaccgtccgtttccggccgctgagcccccgcgagattcggcaaggggaggaggtggcatggtatgcggacggcgacacggtcgtgaggagcgagcagaatcccagcgttgcttatgcttacgatcgggtttttgcaccaactactacaacccgtcaggtatatgatgttgctgctcaacatgttgtcagcggtgccatggagggagtaaatggtacaatatttgcatatggtgttacaagcagcgggaagacccacacaatgcatggagatcaaagatccccagggatcatacctttggctgtcaaagacgcatttagcattatacaagagacaccaaatcgcgagtttcttctccgtgtatcatacttggaaatttacaatgaggttgtcaatgatctgctcaatccagctggacagaacttacgaattagagaggatcctcagggaacatttgttgagggtatcaaagaagaagtagtattatctcctgcacatgccctatccctcattgctgctggagaagagcatagacatgttggatccactaacttcaatctacttagtagcagaagtcatacaattttcacactgactgtagagagcagcccttgtggtgagtctaatgaaggcgaggcagttaccttctcacaactgaacctcatcgatctggcaggttccgagagctcaagggcagaaactactggagtacgccggaaagaaggatcttatatcaataaaagcttgctaacacttggaactgtgatatcgaaacttactgacggaaaagctacacatattccatttcgtgattcaaaactaacacgtctacttcagtcatccttgagtggtcaaggacgtgtttcactgatctgtacagtgactccagcatcgagcaactcagaagagactcataatacactgaaatttgcccaccgtgcaaaacgcattgaggtccaagcatcacaaaacaaaattatagatgaaaaatctttaataaagaaataccagaatgagattcgcagattaaaggaagaactagaacagctgaaaatgggtattattactggcactccagtgaaggatgccggagaagataatatcatcctttggaaacaaaagctagaagatggtaacgtcaagctgcagtctaggctcgaacaagaggaggaagctaaagctgctttgcttgcaaggatacagcgtctcacaaagcttatcttggtctccactaaggcgacacaaacttctagattttctccacatcctggaccaagaagaagacattcttttggggaagaggagcttgcgtacctaccttacaaaagacgtgatatcgtgttggataatgaaagcaatgaattactttctcctgttgaaggacttggcatgacacttgaagattcgaaggaggagaaaaagaatcggaaaggaattcttaattggtttaaacttcggaaacgtgaaggtggagcttctattctgacaagttcagaaggtgacaagtccagtttgactaaatcaactgctccttcaacacctattggggagagtgttaattttccttccgaaccaagaatatcaaattctttggttggtgagagtgcatcggttgatctctttagcattggccatggggagttcgctactgacagccttcatggagaagaaacacctctggccagcagaaaaacaatagatcacgttgacttactgagagagcaattgaagattttgtcaggggaggttgcacttcatacaagtgtcctaaagcgccttaccgaggaagctggaaggagcccaaataatgagaagattcagatggaaatgaagaaggttaatgatgaaattaagggaaagaagcatcagatagcgtctttagaaaggcagatacctcattccatctcaaataatcaagggatggctgacaagttagaacttactccgtcttatgctgaactgcttgagcaactcaacgagaaatcctttgatctcgaggtgaaggcagcagataacagagtaatacaagaccaacttaatgaaaagacaactgaatgcatggaattacaagaggaggttgctcacctgaaagagcaactttaccaaactcttcaagctaaggattcactgtcaaatagcattatgatgcagaagaatgcaggaattaaccatgaaactgataatcatgctgatcaagaactatcagttcctagagaggtccctggtgaaacgtcgccaaaagaaccacagtcagttgagattgatgagctgaagcagaaggtgtgtgagctgattgaagtaaaagctcaactagagactcgcaaccagaagctactagaggaaagcacgtacgcgaaaggcttggcttcggctgcgggagttgaattgaaagcgttgtcggaagaagtcaccaagctcatgaaccaaaacgagaagcttgcttctgagttggcatcggtgagaagtccaaccccgcgtagagccaacagtggactgagaggtactcggagggatagcatcagtagacgacatgagccagctccaagaagagacaacaacgcaggctacgagagagaaaaggcattagaagctgtgcttatggagaaggaacaaaaggaagcagaactccaaaggagaattgaggagtcgaagcaaaaggaagccttcttggaaagtgaacttgcaaacatgtgggttctagtggcaaaactgaaaaagtctcaaggccatgatcttgaggattttgacaccaaatatattggctcgtaacatcataactctaggctaattaattattagtagtgcgactggcttgggtacgtctgtatgtaagataagagatttataccaggtttcctgttgcagtgtgaattagttcccatcttgtatattcgccggttg

SEQ ID NO: 450 - DNA, 1223 bp, Sorghum bicolor
ccaccatggaggcgccgccgggaccggagcccatggagctcgacgcgccccctcccgccgccgccgaggccgcggcggcggttccccccgccgggagcgacaagaagaaggaaggggaagggggagacgctgttacgggtcatatcatctccaccaccatcggtgggaagaacggcgaaccgaagcggaccatcagttacatggcagagcgtgtcgtgggtacaggctcatttgggatcgtcttccaggctaagtgtttggagaccggagagaccttcgccatcaagaaggtgctgcaagatcggcgatacaagaaccgggagctgcaacttatgcgtgccatggagcaccccaacgtcatctgcctgaagcactgcttcttctcgacaacaagcagggatgaactgtttttaaacctggtcatggaatttgtcccagagaccctataccgagtcctgaagcactacagcaacgcgaaccagaggatgcctcttatctatgttaagctgtacatgtatcagctttttagaggcctagcttatattcataatgtaccaggtgtctgccatagggatgtaaagccccaaaatgttttggttgatcctctcactcaccaggtcaagctctgtgactttggtagcgcaaaagtcctggttcctggtgaaccgaacatatcttatatatgttctcgttattatcgtgccccggagctcatatttggcgcaacggagtatactacttcaatagacatatggtcagctggttgtgttctagctgagttgcttcttggtcagccactgtttccgggagagagcgcagttgatcagctggtagagattatcaaggttcttggtactccaacccgggaggagataagatgcatgaatcccaactatactgagttcaggtttcctcagataaaggctcatccgtggcacaagattttccacaagagaatgcctcctgaagctatagaccttgcttcccgtctccttcagtattcaccaagtcttcgctgctctgctcttgatgcatgtgctcatcccttctttgatgagctgcgggcgccgaatgcgcgcctaccaaatggccgtccattccctctgctctttaacttcaaacatgaactagcaaatgcatctccggacctcatcaacaggcttgtaccggagcacattagacggcagaacggtgtcaacttcgggcatgttgggagctagtag

SEQ ID NO: 451 - DNA, 1823 bp, Sorghum bicolor
aagagatggcggagcggctgacccgtatcgccatcgtcagcgaggacaagtgcaagcccaagaagtgccgccaggagtgcaagaagagctgccccgtcgtcaagactgggaagctatgcattgaagtgacttcggcgtcgaaactcgctttcatttctgaggagctgtgcatcggttgtggtatctgtgtaaagaaatgcccatttgatgccattgaaatcatcaaccttccaaaggacttggaaaaggataccactcaccgatatgggcctaataccttcaagctgcacaggttgcctgtcccgaggcctggtcaggttttgggccttgttggaacaaacggaattggaaagtcgacagctcttaaagtgttggctggcaagctgaaacctaacttggggcgcttcaaaaacccgcccgattggcaggaaattctcacatatttccgtgggtctgaacttcagaactacttcacacgcatattggaagataacctgaaggcaatcatcaaacctcagtatgttgaccacatcccaaaagctgtccaagggaatgtaggacaagtacttgaacagaaggatgagagggatatgaaagctgaactgtgtgttgaccttgaattaaaccaagttattgaccgaaatgtaggagatctttctggtggtgagctacagagatttgcaatagcagttgttgctgtgcaaaatgcggaaatctacatgttcgatgagccatcaagttaccttgatgtgaagcagaggctgaaagctgcacaagtcattaggtccttgcttaggcccaacagctatgtcatcgttgtggaacatgacttgagtgtcttggattacttgtccgacttcatttgctgtttatatggcaagccaggtgcttatggtgtggttaccttgccattctcagtccgagagggtatcaatattttcttggctggatttgttccaacagaaaatcttcggttccgagacgaatctcttacatttaagattgcagagactcaagaaagtgctgaggagattgagacgtatcagcggtacaagtaccctactatgagcaaaacacagggaaatttcaagcttactgttgttgagggtgaatttactgattcccagattgttgttatgcttggtgaaaacgggacagggaaaactacattcattagaatgctggctgggttgttgaagccagacacagtcgaaggcactgatattgaaattcctgaattcaatgtgtcttacaagccccaaaagattagcccaaaattccagaataccgtgaggcatttgctgcatcagaaaattcgggattcctatatgcaccctcagtttgtgtctgatgtaatgaaaccactgcaaattgaacaactcatggaccaggaggttgttaatttatcaggtggagagctccaaagagttgctatatgcctgtgccttggaaagcctgcagatatctatctgattgatgaaccaagtgcttatcttgattcggagcagcgtattgttgcctcaaaggttatcaagagattcattcttcatgcgaagaaaactgcatttattgttgagcatgatttcatcatggcaacatacttggctgacaaggtcattgtttatgaggggcgaccttctattgactgtactgccaatgcaccacagtctttagtatctgggatgaataaattcttatcgcatcttgacattacttttagaagagacccgaccaactataggccacgtataaacaagttggactctaccaaggacagggaacagaagtcagctgggtcttactactacctcgatgactaatga

SEQ ID NO: 452 - DNA, 609 bp, Sorghum bicolor
gaatcgaatcgaaagatgatggatgaggagcacgagcagcagcagccggtgccggtgccggtggcggcggaagcagcggtggagaaagacaataagaagacggcgaagaggaataataaggtgtgcgtgttctgcgggagcagccccggggtggagcggggcatggacctagtgtacggcggcggctgtgcagctctgatgggtctggtgtcccgcgccgtccacgacggcggagggcacgtgctcggcgtggtgcccaaggcggtgctgccgctggagctcatcggggagacgccaggggagctcaagccggtggccgggatgcaccagcgcaaggccgacgcgctcccaggtggttacggcatccacaccaagcccgtgggcctcctcaacgtcgacggctactacgacccgctgctcgccttcgtcgacaaggccgtccaagaaggattcgtcacccccctcgaacgcacaatcatcgtccacgccaacaccaactcctcgacaagctccagctccagctccacgaccaacatcaacgccgacgccgacgccgacgcctagctatattcatccatccatcaccaacccaacaactccaacatctag

SEQ ID NO: 453 - DNA, 2252 bp, Sorghum bicolor
ctgccatggacgacgaggcggccaagtctgttcctacatcagacatgaataccgacgctgccgcggaagccgaggcggccgccgctccgctgcggccctcgagctctgaagcggcggagagggaggcaaaggttgagggcgcggatgaggagggccaggtggttgagcgattggtcgagctggtgagcgagatcgcgaccatctcggacttcaggaactcgtacaggcggcagttctgcaacctgtcccggcggatccggctcctcgtgcctatgctggaggaggccaaggaagcgcccgcgccgcttccggcggcgtcggaggccgcgctacggcggctcagggacgcgctccacgccgccagggagctgctccggctcggcagcagcggcagcaagatcttcctggttcttgatagagagaaaataatgaagactttccaggatgttactgcaagacttgaacaagccttagctggtatttcgtttgatgaacttgatatatctgatgaagtaagagagcaggttgaattggtgcatactcagttcaaaagagctaaggaacgatcagattcatctgatgatgatctttttaatgagctgatgtctctctataattcaagcagcagtgctagtgttgacccagatattcttcgaaggttatctgagaagttgcagcttgtcacaatatatgacctcaatcatgagtctctgaccttgcatgagatggctagaggcggtgatcctggtgcagttgttgaaaagatgtcaatgctcctcaaaaggattaaggattttgtgcagacagaagaccctgagatgggcgctcgagcaagtacagcaaacattttcccaaaagacaactcagcacgtcctgttattcctgatgatttccgttgcccaatatcactggatttaatgagcgacccagttattgttgccactgggcagacttatgagcgggggtacatagagatgtggctggaggctggccatgatacctgtccgaagacacagcagaagcttgctaataaatccctgactccaaattatgtcctacgtagcctcataactcaatggtgtgaggcaaatggtattgaacctccaaaacgccctgctcaacttaaggatgcaccattgccatgtagtgctgctgaacatagcaatgttcttgagcttcttcagaaactgtcatcccaaaaccttgaagatcaacgtggcgctgctggtatgcttcgtcagcttgccaagcgcagtgctgaaaatcgtgcttgtattggagatgctggtgctattcctattcttgttagtatgctatcaaccactgatgttagcacccaggaacacgtggttactgctctcttgaatctttccatctatgaagagaacaaggcaaggataatctcttctggagctgttcctggaattgtgcacgtattaaagaggggcagcatggaggctcgggagaattcagccgccacactgttcagcctatctattgtagatgagaacaaggtgactattgggtgctcaggggcaattcctgcgcttgtgcagctattgagtgacggaagccaacggggtaaaaaggatgcagcaacagcactatttaacttgtgtatttaccagggcaacaagcggaaagctgttagagctggattggtacctatactactagaactactcatggagtctgaaagtgggatggtagatgaggcccttgcaatattggcaatcctctcaggccaccctgaggggaaagcagctattggtgctgcttctgcaatacctgtacttgttggagttatcagaactggatctccaaggagcaaggaaaatgctgctgctgttatggtgcatctatgcaatggcgaaggagaacagcagcaacagcatcttgctgaagcacaagagcagggcatcgtgtctttgctggaggaactagcagaaagtggcacggacagaggaaagaggaaagctgtgcatctgctcgaacgaatgaatcggttcctaaagcggcagagtcaagcccaagccgaagcagaggccatggcacaggctcacgcgcaagcacaagcacaagcacaagcacaggcacaagcacaggcacaggcacaggcacaggcacaggcacaggcacaggcacaggcacaggcacagcctcagatcctggttcaagctgaagcacacgcagatatgcaagctgagcgatcactacttcccacttcaccagatatttctgatagatgatag

SEQ ID NO: 454 - DNA, 2118 bp, Sorghum bicolor
acagttccaggcttccagttccagctcacccctgcttcctcgggcggcggcgccgccgccgtttggcgcacgcgcgatgccggcgacggcggaggactccccggcgatacggaagctggggcagctcttccggctgaccgaagtatacctctgggacgattcgtatggcgctggacctcacgatggacggaagaactggcgctcggcggaggctgctctcgtggactctcatacagataaaacatgcaatgaagcatccaatggcactgacaaaggccatttgtttgttgaagatttggaattggccaacctcatgggttctttggggcttcctgtttcattcagcacaagtaaagtgaacaagaacacaggcaacaagggaaagaaaaaaggaagacaagcactgctcaaagcagcaaagactcaaatcaatgatgctgtgaggatatgtgccaatactgaagatagagaaagtgctgttgaatcattggatgttatggcgcacatgcactcatgcaatttatctgggactccgctgggtcacaatgaaccctgccatgatgacactgacaagatgcttagggaagacagtccttgtgttgaagaacaagaagagtctggctgtagcaccatctattcttctgacaaagcccctagctgtgatgctaaaaatctgctcactgaacttgggacttttgagctttctgataacttgggcaacccagcaaaagaagattattcaattcaagaaaatcaagcctctgacagcgtgttgctagattctgaagagatgccaaggcatgactgtgttgatggtgaatctacacattcatgtgtcgacatttatcaggaagaaagagtgtccacaagggaagatcaaacatctgaagaaactctgtcagtatcccatgatcataatgatgttggccaagaagctagtctaagtttggcagagccatcttctattgatgagcatgcacaaagttctgccaacaacttttactatgactatggtgaatggagggttgtctgggatccgttctatagtcggtattatttttacaacatccagacacaagagtccacatggtgtcctcctgaaggattggaggattttgcatcatattgtagcccagataccactaaagagctagttgaactgggatctcagtgtacaagcatagcaccgcaagagaacaatctggctactgatgacaatcatttagaagcacaggaacaagatcactgcattcatgatttatctgacattcctgtcgaaaaagcaatatatcaaagtatgataactacctctgacaaagcacagcacactgaaaataagtacagcgattcaacaactattgtgttagagatgaaccaggaagttactaccaccaaaaagaaaaagagagtaaggagatctcaatcgtatcattcatgccaagacatggcagggaacatctccaatgacatcatcaagtactggactcagcggtactcacttttctcactttttgatagaggtataaagatggatgaagaagggtggttttcagttacgccagagcctattgcaaagcatcatgcatctcgtgttggtgcgggagtaatcattgattgtttcacaggagttggtggaaatgccatccagtttgccacaaagtgcaagcatgtaattgcagttgatattgatccacaaaagattgattgtgcacatcataatgcatccatttatggagtaaatgatcacatagatttcattgtaggtgattttatacatatagctcctcatctgaagggagaaactgctttcatgtcgcctccttggggtggacctgactatgccaaagttgatgtttatgatatgaaaagcatgcttttgccttgtgatgggtactctcttttcaaacttggtactatgatagcttcaagagtagtgatgtttcttcctcgcaacattgatctaaaccaattggctgacatgtccttgtctgtggaccccccatggtcggttgaggtcgagaagaacttcctcaacggaaagctgaaagccataacagcatactttgaagaacaggattgttgagtcgcgcatcggcactggtgatacaaatcatcttg

SEQ ID NO: 455 - DNA, 1406 bp, Sorghum bicolor
gccgcatggagatcgtgcgctcacaccggcaggtcgccgccgcagctgccgcagccggcggcgacggcggcggcgcgggggcgctgccgacctacaaggcggcgccgcagctcgaggtgcggctggaggagttcgagctcttcgccatcgaccgcctccgagttctcaaggggatttcggatggactctcgcgggggaagaggcccgaggagatggagaaactggtcagtgaattgtggaagacatacatgaggcaccaggatcctgcagagactttgaacaaggatataatatcacactttgtgctccgcctagtctactgcagaacggaagaattgcgaaagtggtttctctccatggagactgcactttttcggtatcgctttcggcttgagagtcctgaatcacagaggatgcttatgactgagtttcaactgccatacaaagcactgccacactcagagtttgaggctgtgaaagacaagttgagccaagttgcgcgttccatcggtcaatctgcaaatgtggagcatgtgttcttcaaggtaccttttgaagaagttcctgatcttgttgccagccgccgggtatttctttcaaaaggctatgcttatgtggcgatgagccaggtggtttcgctagtggttactcaattccgctgcaatatctcaaaggcacttgctttaacaaacagaaaatggacagcaaccattaaagaacaagaaaaaggcaggttgactcctattgtcgaagcattaagtaatgcatattttggtcctgattactctcagccaaaggatactgttgacatatctctaaaggatattgaccaactggctaaaagttctttccctctttgtatgcggcatatgctagataagttgagagaaaatcaccatctgaagcatgggggtagaatgcagtttggtctttttcttaagggtgctggactaaagttggaagatgctcttgcattttggagggcggaattttctcagaaggttggttctgagcggtttgacaaggaatatgcctataccatcagacataattatggaaaagaaggaaaacggacagattacacaccatattcatgtcaaaagatcatttctgcaacacctggtgttggagatcaccatggatgcccgtttcgacatttcggcgaagaaaatttgcgggcagcactcaacaaaatgggcgttggtgggcatgcattggaagagataatggataaagtgaagaacaggcattaccagctagcttgcacattaacctttgagaccacacacggtgtctcctgtgattctggaatcaaccatccaaatcaatatttcagtgaaagccagaaaattctgcgagccaaaaaccaaacaatggagagccaatcacaatcagcaacctaataa

SEQ ID NO: 456 - DNA, 5744 bp, Sorghum bicolor
ccgctatggcgccgccgcgcggcgacaggaagaaggggaagggcgccggcgggaagaccgatctgcgccccgaccggaagcagttcaaagggcatcgcaaggaggttgcagccgctgagcagggggatggcgacggagagcggcagcagttggcagcgccgggttccgctgcgctcctcgccgcagcttctgacgaagctgacttcccgagagggggacgcagcctcctgagcaaggatgagatggcggaggctcgcgcggaggcggagcaggatttcgagagggaggggaagaagggtaaggggaaaaggaagaggaggggcggcgagtcgtctggttttggcccggacgacgacttggggacactctttggtggcgccaccactgggaagctcccacgctatgctaatcgcatcacagtaaagaatatttcaccaaatatgaagctctggggtgttgtaattgaggttaaccagaaagatattgtgttaagtctacctggtggaattagagggtttgttcgctcagaggatgtgtgcgacattgctttgcaggaaaatcgcaaggatagtgagaacagtttatgtgcaaaagttgttcatgttggtcagcttgttccttgtatagtcctacgagttgacgatgataagaaagaaggaaaagtaaacagacgggtttggctatcattgcgattaagtctactgtacaggggactttccttggatggcttgcaggaaggaatggtacttgctgcccaagtcaaaagcattgaggaccatggttacattcttcattttggagtatcctcctttagcggatttatgcaaaaggatgacaaagaaaatgtgaagattgagcgccgacaactgatgcattgtgttgtgaaggcgattgacaaaactcgggctattgttcacttgagctctgatgaagacttgctttgtaaatctattattaaggatctgaaaggcctttctattgatcatttgattcctgggatgatggttaatgcacgcgtccattcagttcttgaaaatggagtcatgttatcatttcttacttatttcagtggaacagttgatatttttaatttgttgaattcctttccctctggtaattggaaagatgattacagtaagaataagaaggtaaatgctcgcatcctgttcgttgatccatcaacaagagcagttgggcttacattgaacaaacatttacttcatcttgaagtaccccctattaatctaaaagctggagatatctacgataaatcaaaggtgctgagggtagataaaaaggctggtctttttctggaaataccttctccaactccatcacctggatttattagtatacatgatgtgtcagacaaggatgcaaaaaacttggagaagtttaaggaaggcagtagcttacgtgtccgtatacttggagtacggaatcttgaaggagttgcaataggcactgtaaaagacagtgcttttgaagggtctgttttcactcatgatgatgttaaacctggaatgttagtgagagctaaggttgctactgtggagccattcggtgctattgtacagttttcaagtggtgtgaaagcactttgcccgcttcctcacatgtcagagttggaacatgttgtgaaaccaccaaagaaatttaaggttggagctgagcttcttttccgtgtattgggctgcaaatccaagagagttacagtgacatacaagaagtctctggtgaaatcaaaacttgatgtgctagcatcatatgctgatgcaaaaattggtttagtgactcatggatggattactaaaattgaaaagcacggttgctttgtaaaattctacaatggagttcagggttttgttagcagatctgaccttggattagaggctggaactgaagcagaaaatgtttatcatgttggtcaagtggtcaaatgtagaattatcaatgtgatacctgcttcaaggaaactaaatgttagttttgtcatatcccataatagggttattccaatagacactccaaagttgggtagtattgtctctggtgttgtggaacggcttactcctgcagctgttgttgtcagtgtaaatggcttctccaaggggacaatactgaatgaacatttggcagaccatcatggtcaagctgctcagttgaagaatttgctgaaacctgggcacgagttcaaccaacttctagttctcgatattgaaggtcacaatttagttctttcggcaaagcactcacttatcaattgcgcaaatgacattccttctgagatatcgcagatgcatcctggagttgtagttcatggttacatctgcaacattatcgaatctggatgttttgtccgttttctcggacatttgactggtttctctcccaaggacaaagcagttgataggcggatagaaaggctttctgatgcgttctatgttggccagtcagttcggagtcatatactcagtgtaactgcagaaactgctagagtaaaactctcacttcaacagtcaatgtgctcctcaacggattcttcgtttattcaaggatactttcttctggatcagaagattgcagcattgaagtactcaagcaatgattgggctcacacttttggcattggtagcttagttgagggggaggtgggagcaatagaagaatatggtattatccttaacttcaaagaccatctggatgttgttggcttaatcgagcaccatcagcttggtggcagtagtgtggaagtggggtcttctgtgaagggccttgttttggatttatctgatggagttgttaatttgtcccttaaaccagagctaattggcagtgttagaaatgttggaaaaaagaagaaacgccaaagggctgcagttgcagacttggagcttcatgaggaagtgaatgcagttgtggaaataatcaaagggagctatttggtcctttccatccctgagtacaattacgcaattggttttgcaccactgatggattacaactcacaactgcttccccaccaccactatgataatggacaacgcattactgtggttgttggaaatatcccaagttctgactcttctggaagacttatcctactaccaaaggcttcagctcagtattctgccctctctgaatctaaaagggctaagaaaaaatcaggctacaaaattgggtcacttgttgaagcagagattattgatatcaagccgcttgaacttctactgcaatttggtggcaatcttcatggaagaatccatattactgaggttcctgaaaaggattctgatgagcatccctttagtaaactcagaatagggcaaaagcttactgccagaattgttgcagaggctgaaccttctggaaagagtggcaaaaacttcaaatgggaattgtctattaggccatgtatagtcaacggagagtttgacgaattaactgctcaaaaagaacaaaagcacaccacaaatgagattgtacgtgcttatgtcgtcaaggtggataaggaatgggtctggttaactgtatcaagaaatgttatggctcatttatttgtacttgatagttcttccgagcccagcgaactgaaagaattccagcagcgctttagtgaaggccaagcagttaaaggccgtgttatcaatgtgaatcgggagaaaagattacttcggttgaaggcacttgataaccaatgcacacagctgaatatagatgaaatacaacaatcaaagtcctctgtgtttgaacaaacaaaacaaggagatatcatcggtggacgtgttcaaaaaattctacctggcgttggtgggcttgtcgttcagattggacctcatctccgtgggagggttcattatactgaaattgttgactcatgggtgaccgaacccttgtctggattccatgagggccagtttgtgaagtgcaaggtcctgtctgtgagccgctcatcagaaggatcacttcgagttgatctatcactccgttcatcaaacctgatcagagactctaacaactcaggactagttgatgatctggcaacctgtacctcccggatcgaaaagatcaaggatctgcttcccggaactgagattaagggctatgtgaagaatgttaattccaaaggatgttttattatgatttctcgaatggttgaggctaggattactctatcaaatttgtcagatgagtatgttgaaaatccgcagaaggatttccctgttggaatgcttgtacacggaagggtcctgtctacggacccatcatcagggagagtggaggcatcacttaggaagaccactggttccaaattggaaaagctggatgatattagttatagtgatttgcatgttggggatatcattgatggccaagttaagcgggttgaatcctttggattattcgttacaattcggagaagtgaactggttggtctgtgccatgtatcagaactttctgatgaacctgtcgttgatattaactcttgctataaagctggtgatatggttaaagccaaaattctgaagattgatgagaagcggcatcgagtatcacttggaatgaagaagtcgtactttgattctgatctgactgctgacacaaatgatgatgaagatgatgaaagtgctcttatggacatcagtgttgcccctcagatggttgaatatcataatagaagtttagttaatcgcaaagcagaaccaatggcttctgtgccgcctcttcaggtttccttggatgaatctgaatgttctgacctagaggataataataataataaaggccctgaaattgcaaatggaactgaagcaaatgctaaaaagaatgataaacaattaaagaaggaagcaagaaaacaaagggaactagaaatcagtgctatggaggaaagggctttgcagggagatgtaccacaaactccagatgattttgagaagttggtcaggagctccccaaatagtagttttgtctggataaaatatatggccactttgttagatcttgcagatgttgagaaagcacgtgcagtagctgagagggctttaaaaacaataatcccaagagaagaagaggagaaacttaatgtttgggtagcatatttcaatctggaaaatgaatatggtagtccacgggaggatgctgtgaaaaaggtattccaaagagccttgcaatattgtgatcccaaaaagttgcacttggctcttcttgcgatgtacgagaggaccgaacagtatgaacttgcagatgaacttcttgacagaatgaccaaaaggttcaaaacatcctgcaagatatggttatgccgcattcagttcgccctcaagcaaggcaaggatgttgcgtgcatcaaatccattgtaaaccgtgcgcttctaagtttgccacataggaagcgcataaagttcctctcgcagacagctattctagaattcaaatgtggggtgcctgaagaaggaagatccagatttgaactaatattgcgggagtacccaaaaagaacagacctttggagtgtttatcttgaccaagaaatccgccttggtgacatagaagttatacgggcattgtttgagagggtgacttgtcttaccctacctccaaaaaagatgcagttcttgttcaagaagtaccttaattttgagaagtcacttggtgaagacaacgaaagaattcagtttgtgcagcagaaggcaattgaatatgttcagagttcactgccgtcacaagacaacccttgatag

SEQ ID NO: 457 - DNA, 830 bp, Sorghum bicolor
cagtccagcaagcaacaataaaggcgggtgtcgaagaggccgggtaggaggaggagagctttggaccgagcgagagagcgagagagcgagaggaattaatgggtgaggaggccagctgcaacgccgtcagcgcgatggaggccgccaccaacgccaagccggcggccaaggagaacggctgcgcggccgccgtggcccaggaggcggcggcccccgtggccgcggccgacccccggctgcagggcatctccgacgccatccgcgtcgtgccgcacttccccaagcaaggcatcatgttcaacgacatcaccacgctgctgctgcgccccggggtgttcaaggacgccgtcgacctgttcgtcgagcgctaccgtgggatgcgcatcgacgccgtcgccgggattgaggccaggggcttcatatttggcccagcaattgcgttggctattggcgccaagttcataccgctgcgcaagcctaggaagctcccaggtgaggtgatctctgagaagtatgttctcgagtacgggactgattgcttagagatgcatgttggagctatcgaacggcctggtgagcgtgtgctgatcatcgatgacttggttgcaaccggagggacactttgtgctgcaattaggcttcttgaacgtgctgaagctgatgttgtcgagtgtgcatgtctcattgggctcccaaaattcaaggatttctacaagttgaatggaaagcctgtatacgtgctggttgagtcccgtgaatcagataaataagagcttatggtcagaggaaaactggtgcctggtgggttaattcgttgctactgcggttag

SEQ ID NO: 458 - DNA, 1487 bp, Sorghum bicolor
ccacaatgccgactctccgcagcgcgacggcgaacgcgtcgtccgtggccgtgggcacgccatcccctgcggcggcgagcacgccgcgcagcgtcaagcgccggctgacgccaggccgcgccggcgagttgcccgccgcgtcgcggcacacctcccctcacagatccccgcacgccggcaccggaaccgtatgcatgccgaagctgctctccgcgtcgccgaagtcctccaggaagcgtctctacggcgaccttgtcgcagccgagaagcccaagtggaatccccgagatgccgcgcagatgagggctgtcaaggaggcgctgcacgtggcaacagtgccgtcgtctgaattggtttgccgggacaacgagctcaggcgcgtccttgagttctgtaaggctagtgttgagcaggagaaggctggtagcctctatgtctgtgggtgccctggcacagggaagacattgtctattaacaagatcaaggatagcttggtgtgttgggcggatgagatgggaatggagacacctgattccttagcaatcaattgtacaaacctagccaacacctcagagatttttggcaagatactaggaaaatttcagaaccgaaagaaaggaagcagcaaattgtcgccacttcagcaacttcagagcatgttttccagcaaggattcagctccaagaagaatgatgctggtcattgtggatgagatggactacttaataacaagagaccgtgctgtgctacatgatcttttcatgcttacgacttgtgcattctctagatgcatactaataggaattgcaaatgccatagacttagcagatcggtttcttccaaagcttgaatccttaaactgcaagcctcttgttgtgacttttcgagcatattccaaggatcaaatatctgacattgttaagcataggctaaagggtcttgagtatgatgtttttgaaccactagctctggagttttgtgctagaaaagttgcagcagcctctggtgacatgagaaaagctctaggcgtttgcaggagtgctgtggaggttcttgaagcaaggctacaagattcccctgatcaagaactaggaatagtgacatttgaccatatggatatagctttgtcaaaagcattcaagtcagcagtcatagatagcatactatgtcttccccagcaccaacagatggtgctgtgtgcgttggcaaatacttttcagcattgcaagaaaaaggctactactctaggcgagctcaacaaatcgtacattgagatttgtagatcaacccaagttccagcagttggaatgcttgaattttctaacatgtgtatggttttgagcgatcaggggttcatgaagctagggcaatccaaggaagataagcttaggagagtaacacttcagattgacagttcagatatcacttttgcctttaagggaaatcgtttctttcaaaaatgcctggagcagccaagatgctaataa

SEQ ID NO: 459 - DNA, 1244 bp, Sorghum bicolor
ccgccatgggaatcaaggggttgacgaaggtgctggcggagcacgcgccgagagccgcggtgcagcggcgggtggaggactaccgcggccgtgtcatcgccgtagacgccagcctcagcatctaccagttcctcattgttgttggaaggaaaggatcagagcttctgaccaatgaggctggtgaagtcacaagtcatctgcagggtatgttgaaccggacagtaagaatgctagaagcagggataaagcccgtatttgtttttgatggtgagccacctgaaatgaagaaaaaggagcttgcaaaaaggtccttgaagagggatgatgctaccaaagatcttaatagagctatagagattggagatgaggatgcagttgaaaagtttagtaaaagaactgtcaaggttacaagaaagcacaatgatgactgcaagaggttgttaagattgatgggtgtccctgtagttgaggcaccaggtgaggctgaagcacagtgtgcagcactttgtgaaaatcaccaggtttatgctgtagcttcagaggacatggactcactgacttttggtgcccgaaggtttcttcgtcacttaactgaccttggttataagaaatctcctgtgacagaatttgatgtgtcaaaggttttggaagaacttggactcacgatggatcaattcattgacttgtgtatccttagtggatgtgattactgtgagaatattaaaggtatcgggggacaaagagccttgaaactcattcgtcagcatggttgcatagaagaagttctgcaaaatctgaaccagacgagattcagtgttccagaagactggccttaccaggaagttcggactttgtttaaggaacctaatgtttctgcaggaatttcagatttcacgtggacctcaccagacacagagggccttatgggtttcttgtcaacagaaaacagtttcagtcctgatagggtaacaaaggcattagaaaagataaaggctgcaagggataggtattccccaggcagattgaagcatttaacaccagttgctagcttaccaggaactcacactggcaaggaacccaaatgcatactaggttctccaggacaaagtctgaaggtcaggtcatctccacaagtatgcaagagttcaagctctggtttcagatatggtagctcaaagccatttatgctgggcagacaatctggatatcatggaatgccctatggtctctcttttatctaataa

SEQ ID NO: 460 - DNA, 4469 bp, Glycine max
ccggaatgtcgtgggaagacgagattgtgatgcgtgatgtcacgaatgcggggcttgttgtcagcgatcgcattggtcgcgaagtttcgtctcagctcgacctcgaagaagctctagaagcttccagatacgctagccacccttattccactcacccccgagagtggccccctttagttgaggtggtgaatacctgggagttgcctcccgtgctcattgaaagatacaatgcagctggtggggaaggaactgctttttgtggaatatttcctgaaatacgaagggcatgggcatctgtggacaattcattgtttctttggcgttttgataagtgggatggccaatgtcctgaatttagtggggaagaacaagctatttgtgcagttggtcttgcaaaatcaaaacctggagtttttgttgaagctatccaatatcttttagttttagcgacacctgttgagttaattttagtaggagtatgctgctctggaggagcagatggttcagatccatttgcagaagttacattgcagccattgccagagcatacaataccttctgatggggttacaatgacttgtgtagcatgtactgataagggccgcattttcctcgctggtcgggatggccacatatatgagattctgtattcaactggttctggatggcaaaaacggtgcagaaaaatctgcatcactgctggtttaggaagtgtaatttcaagatgggttataccaaatgtattcaattttggagctgttgaccccattgttgaaatggttttcgacaacgagagacaaatattgtatgcacgaactgaagagatgaagctacaagtttatgttctaggaccaaatggtgatggcccattaaagaaagtagctgaagaaagaaatcttgtcaatcagagggatgcacattatggtgctagacaatccacagggtcaagagtctcaagtcgatctccaaagccatctattgtttgcatctcacctttatctacacttgaatccaagtggctacatcttgttgctgttttatctgatggcagaaggatgtacctatctacctctccttctagtggaagcttgactgggttcaacaccaaccaccacaagcctagctgtttaaaggttgtcactacaaggcctgctcctccttggggtgttagtggtggtctcacctttggagccatggctcttgctggtagacctcagaatgaggatctctccctgaaagttgaggcagcttattattctgctggaacccttatactttctgatgcatcaccttctaccatgccttcactccttgttttgaacagggattcaagcacgcaatcatcgccgtcaggtaatctaggaacaagtacgaggagttcccgggcattaagggagtccgtatcttccttaccagttgaaggacgaatgctttctgtggcagatgttttacctttgccagataccgcagctactgtgcaatctctatattcggaaattgagtttggtggttatgagagctctatggaatcatgtgaaagggtgtctggcaaactatgggccagaggagatcttgcaacccaacatatactaccaagaagaaggattgttgtcttcagcaccatgggcatgatggaaattgtttttaacaggccactggacattataaggcggctattggaatccaactctccacgatcagttttagaagatttcttcaatcgttttggtgcaggtgaggcagctgcaatgtgtctaatgctagctgcaagaatagtgcattctgaaaaccttatcagcaatgttattgctgagaaggcagctgaagcttttgaggacccaagagttgttggcatgccacaacttgaaggcagtaatgcattatcaaacacaagaagtgctgctggtggatttagcatgggccaggttgttcaggaggctgagcctgttttttcaggtgcacatgaagggctctgtctgtgttcgtctagattactttttcctctgtgggaacttcctgtaatggttgtaaagggaagtttaggcccttcaggcactctatctgaaaatggagtagttgtgtgcagactctctgttggggctatgcaagtccttgaacagaaactccgatctttggagaaattcttaagatctagaaggaaccagaggaggggactttatggctgtgtagcaggtttaggagatctgagtggttcgattctgtatggtaatggttcggcattaggagttggggatcgaaatatggtaaggaacttatttggtgcatattccagaaatatggagtccaatggtggcataacaactaataaacggcaaaggttgccatatagtcctgctgaattagctgccatggaggtgagggcaatggagtgcattaggcagttgctccttagatctggtgaagccctatttttgcttcaacttctttcacagcatcatgtgactcgattgattcagggatttgattctaaccttcaacaagcattagttcagttgacatttcatcaactagtttgttctgaggagggagaccatcttgctacaagacttatatctgctctcatggagtattatactggtcctgatggcaggggcactgtagatgacattagtaggagattgagagatggttgtccaagctactataaggagtctgattacaaattcttcctagccgtggaagccctggagagatctgctatgaccatagatgccgaggacaaggagaatcttgcaagggaagcatttaattccttaagtaaagttccagagtctgtggacctacgaactgtttgcaaacgttttgaggatttaaggttttatgaagctgtagtgcgcttacctctacaaaaggcacaggctcttgaccctgcaggcgatgcttataatgatgatattgatgcaactgtcagagagcaagcacttgctcagcgggagctgtgttatgaaataattatcagtgctttgcggtctctgaaaggtgacaacttacagagggaatttgggactcctattaaatcaactgcttcacaatctgctcttgatccagcctctcggaaaaaatatatatgtcaaattgttcagctgggtgtccaatcacctgacagaattttccatgagtatctttaccaggctatgattgatttaggtcttgagaatgaattgctagagtatggaggtcctgatctgttgccatttttgcaaagtgctggtcgtaattctatacacgaggttcgtgctgtgacggccacaacttctccagtggggcaatcaggagcacctatgtcatctaatcaagtcaagtactatgaacttttggcacggtattatgtcttgaaacgccaacatatgcttgcagctcatgcattgcttagactagctgaaaggcgttctactgatggagttcctactcttgaacagaggtgtcaatacctaagtaatgcagttctacaggcaaaaaatgcaactaatagtgatgggttagtaggttctggtcgaatttccattgacagtgggttcctagatttgcttgaagggaagctcgctgttctttggttccagataaaaatcaaagaagaactagagtctatggcttccaggtctgatgttttacctggcacatcagagtctgccgaaaatggtgtagtccctgagggaagttctactgctgatgctaattttgcaaatgcaacacgagagaaggctaaagagctagcttcagatgtaaagagcataacccagttatataatgaatatgctgttccctttgggctctgggagatatgcctggagatgctgtactttgccaattattctggtgatactgacagcagcattgtcagagagacatgggctagacttatggatcaagctatatcaagagggggtattgctgaagcttgctcggtactgaagagggtcgggccccgcatttatcctggtgatggagctgttttaccacttgatattatttgtcttcacctagagaaggctggactggagaggttaaattcaggggttgaagctgttggagatgaagatgttgcaagagcccttgtttctgcttgtaagggtgccgctgaacctgtattaaatgcatacgaccaattgttatcaaatggggctattctgccatccccaagtgttagattacgtatgctgagatcggttctagtggtacttcgagagtgggcaatgtctgtatattcacaaagaatgggtagcagtagtgccactgggcattccttaatactaggtggaggattctcaacggaacgtactattgctagccaaggaatccgggacaagatcacaagtgcagcaaacaggtatatgactgaagtgcggaggttagcccttccacagaaccaaacagaacatgtctaccgaggttttagagaacttgaagaatcgtttataagccaacattcatttgatcgattttgataa

SEQ ID NO: 461 - DNA, 3220 bp, Glycine max
cttacaaatcccatccatccacaccgcacaactctgttcttcagaatattatggatgatctggagagagcgattcttgttatatttgatgaatccggaacccttgacgatgacttgaagaaacaggcagaactttactgtaatgatgttaaggagaagcctttaatttgtagattgtgcattgaaaaattatgcttttcaaatcttgttcaagtccagttttggtgcctacagaccttgcatgaagtcattcgaacacgatacttgacaatgaccccagatgagaggcacatgatcaggggctccgtcttttcaattgtgtgcctcgaagacaagaacctcacaagggttttggaaggccctgcatttataaagaacaagcttgcacaggttttgataactttgatttacttcgagtaccctttggtttggtcctccgtctttgttgatttttttccacatttgagcaaaggcaacgtggtcatagacatgttctgtagagttttgaatgccctggatgatgaactcattaatttggactaccctagaacccctgaggagttgacagttgcgggccgggttaaggacgcaatgagacagcagtgtgtgtgtcagatagttagagtttggtatgacattgtttctatgtaccggaattctgatcaggagctatgcactagtgtgttagattccatgaggagatatatttcttggatagacattgggttgatagtcaatgatgctttcatccctttgttgtttgatttgattttggttggtcctctgtctgttcagcttcgtggtgctgcagtcagatgcttgttagcagttgtttctaagcgaatggagccccaatcaaaactgtcattgttgcgaagccttcaaattagtcgggtacttaggttagtgaccgaggatggtgatgccgagctggtctctgatatagctgcattgctttctgggtatgctgtggaggctttggattgctttaaacacttaaattctgaggatgctaaaggaatttctatggagcttttgagtgaagtttttccctccattttctatgtaatgaagaattttgaggtagatgtcaatatcattcagtttctttcaggttatgttgccattttgaagagctttgctcctttgccggagaagcaactacttcacctgggacaaatattggaagttatccttgtgctaatccgttatgacccagcataccgcactaatcttgatttcatggacaaaattggtaaagaggaggaagataggatggtagagttcagaaaggatttatttgttctgcttcgcactgtgggtcgtgtagcgcctgatgtaactcagttgtttatcagaaattcgttggcaagtgctgtttcaagatcttcagatagcaatgtggaggaggtggaaggtgcactttctcttttatatgcacttggagaatccataagcgaggaaactataagaactgggagtgggttgttgagtgagctgttgcttatgcttctatcgacaaagtttccttgtcactctaataggcttgtcgcccttgtttatttggagacagtgacaagatatgttaagtttattcaggataatactcaatatattcccatggttctggctgcctttcttgatgaaagaggcatacatcattcaaacatcaatgtaagtcgtagagccagttatttgtttatgagggttgtaaaattgctgaagatgaagttggtgccttttatagagactattttgcagagcctgcaagatacagttgctcaattcactattacgaattatacgacagaagagctatcaggatcagaagatggtagccacatttttgaggcaattggtttattgattggaacagaagatgtcctgcctgaaaagcaatctgattatctatcttctttgctcagtcctctttgtcagcaggttgaggcactgctaaaaaatgccaagttattgaatgctgaggagactaatgctaaaattgctgtaacccagcaaattattatggcaattaattctctcagtaagggctttagcgagcgtcttgtaactgctagtcgccctgcaattggtctcatgtttaagcagacattggatgtacttcttcaagttcttgttatatttccaaaagtagaacctctgcgaaacaaggtcacatcttttatacaccggatggtggatacactaggagcatctgtttttccttaccttccaaaggcattggagcagttgcttgaagaaatagaaccaaagcagatggttggttttcttttgttactcaatcaacttatctgcaagttcaatactttggtgcatgacattttggaagaaatatttccatctgtcgccgagcggatattcagtgttattcctagaaatggattaccttctggtcctgatgcaatcactgaggaaattcgtgaattgcaagaacttcagcgaacactgtatacatttcttcatgtgattactacacatgacctgtctcctgtatttctttccccaaaatgtaaagcatacctggatccagtgatgcagttgcttttgtactcttcttgtaatcataaggatattcttgtaagaaaggcatgtgtacagatttttattagattaattaaagattggtgtgcccagccttatgaagaaaaggttcctggttttcgaagttttgtgattgaagcatttgctacaaactgctgtttgtacagtgtgctggacagatcttttgagctccatgatgcaaatacttttgttttgtttggagaaattgtgctggcacagaaggtaatgtatgaaaaatttggggatgattttctagttcattttgtatcgaaaggattttcttctgcacattgcccaccagatctggcagagcaatatcgtcaaaaattgcagggtggtgatttcaaggcactaaaatctttctatcagtcactagtggaaaatttgagactgcagcagaatggaagccttatattcagatagcatacttgtaatggaaaattaagagtcctcttcctatatatggctatgttttttggccgtctcctagtttggtgcttcatttctgtctactgaagtgcggtcatgaaacggtggtgaacactgcagggtggtgtatatagcttttgcggatgagagatggatattctccttgccctgattttgatgagttcctcatgcaacctgaccaatcagctaat

SEQ ID NO: 462 - DNA, 2558 bp, Helianthus annuus
ctttcgcatctgatacctcaccacacatggattcgttcggcggcgcatacttcaccgacgagaaagcagcgaaggtggagaacatcttcctcgagttcctcaagagctttaggttggatcagaactcacgagaactcttctatgaatcggagattgaagccatgaggccgaatgagtcgaatactatgtttattgatttctcacatgttatgcggtttaatgatgtgttgcagaaagctatttctgatgagtatttgaggtttgaaccgtatttgaagaacgcgtgtaagcgatttgtgatgggacagaaaccgacattcataactgatgacaatcctaataaggatataaatattgcttttcacaatctgcctatcataaaaagactgagagaactgagcacatctgagataggtagactagtgtcggtaacaggagtggtgactcgaacaagcgaggttaggcctgaactgatccagggcacttttaagtgcttggagtgtggaaccattgttaagaatgttgagcaacagtataaatacactgagccaatgatatgcatgaatgctacatgttcaaagaaaggaagatggacacttctcagacaagaaagtaagtttgcggattggcagagggttcggatgcaggaaacatcaaaagaaatacctgcagggtcactgccgcgatcgttagatgtcattctacgccatgacattgttgagcaggctagggctggtgacacggtgatctttacgggcactgtagttgtgatacctgacatcttggcattggcagctcctggagaaagagcggaggttcgtagagaaggtggtcaaagtcaacgcactggcggtggtagtgtccaagaaggtgtcaaaggtcttcgtgcattgggagttagagatctttcgtataagcttgcgtttattgccaattcagtgcagatttgtgatggtagaagggatgctgacatacgaaataggaagagggactccgaggatgatgacactctacggttcacgtcggaggaggtagatgaggttacacaaatgagacgtactcctgactttttcaacaagcttgtcgatagtatggcccctactgtttatggccatcaagacatcaagcgagcaatcctgcttatgcttttgggtggtgtccacaagtttactcatgaaggaatcaatcttcgaggagacatcaatgtttgtattgttggggatcccagttgtgccaagtctcagtttctcaagtacacaacaactttagttccgagatctgtatatacatctgggaaatcatcgtctgctgctggattgactgctactgtcgcaaaagagccagaaaccggagagttttgtatagaggctggtgcactaatgcttgctgacaatggtgtttgttgtatcgatgagtttgacaagatggatgtaagagatcaggttgccatacatgaggctatggaacaacaaacaattagtattacaaaagcaggaatacaagcaacgttgaatgcaaggacatctattttggctgctgcaaatcccactggaggccgctacgataagtctaaaccgttgaagtacaacgttgctcttcctccagccatcctttcaaggtttgacttggtatacgtcatgattgatgatcctgatgatacaacagattatcatattgcaaaccacatagtgcgtgtgcatcaaaagcgtgaagcagctgttgatccaacattcaccactgcacaactgaagcgttatattgcatacgccaagtctaaaaagccaaagctaaatgcagaagccagacaacttttggtggattcttatgttcatctccgtaagaatgatacggctccaggaagtagagtcgcataccgtatgacagtcagacagttggaggcactaatcagactgtcagaggcaattgccagatgtcacctggacgatgaggttctcccacgtcatgttagtttagcaaccaaactcctaaaaacttcagtaatcagtgtggagtcacaagaaattgatttgaccgagtttcaagatgagaatatagaacatggtgataacgaagaaaatggtgatattggagaaaacggcgaagctcagccaggtggcgcagatgctgacgcaaacaatatgaacccagaaaatgcagatggggccggagggaagaaacttgttataacagatgaatactttcaaagggttactcaagctcttgtgatgcgtcttagacagcatgaggaaatggttcagcgagaagggagtgggttagctggaatgaggcaaagggatctgatccagtggtatgtgaaacagcggaatgaaagtgaggcctacgaaaacgaagaagaggcaaaggctgaagtcaccaaggttaaagctataatagagagtttggtaagaagggaagggcatttaattgtggtgaacgaagaggaagtgccgccacaaggggaggatgatggaaatgccagacggccttctcggaacaacaggattcttgcagtggcacccaactatgttcttgatcaactcgactaatttatcggctaa

SEQ ID NO: 463 - DNA, 2147 bp, Solanum lycopersicum
tataagccctgtttggaccatctcaggtgctgtttgctataaaattttgagttttgagtaagagaaagaattgttgaaaatgagcatgaacaaatttggtttgaaggttgaggaaggaaaagaaggaaaaaatggagagccatctattggtcctgtttatagaaatccaatagctaaaaatggttttccatcagctgatcctgatttgtctacagcttggcaactctttagatcagctgttgaaaaatatccaggaaacagaatgctgggatggcgtgattttaaggatggaaagtggggtccttataattggaaaacctacaaagaagcttatgaagagactttgcagactggttctgcattacgggctcacggaattgaacctggtgctcgaattggaatttatggagccaattgtcctcagtggatagtagcaatggaggcttgcagtgctcacagtttgatatgtgttcctctctatgataccctcggatccggcgctgtagattttattattgaacatgctgagattgatatcgtttttgttcaagataagaaagtgaaagaacttctaaatgcagagtgcacacatgctaaacgcctgaaattgatcgtgtgtttcactttgctacagcaggaagaaaaggataaggcagtttcaatgaatatcaagccatactcttggaatgaatttctcaacatgggtaaagagaatccatcagagccttcaccaccacagccattagacatatgtacaatcatgtatactagtggaactagcggcgaacctaaaggtgtaatattgactcatgaaaatatgacagcatctgtaacaggagttgatcattttatggaagaattcgaagacaagatgacagtggatgatgtgtacatatctttcctaccacttgctcatatacttgatcggatgattgaagaattcttctttcataggggtgcttctgttggctacttccatgggaatattaatgagatacaagaagacatgatggagttgaagccaacctttttagctggagtacctcgagtttatgaaaaagtgcatgaaggtgtactaaaagcacttgaagaactcaatcctttcaggaggcacatgttccatgtgctatataacttcaagcttaaatggatgaatcttgggtacaaacagaagtatgcttcgcgactggctgatctactagcttttagaaaggttaagaataggctaggtggcaggattcgtctcatagtttccggtggtgctcctttaagcactgaggtggaagagttcttgcgggttacctcttgtggatttgtcctacaaggctatggtttgacagagacttgtggtttggccaccattgggcatccagatgaaatgtgcatgcttggaactgttggtccaccatttgtcttcacagaagttcgtctcgaggaagttcctgaaatgggatatgatccgctagcagacccttcccggggagagatatgcgtgagagggaggaccactttcactggatactacaaaaatccagagttgacaagagaagctatcaaagatggatggtttcatacaggtgacatcggagaaatgatgcctaatggagttgtaaaagtcattgatagaaagaaaaatgttataaagctatcacaaggagaatatgttgcattggaatatctggaaaaggtttatgctattgcgcccatcgttgaagatatatgggtatatggggacagcttcaagtccatgttgatagcagtcgtggcgccacatgaagggaatacgaagaaatgggctgataaaaatggccacaaaggttcaattactgaactttgttccctacaagacctaaaccaatatgttctccttgagctgaaatctgctgcagaaaggaacaagctaagaggtttcgagaacatcaaaggagtgattctggaacctcaaccttttgagtttgacaaggagttggtaactgcaacaatgaaaaagagaagggagagactgcttaagcgttacaagttggagattgatgacctttacaaaaggcttaatgcagcagctaaacgctgataagtttttgaatactgcgcaatgcatctcttcatcaatccactgcatgatcgtctggcgttgtaacgtttgaact

SEQ ID NO: 464 - DNA, 2065 bp, Solanum lycopersicum
aatctatggcggatgttgtacagtacaagctggagcgtatgctccctgagctcgacgaccttgaaaaacgctgtctttttagccgccaggaaatagcggaaatagtgaaacagcgccggaaatttgagtacaggctgaagagacctagtccattgaaacaggattttgtagcatacattgactatgagaaaagtctcgattctctaagacttctacgtaaaaaagctcagatgaaaacaacaggcgatagaaagctgaaaaagtctgtttcagattatgctggagtttccaggattattgagatttataggctcgccaccaccaggtttaagggagatatagagctttggtttcagtatttggagttctgtagggagcgaaggaacggtcgaatgaagaaggcccttgcgcaggtaatcaggtttcatcctaaggtgcctggagtatggatatatgctgcagcttgggaatttgataacaacctaaatgctgctgctgctcgtgccctaatgcatagcggcttgagagcatgtccaacttctgaggatctttgggtagaatatctccgaatggagctaacttacctaaataaattaaaggcccgcaaagttgtgttaggagaggatgagggaacactagctcgttctggcaatagtgctaaagaggaacagtggagagatgagaacaaggaattatttattgtccttgatgataaaagagaggaagacaaattatccaaccttcacgacggagactctaaggaaaaattagatttgtttaggaaacaaggtttaagtgttctccagacagtttatggtggttctattaaagccctcccttccagtttcagtttaagaacaaagtttcttgacatactagaagcaacagatttaggtcattcagaagatatgcgaaatgaaatacttgctgatatgaaacgggacttctcaaaagaaccaaagtattgggattggcttgcaagacaggaagtgattgatcttaataatccagagactactgaagcaatgacagttgatcaattaagcagcgctattcaggtttatgaggagggtttaaaaattgttccttcagcttcaatgtttgattgttatgcaaagttcctgacggatgtcatccattttaaaaacaagggaagtcaatcttctgagcttttcagtacagctagtcatgctatggatcctatttcacatctcttggtagtatatgaaaaggctgaaaccatggggtgcatcacagaagatcttgcttgccagcatgtttcttttctactgcaacttgggaaagtagatgaagctaagactttggcggagaaattgtgttctggaaaattttcagaagcagtgcagctatggactttacgattctcaatagaaatgagatttatccagaagaactgtactccaaataaggcagctctgtcttctatctttgaacccatgagaaatgctttgttgaaacttcccatatcagaagcagaaactatatggcttatggcgctcaaatatttttccactcataagaaattctttgacaagttggttgagacttctatatctttactggccaaagatggtggaagtgatgatggtttttccctctctgctaccatcgtcaattttgttctgcaaagggatggacttgggagtgctagagagttgtataagagatttcttgctttaccgcatccaggactttctttgtacaggaattgcattgagctggaattgaaccttgcgtctagtggagataagattagtcttggaaatgtgcgaaaactatttgaaacttcacttacaacttatgatcaagatgtcagattgtggcaagactattataatatggaagtcaagttgggaacatcagaaactgcagcagccattcactggcgagcacggaaaaccctgaagaagagtatttcccttctaccctcactgaatatgtgatcaatctcatgtgtgaatactgtcaaaattttgacttgggaatgaatactttgagcaagtaatataaccaaagttctctgtggaggtctggctaatgtgat

SEQ ID NO: 465 - DNA, 2504 bp, Solanum lycopersicum
ggaggatggcttccgactcatctccggtcaatgctcgcggcggtccatctacaccagatgattccatttcaagtccaattggcaacacttactcttctcctggcgactctgctcgccggaagcgtggccgccgctcggcctcatcgacgccagtagcaccgtcaaatcggcgattcacaactcctgaggctacaccaacaccgtcgagtactaatcctcgccgtggtggaagaagagcatcctccaacactcctaccggtgccgcgactccatcctatgcctctgatgttccgccttcctcagaaggcggggaaggtgatgatgccgatgataccccacctatgtatgtgtggggcacaaacatcagcgtgcaagatgtaaacgctgcaatccttaggtttttgaggaatttccgggaggatccttctcaaactgaggggaaatacatgagggcagttcataatgtaattgaaatggaaggcgactcactcgatgttgatgcgcatgatgtgttcgactatgatggtgatttgtataccaaaatggtcagatttccacttgaggttctagcaatttttgacattgtcttaatggacatggttagcagaatcaacccactctttgaaaagcacatacaagctagaattttcaatcttaagacgtccacttcaatgagaaatctcaatccatctgatattgagaagatggtgtcactcaaagggatgattatccgttgtagtgcaattattccagagataagagaagcaatatttagatgtcttgtttgtggctattactctgacccaattgtcgtagacagaggaagaattagtgagccgacaatatgcggcaagcaagaatgtctggcaaggaactcaatgactctggttcacaatagatgcaggtttgctgataaacaaattgtgagagttcaagaaacaccagatgagatccctgagggaggaacacctcacacagtaagcttgttgatgcatgacaagctggtggatgcggggaagccaggtgacagagttgaagtcactgggatttatagggctatgagtgtcagaattgggccagcacacaggactgtaaaatcattgttcaagacttacattgactgtcttcatcttaagaagactgacaaatcaagaatgcacgcagaggatccaatggaaattgaaaatggtgttgttggaaatgatgagcctcttgatcatgaagaaaaggtggagaaattgatagaactatctaaacagcctgatatctatgaaaggctgaccaggtccttggcaccaaacatatgggagttggatgatgttaagaaaggccttctttgccagctctttggtggaaatgcattgaccttgccgtctggagcaagcttccgtggtgatatcaacattcttcttgttggtgatccggggaccagcaaatcacaactgctccagtatattcacaaactgtctcctcgtggtatatacacaagtggacgaggaagttcagctgtggggttgactgcttatgtagccaaagatcccgagactggtgaaactgtccttgagagtggcgctctggtcttgagtgacagagggatctgctgtattgacgagtttgacaaaatgtctgacagtgccaggagcatgttacatgaggtgatggagcaacaaactgtttcaattgcaaaggctggaattatcgcttcgcttaatgctaggacttcagtattggcatgtgcaaatccaattggctcccgttacaatccccgattatctgtcattgataatatacaccttccacctaccctgctgtctagatttgatttgatatatttaattctagacaaagcagatgagcagaccgacaggcgccttgcaaagcacatagttgctttacactctgagaatcctgagaactctgagcaagaagtgattgaccttccaacattagcttcatacttgagctatgctcgaaaacatatacatccacaattatctgatgaagcagctgaagaattgactagaggttatgtggagatgagaagaaaagggaatttccccggtagcagtaaaaaggtgattacagctacaccaaggcagctagagagtttgatacgtctaggtgaaggtcttgctcggatgcgtttttcagaaaaggtggagaaaagagatgtagtggaggcttttcgacttctagaagttgcattgcagcagtctgcaactgaccatgctacaggaaccattgacatggatctcatcacaactggagtatctgcaagtgaaaggatgagaagggagaatttggtgtcaagcacccgcaacataattatggagaagatgcagcttgggggaccatcaactcgtttgctagagttactggaagacgtcaagaagcaaagttctggtggtgaagtccacctagcagatctgcgaaatgcactggctaccctcgcaaccgaaggactggttgttgttcatggagacactgtgaagagaatatgatga

SEQ ID NO: 466 - DNA, 742 bp, Solanum lycopersicum
tgtaatgtaaatacatgaaagctaccatgggagagtttcttaagaaatgcgagaaaatcaatggtgggatgaaggtgacggagcttggaaatggaggtttgagaataagagataatgatgtggaggaggaggttacgagtaattgttctatgagctattcaactaagagaagaaaatttggttctgttacagacgttgattttagtgagaattcagcttcgccggctacatctgtaacgtctgttcatattccgacgaattcgcagtgttcgagttgttacgagtctggtgaagttatgatgaagagtattttgaaatcgttagatctgaaggccgagaaattcggaacggacaattctgcttcttttaacggcggtttcagtgaaaatttcaagccaattgatcaaccgaatccacctagtgagcattgcggagactcggaagatatggagtcatcatccacgacaaccaaaaaatcatcttcgtctgccagtgctcccaggaaacagctgtctgcgtcgaaggttccaccagaagcagagatcgaagaattcttttcagcagcggaaaagcgcgaacaaaaaagattcgcagaaaagtacaattacgatatcgtgaaggacgctcccttagagggacgttaccagtgggttagtttgaagcctcgaagaataaatgaatgaagaaaaatagagatgagagtacaattgctgaaggggcggaatccaattctctgatcctt

SEQ ID NO: 467 - DNA, 1375 bp, Hordeum vulgare
cgccaccaggcaagtagtagtaaaaggcaaaagcacggcacattaaaagagaggccagcccagccccggaccggaccggagccaagcagcagccgcagccgcagccgcagcagaggagagagagagggagggagaagcatatatggcgatgccctttgcctccctgtcgccggcagccgaccaccaccgctcctcccccatcttccccttctgccgctcctcccctctctactcggtaggggaggaggcggcgcatcagcatcctcatcctcagcagcagcagcagcagcacgcgatgagcggcgcgcggtgggcggcgaggccggcgcccttcacggcggcgcagtacgaggagctggagcagcaggcgctcatctacaagtacctcgtcgccggcgtccccgtcccgcaggacctcctcctccccatccgccgcggcttcgagaccctcgcctcgcgcttctaccaccaccacgcccttgggtacgggtcctacttcgggaagaagctggatccggagccggggcggtgccggcggacggacggcaagaagtggcggtgctccaaggaggccgctcaggactccaagtactgcgagcgccacatgcaccgcggccgcaaccgttcaagaaagcctgtggaaacgcagctcgtcgccagctcccactcccagtcccagcagcacgccaccgccgccttccacaaccactcgccgtatccggcgatcgccactggcggtggctccttcgccctggggtctgctcagctgcacatggacactgctgcgccttacgcgacgaccgccggtgctgccggaaacaaagatttcaggtattctgcctatggagtgaggacgtcggcgatcgaggagcacaaccagttcatcaccgcggccatggacaccgccatggacaactactcgtggcgcctgatgccgtcccaggcctcggcattctcgctctccagctaccccatgctgggcacgctgagcgacctggaccagagcgcgatctgctcgctggccaagactgagagggagccactgtccttcttcggcggcggcggcgacttcgacgacgactcggctgcggtgaagcaggagaaccagacgctgcggcccttcttcgacgagtggcccaaggacagggactcgtggccggagctgcaagaccacgacgccaacaacaacagcaacgccttctcagccaccaagctgtccatctccatgccggtcaccagctccgacttctctggcaccaccgccggctcccgctcgcccaacggtatatactcccggtgaacggcgtcggccggcctgatctctgctgatttgccgtggtcacgacggacgtcctcaaatcatcacagatgagcg

SEQ ID NO: 468 - DNA, 1091 bp, Hordeum vulgare
gatagagagagcgtgtgtgtttgtgtgagggtgagggatcgagcgagccatgggccctggaatgcttgagatggcgatattctacgcacaggagcgcagcttcttccatcggctggtgcgcgacctcgggcaggagagggagcacatgaggtgggtgatcgcgctctggctctggctcgaggccgatgggcacgacaagttcatgcgccgcgcgtccgcgctcccgggccccgtcgtgctgcgcttcgtcgacgaggcgctggcgtgcctcgcccgcctcgcgggccgcgagctcgccggcgccggcacgctcctcccctgcaccaacgcgctcctcaacaggcccatcgacgacgtcacctacttcgaggagcaccgcgacaagatcatgcccggcgtcaagttactgtacaagaccgtctgccgcgtcgtcctcgacgacacctgcgcctccgacgacgccatcttcttacccaggagcagcaccgcctccgtgccgcgcgccatcggctctcccgcgttcgccggccccaccccggtccccgagacgccgacgacgccgacgacgccgaggttcgccgacctgaacgcgataatgacgccgaggttctcccagctgaacgcgatggcgccgccgtggtcaccggtccgggtggcgcagcagcatcaccagcagcaccaaatgatcatcgacccccttccagaggagttccgctcgctcttcatcaccttctcccgcggctaccctatcgacaaggacgacatcaaggagttcttcaactcgctgcacgggccgtgcgtggaggacgtgatggtggagagggcgccggcggggcagcttccggtgtacgggagggtggtgctgcagagcccggacatgatcccggtgctgctcgggggcgagccgacggccaagtacatcatcaagggcaggcacctctgggccagggtctacgtgcccagctccaggcactccaccttcatcgaagcctgaatgcttgatccatcctacaattaagaaactgtgtgcatgaagttggagcttgaagatgcatgtgtcatggcgatggcacagtcggttactcggttaa

SEQ ID NO: 469 - DNA, 1048 bp, Phaseolus vulgaris
gacaatggcgtgctgaattactgcatcttttcttacttccccactctgcagcttcattttctgcaaaaatggattcgccattgctgtttagccacctcaagggtgcagacccgttcttcctgctagcgggacctaatgtgattgaatcagaggatcacattctgcggatggctaagcacatcaaaagcattgcatctgaagttggaatacctttggttttcaagtcaagctttgacaaagctaaccgaacatcatcaaaatcatttcgtggcccggggatggttgagggattgaagatactcgagaaggttaaaatagcttatgacatccctatagtgacagatgtgcatgagaccatccagtgtgaagcagttggcagagttgcagatatcattcagattcctgcattcttgtgtcgccaaacagatcttctagttgcagcagccaaaactgggaaaattatcaacattaagaagggccagttctgtgctccttctgtcatggcaaattcagctgaaaaggttcggttagctggaaatcctaatgtgatggtttgtgagaggggaacaatgtttggatacaatgatttgattgttgatccacgtaactttgagtggatgagagaagctaattgtcccattgtagctgatataacacattctctacaacagcctgctggaaagaagttggatgggggaggtgttgcaagtggaggtcttcgagaactaattccttgcattgcaaggacagcagttgccgttggagtggatgggattttcatggaggtgcatgatgatccactgaatgctcctgttgatggaccaacacagtggcctttgcgccatttgaaggagctacttgaggagcttgtagctattgctaaggtaagcaaagggaagcaacagttcaaaattgatctcacgccatttcgtgaataatggtgatggttttcagttatgctgaatatgattctgtgagtattgatgttttaagattgctcaaggttgaatacaaaactgtcttctcccacaagggccttataaagaga

SEQ ID NO: 470 - DNA, 1632 bp, Phaseolus vulgaris
gggcaagaagagaagtgatagcagagagtttttgttgatggcttcgttggcgatggtgcaaggtggaggtgtggatgaacggtgcgtgcagaaaagctattggatagaacacacgacggagctatcggttgagtcaatgatgctggattcaaacgcttctcatctcgacaaggaagagagaccagaagttttgtccttactaccagcatatgaaggaaaatcagttctagaacttggagcaggtattggaagattcacaggtgaattggccaagaaagctggccagttacttgctgtggacttcattgagagtgctataaagaagaatgaaaacattaatgggcaccacaagaatgtcaagttcatgtgtgctgatgttacatctccaaacttgcagatttctgaaggatctgttgatctgattttctcaaattggttactcatgtatctttccgacaaagaggttgagaatttagctggaaagatgatgaaatggttaaaagtaggtggatatgtattcttcagagaatcatgtttccaccaatctggagattccaagagaaaatacaacccaactcactacagggaaccaagattttacactaaggtgtttaaagagtgtcataagagtgatgacagagggaattcctttgaactttcgcttattggatgtaaatgcattggagcttatgtacgaaacaagaagaatcaaaaccagatttgctggatatggcaaaaagtgagatcagaagatgatagggggttccagcggttcttagatagtgttgagtataatcacaaggatattttactctatgagactgtttttggccaaggctttgtgagcacaggaggacttgaaacaacaaaggaatttgtggcaaagttgggactaaaagcaggccaaaaagttttggatgttggttgtggaactgggggaggtgacatttacatggctgaaaattttgatgttgaggtagttggcattgacctctccataaacatgatttctcttgccattgaacgtgtaattggactcaaatgctcagtagaatttgaatgtgccgattgtactaaaaaatcataccctgagaacacatttgatgtaatctattcccgtgacacattgctacacatcaaagataaaccatcactgtttagatcattttacaaatggttgaagcctggaggtactcttctaataactgattactgcaaaagtgtgggaagtctatcagtaggatatgctaactacatacaaaagggaggatactatatccatgagatgaaaacatattctcagatgctcgaatttgctggatttaatgatgtcattgccatggatcaatctaatttgttcatgaaaacactacaacaggagttaaatgaccttgagagcaagaaggatgatttcattgattatttctccaaggaagactacaataaaattagtgaaagatggaaggccaagcagatgaggggtgcagatggtgaacaaatatggggcttgttcattgccaagaaaaaatgatgcttcattctcatcatatctcttattatgcctatatattctgttgttatttatatgttttgagaaaagaacgtttgtgcactctagcacaacataaacca

SEQ ID NO: 471 - DNA, 1349 bp, Setaria italica
caaagatgaagatcacggtgcgggggtcggagattgtgtacccggcggcggagacgccgcgtcggcggctgtggaactcgggcccggacctggtggtgccgcggttccacacgcccagcgtctacttcttccgccggaaggacgcggaggggaacgacctggcggccgcggacgggagcttcttcgacggggcacggatgcggcgcgcgctggcggaggcgctggtgcccttctacccgatggcggggcggctggcccgcgacgaggacggccgcgtggagatcgactgcaacgcgggcggggtgctgttccaggaggcggacgcgcccgacgccaccgtcgacgacttcggcgacttcgcgcccaccatggagctcaagcgcctcatccccaccgtcgagtacaccgacgacatctccgccttcccgctcctcgtgctccaggtgacacacttcaaatgcggtggcgtcgcgatcggcgtgggcatgcagcaccacgttgccgacggcttctccggcctgcacttcatcaactcgtgggcggacctctgccgcggcgtcccgatcgccgtcatgccctacatcaaccgctcccacctccgcgcgcgtgacccgccggccccggcctaccctcacatcgagtaccagccggctcccgccatgctctccgagcctccgcaggcgcccctcacggcgaagccggcggcgccgcccaccgccgttgccatcttcaggctgagccgcgccgacctcgggcgcctccgctcgcggatccccgcgcgcgagggcgcgccgcggttcagcacgtacgcggtgctggcagcgcacgtgtggcggtgcgcgtccctggcgcgcggcctccccgccgaccagcccaccaagatgtactgcgccacggacgggcggcagcggctgcagccgccgctcccggaggggtacttcggcaacgtgatcttcacggcgacgccgctggccgacgccggcacggtgacggccggggtggcggagggcgcggcggtgatccaggaggcgctggaccggatggacgacgggtactgccggtcggcgctggactacctggagctgcagccggacctgtcggcgcttgtccgcggcgcgcacacgttccggtgccccaacctggggctcaccagctgggtgcgcctgcccatccacgacgcggacttcgggtgggggcggcccgtgttcatgggccccggcggcatcgcgtacgaggggctcgccttcgtcctccccagcgccaaccgcgacggcagcctgtccgtggccatctcgctgcaggccgagcacatggagaagttccggaagctcatctacgacttctgataa

SEQ ID NO: 472 - DNA, 1367 bp, Setaria italica
ctcgcatggattcgctgccgcggaagcggaagggcgcgcgcgccgcgtgctcgctggccggatccctccacgaggcccccgccgccgccgccaccgctcgcaagcgcacctgccgcgagcccaagccgcggcccgagaagaagaagctctcctccggcggcggcgacgaggcggcctccgcctcggcccggggtggcgtggtgatgacggcgccgccggccagcgggcgggcggcgcccgacagccccggccgcgggctgaagcggaagctgggctgcatcgagtccgccacgcggatggggcggaagaagcggctcgacagcgagtacgagctcggcgccgagatcgggcagggcaagttcggttccgtccggatctgccgcgccagggcggggggcgaggagttcgcctgcaaggcgcttgccaagaacggcgaggagacggtccaccgcgaggtggagatcatgcagcacctctcgggccacccgggcgtcgtcacgctcaaggccgtcttcgaggacgccgaccagttctacctcgtcatggagctatgcggcggcgggaggctgctcgacgagatcgccagggaggggaagttctctgagcagcgggctgccattgtgatcaaagatctcatggcggtgctcaagtactgccacgagatgggtgtcgtgcacagggacattaagccggagaatattttgctcaccaaggcagggaagatgaagctcgctgatttcggacttgctgcgcgtgtcactaatggtcagaaattgtctggcatagctgggagcccagcatatgtggcacctgaagttctttctggaagctattctgagaaagttgatatatggggtgctggtgtgctactgcatgtactactgcttggctcacttccatttcaaggaggctctctggacgccgtctttgagtctataaagatggttgaacttgatttcagcagtagtccatgggaatcaatatcaggtctcggaaaggatcttattggtcgaatgttgaatcgagatgtctcttctagattgactgctgatgaagtccttagtcacccatgggtcctgttttacacggaatgccccctgaaggtggtaactgctaatttgtgtgtcactaacaagattatagcacccataattccacggggcagacttaggtcagaatgtgagtcattgtcagacttaagccagagttcagaggagcaggatgaatgtggcatagttgacgcactgacagcagcaataacccgtgttagaatatcagagccgaagagaagtcggctctgtagccctgctcttcagcaggaatgctcttcaaacttgaagagcaatctgtgcacggctttctgataa

SEQ ID NO: 473 - DNA, 875 bp, Setaria italica
gcacgatggcggcgcgtaaggagtggagcatgtccgacttcgagatcggcaggtacatcggcgaggccgcgagggcaagtttcgcccgcgagaagaagttccactcgcacctgcggcgggagattgaaatccagaaagggctcgatcaccccaacgtgctccgcctcttcgcctggttccacgacgaagagcgcgtcgtcctcgtcctcgaatacgcggcccgtggtgagctgtacaaggtcctccgcaccgctggccgcttcaccgagcgcaccgccgccaccataaggaccccttgcccctatgaaaacggcagaggaaaaggaaggagaaagaaaagcaccttatccgcttccttcgtcctaaattaccattcgttttgccttgctggtgcactggcgcactgtcacaggaagcaggtcattcatagggatatcaaaccagagaatctgctacttgatatcgagggccggcttaaaattgcagattttggatgggcagctcgatcaaatgctaaacgacacacactatgtggcacaattgattatctggcaccagagatgatagataaaaaagctcacgatcatgctgttgacaactggactttaggaatcctgtgctatgagttcttatatggctcacctccttttgaagctgataaacaggctgataccttcagaagcaagatagttagagtggatttgacattcccttcaactccttccgtatcttcagaagctaaggatctcatttccaagcttctagtgaaggattcaagcaagaggctttctcttgaagacataatgaagcatccatggatcaaaaagaatgcagaaccttcagggagttgcattaagcaaaaagacctatgataa

SEQ ID NO: 474 - DNA, 359 bp, Setaria italica
tcctcacatagagaagttcactgcttttccccatggcgctcaccaagtgcgccatcgctgttttcttggttcttgcagtcatgtctaacacatccacatgttgtgttagggcaatctgctcgggctgccctactccgaagccaaaaccagggatgccgtgcttccacgctggatcctcacagcacccctgtacgactgagaagtgctccaggttatgcgagcacctaaaccacaatggcactttggcctactgtcgaagtgcttctccaggggtgtgctgctgcccaaatgaatagatgaatccatatgtttaatgataatgcaatacaataaggttttgtattactctcgtcattcaa

SEQ ID NO: 475 - DNA, 1649 bp, Setaria italica
ggatccaggccatggcgcgggagcaggcgctgctctcgacggagatcgtgaaccgcggcgtggagccgtcggggccggacgccgggtcgccgacgttctcggtgcgcgtgcgccgccgtctgccggactttctgcagtcggtgaacctcaagtacgtgcggctggggtaccactacctcatcagccacggcgtgtacctggcgaccatcccggtcatcgtgctggtgtgcggcgccgaggtgggcagcctcagccgggacgagctgtggaacaaggtgtggggggaggccacctatgacctcgccaccgtgctcgccttcctcgccgtcctcgccttcaccatctccgtctacatcatgtccaggcccaggcccgtctacctcatcgatttcgcctgctacaagcccgccgacgagctcaaggtgtccaaggcggagttcatcgacctggctcgcaagtcgggcaagttcgacgaggacagcctggcgttccagtctcggctactcgccaagtccggcatcggcgacgagtcctacatgccgcgctgcgtcttcgagcccaacgtcaactgcgccaccatgaaggagggccgcgcggaggcgtccacggccatgttcgccgccctggacgagctcttcgacaagtgccgcgtccgtcccaaggacgtgggcgtgctggtcgtcaactgcagtctcttcaacccgaccccgtcgctgtcggccatgatcgtgaaccactacaagatgcgcgggaacatcctgagctacaacctcggcggcatggggtgcagcgcgggcgtcatcgccatcgaccttgcacgcgacatgctgcaggcgagcggcgcggggctcgccgtcgtggtgagcacggaggcggtctccttcacgtggtaccccgggaagcggcggtcgatgctgatcccgaacgccttcttccgcgcgggttgcgcggcggtgctgctctcgaaccggcggcgcgacttccaccgcgccaagtaccagctggagcacgtggtgcgcacgcacaagggcgccgacgaccgggcgttccggtccgtgtaccaggaggaggacgagcagcggatcaagggcctgtccatcagccgcgacctgctggaggtgggcgggcacgcgctcaagaccaacatcaccacgctggggcccctggtgctgcccttctcggagcagctgcttttcttcgccggggtgctgttccgccacctgttcccgtccaagacctccacaccgccgccggcgacgacacccggggacgcctccgccgcggccccctacatcccggacttcaagcgcgcgttcgagcacttctgcatgcacgcggcgagccgcgacgtgctggagcacctgcagagcaacctgggcctgcgcgacggcgacctggaggcctcccgcgcggcgctgcaccgcttcggcaacacctccagcagcagcatctggtacgagctggcgtacctggaggccaagggccgcgtccgcaggggcgaccgcgtgtggcagctcgccttcgggtccgggttcaagtgcaacagcgccgtgtggcgcgccgtccgacgcgtgcgccgcccgtcgcgcagcccctggctcgactgcgtcgaccagtacccggcgcgcatggacgcctagtaagaattc

SEQ ID NO: 476 - DNA, 1313 bp, Gossypium raimondii
ttaattccgtttctcacatctcacaaaagagaacaaaaagaaatatgtgtacctctaaggctaaggtgaccacaggcaccactcatgttgaaataacaccacctgctgtcgcccggatcaatgggcgtcctgtccttcagcctacttgtaatcgtgttcctagccttgatcgtcgtaattccttgaaaaaaataccacccatctctcctccaccacctgcatcactaccatttacgccatcagccaccagtactacaactgttgccaatggtagcagggctaaggcctcactcacaccgcctttatccccaagctcaaagttcaccaccaccaagcgatggagtgatcccaatgcgttgaactcaagttctgaaaaggttgccattcccagaaacaccacaaaaaccttggataggaagaaatccaaaagtttcaaagagggtatggggaataatggattatcttcttatattgagccatcattgagttattcttcttctctgctggttgaggctccaggaagtattgctgcagtcaggagggaacaggtagctcttcaacaagcacaaagaaagatgaaaattgcacactatggaagatcaaaatcggccaaatttgaatctaaggttgttcctctcgacaataccaagcctgccgaggaaaagaagaggtgcagtttcattacgcccaactcagatcctatctatgtggcttaccatgacgaagaatggggagttccaatccatgacgatagcatgctcttcgagttgttggttctaagtggtgctcaagtaggctcggattggacttcaatcttgaagaaacgtcaagatttcagggatgcattttcagggtttgatgcagaaactgtagccaacttcactgaaaaacagatgaccacaattagctctgaatatgggattgacataagcagagttcgaggtgttgtggacaacgccaaccgtattctcgaggttaagagggagtttggatcatttgacaaatatatatggggatttgtgaatcacaagccgatgtcgacgcaatacaaattcgatcacaagatcccagttaagacatcaaagtctgagagcataagcaaggacatggtgagaagggggtttaggtttgttggaccaacggtggtccattccttcatgcaagccgccggtctaaccaacgaccacctcatcacatgccacaggcacctcccttgcgccttgttagccatccaaaggccaccggtccactcactccctgatttgtagatgattatgaattgacatttagacatatccaggcaacaataatgc

SEQ ID NO: 477 - DNA, 1614 bp, Zea mays
gttaggagctgggtgactgacgggggaggcccaccggacgtacgtgatcggcagccaagccaaggcgatgcctgcagccgcggctccagctccacacaccaggaccaggaccaggtccagcggcagccccagcgcagccatcggccccccgcttccttactggggcggcgccgctgttggcgcagaggagcagaggtggcgcatcggcatggactccgccgccgctgccctcctcgactccgcctccgcgtccgcctcttccgccaacgccgcaggcaaggagatgcccaccgcccgccacatcgcccaccgcaccgcccacaacatgtcctcctcctcgctccgcaagaagtccgacctcgcgctcctccgcaaggtcccctgcgccccgctccgacgcctcctcgacaacctccaggaggttttgctcgccaccaagctcgccctcctcttccccgccgttctactcgcgatcgccgcgcgaatcttccacttcggccaggaatgggtctttgtgcttagcttgatcggtctcgttcctcttgctgagcgacttagctttctgactgagcaggttgcgttttacatagggcctactgtgggtggactgttgaatgcaacatttggaaacgtaacagaggtcatcattgcgatctttgcactctatcaaggcaaggtagtggtggtgaaatgctccctgctaggctcagtcttgtccaacctgttgcttgtccttggaacctcccttttctttggtggcctggctaaccttggaactgagcagctatacgacaaaatgcaagtagatgtcagcacaggacttctgattcttggtgtgctatgccactctctgccactgatgctgagatatgctgtgagctccggggagcacgcagaatcctcttgggattcaggactggagctgtcccgagcatgcagcattgtcatgctccttgcctatgtagcctaccttttcttccaactgaaaacccaccgccaactatttgaaccccaaccccaagaggttgaagatgatggtgatgattcggtctctcaagacgaggcagtactgggattttccagtgcaatgatttggctgggagtcatgaccctgatgacagcactcctatcagagtttgttgtgagcacaattgaggcagcatcggaatcttgggagctatctgtcagtttcattagcgtcatcttgattccaatagttggtaatgcagcagagcatgctggtgcagtgatatttgcgtttaaaaacaatctggacatcaccctcggagtatctttggggtccgctacgcagatttccatgtttgtggtgccattgagtgtccttgtagcatggatcatgggagtcccgatggatcttgatttcaacttgcttgagactggttgtttgtttcttgcaatattagtaacggccttcacgctccaggatggatcatcacattatctgaagggactgctgcttgtgtttttctacattgtcatctccttatgctttttcgttttgagacagcatggaaatggaagcaacgatgatcagctgggtgtagcaagcaagccatggaggatttagggcgcctgagctggcagtagtttctc

SEQ ID NO: 478 - DNA, 741 bp, Zea mays
gttagttattccgtgccgtcccaactcacccgcggctccgtaccatccgtcgccgccggcgcaccgcgatggccgcctccgccccggccgtgaggcctctcgcccgggccgcaatccctatcccgctctctgcgcgtccgcggaccgccagggtctccttgctccccctggctcctcctgctccggcccagcgcctcgctctcgggcggaccgggcaagcgcggctgccagcgcgcagccggtcggtgcggtgcctggcggcgctgagcccggagatgcgggagacgctggacaaggtcgtggggtccagcaaggtgttgctattcatgaagggcaccaaggactttccgcagtgcggcttctcccacaccgtcgtgcagatcctgcgctcgctcgacgtgcccttcgagacgctcgacgtgctcgctaacgaggcgctccggcaggggctaaaggagtactccagctggcccaccttcccgcagctctacatcgacggcgagttcttcggcggatgtgacatcaccgtcgaggcatacaagagtggagaactgcaggaaactctagagaaagcaatgtgttcgtagaaaaaaatgaacaataagcagatggcatacaattaatcaaaatgttatagtatttgctgtacaattcaggcttgtcatcaactggagatgcaagttgtggataattcatgtccaaatgttcagtgcactttcgactggaaatacatctttctgc

SEQ ID NO: 479 - DNA, 407 bp, Zea mays
acgagatggcttcctgttcctcatcgccacggccacccaccatccctctcctcctcctcctcctcttcctcctcctccacttctcctccgtcctcgccgcaccagctcctccagccttgtcacaacaggctggtaccggcggcggcaatgcgacggattcggcggcggcgtggacgccgcggctgaggaagacgttcttggacggcggcatggagcgctggcgcgggcggcggctggtggggcggttccaggtgtgcgcggtgtgcacctgctgcgggggcccgcacgggatgtgcatcccggcgccctgctgctacgccatcaactgcaacatccccaaccgccccttcggcgtctgctccttcaccccgcgcacctgcaactgcctcacctgccacctctagtag

SEQ ID NO: 480 - DNA, 1633 bp, Zea mays
gtcactcatggactctcctctaatggagcccctactagtgcccaacaaccacagtcccggtccggttgtcgccgccacgccgggagaacacggcggtgctgcggtcgacgagagcagcaccctcgtggatgctgccagtggcacggatgagagccacagggcactcgccgacgccgacgtgaagatgaacgacgatggcgacgtacaaggggacgagctgtccgcgtccgtgcagcgccggctggacgagagcagcgccgtggagggggaggatgaagaggaggagattggtgacgacgcggaggccgacgacatggcggcgcgcatgggacggcgcctggcggcgctgcccgggaatgcgcatgagagcgagccgttcaccatcttccgcgtggcggggcccatgcgcgaccgcaaccggcacctctacgagccgcagatgatctccatcgggcccttccaccgtggcgccggccggcacctcgccgccatggaggagcacaagtggcggtacctccgcgacattctggcccgccccggcggcgcgacgctggcctcgtacgcccgcgccgcgcgctcgatggaggcctccgcgcgccgccggtacgcggagcccgtgctgctgcccgcggccgagttcgccgagatgctcctcctggacggctgcttcctggtggagttcttcctcaaggggcaggagagcgcggaggacgcgctcatcgacgcctcgtgggcgatgcagaacgtgtacaacgacatgctgctgctcgagaaccagctccccttcttcgtgctcgagcgcttctacgacctggccacgggcgggctcggccgggactacttcgtcaccaacgtcctcgtcaactacctcaccgtggacatgtgcgtcggcccgcgggaccccgagagcacgcggccccccgacggtgagatccaccacctgctgcacctctactactactggttcctgccaccggaggaccgggacgggagcggcacgggcagcaaggacaaggaagacggcgaggcgctcgaggaactgatgtccacgtctgcggatgagcgcatgccgtggcagctgccgccggcgtcggagctgaaggactccggggtgacgttccgcgccaagaagtcgccgcggagcatggtggacgtgaccttcgaccgccgcagcggcgcgctggagatcccggccgtggagagctacacgaaccacgccatcttcgcgaacctgctggcgtacgagcagagccggggccggtgggagctgcagcgcctggtgagctacgtgctgctgatggcgtccgtggtggacgcgcggcgcgacgtggaggtcctgcagcgggccggcgtgttcgtgcgcggggacgaggagacggcggcgttctacgcgcacctgggcgagctgtgcccgccgcccgagttcgtcaacaactgctacgccgacctgttccgcgacgtcctggagtactgtgggcgcagctggaacaggcaccgcgccgtgctggtgcacgactacttcagcaacccgtggaccagcatgtccgccgccgccgccgtcttcctgcttgtcctcaccgtcgtgcagacggtctacaccgtgctgccatactacagccagaattaacggtaa

SEQ ID NO: 481 - DNA, 2632 bp, Zea mays
ggcaacaggaatacagcaggggaggagagggggggcaaccggcggcggtcggtcgcggaggatggtgaagttctcgcgggagtacgaggccagcatcatccccgagtggaaggccgccttcgtcgactacaggtgcctcaagaagctcgtcaagaggatcaagatcgcccgccgcgacgccaccagggaagctgggggaggtagcagcagcgacgccaccagcagctacggcttctccgtcctcgaccccgtccgcgccctcgccgcccacttcgcctccgcaacgccgccggcggtctcaccagcgaacggcgacgaggaggaggaggacgacgacgcggagagcttggaaccggattcaggggagctcgtggtggtggccacggccaagcatgagcgagagtttttggagaaggcgggcgaggagctggagaaggtgaacaagttctacgcggcgcaggaggcggacatgctggcgcgcggcgccgcgctcgtcgagcagctccgcatcctggccgacgtcaagcgcatcctcgccgaccacgcggtggcgtcccggcgcagccggcccgccggagactcgccgccgcccccgccgtccgcggacgggcggtccaacagcggccgccacctcctctcctcctcctccccattcctgcaggcctcgccgcagtccatgttagatgggagcgcggagctgccgcaggcgcgcgtggcggaggaggtgatggcggcgctggagcgcaacggcgtgagcttcgtgggcagcgggctgggcagcaaggccaagaaggacggcggcgggaagcagctcacggggcgcgcggccgcgctgccggccacggtgcgcatcgacgtcccgcccaccagccccggccgggcggcgctcaaggtgtgggaggagctcgtcaacgtgctccgcaaggacggcgccgaccccgccgccgccttcgtccaccgcaagaaggtccagcacgccgagaagagcatccgcgacgccttcctcgccctctaccgcggcctcgacctcctcaacaagttcagctccctcaatgtgaaggctttcaccaaaatattgaagaaattcgtcaaggtgtcggagcagcagcggaagactgacctgttctcggagaaggtgaagaggtcgccgttcagcagctctgacaaggtgcttcagctggcagacgaggtggagtgcatcttctcgaggcacttcgcgggcaacgacaggaaggtggccatgaagtacctgaagccgcagcagcccaggaacacccacatgatcaccttcctcgtaggcctcttcacaggcacattcgtgtccctgttcatcatatactcggtcctagcccatgtcgccggcatcttctcttcgacaggaaacacagcctacatggagatcgtctaccacgtcttcagcatgtttgcactcatcagcctgcacgtcttcctgtacgggtgcaacctcctggcgtggaagagcagcaggattagccacaacttcatattcgacttctcccccagcaccgccctgacgcaccgcgacgccttcctcttgtcggcgtccatcatgtgcaccgtcgtcgcggcgctggtcgtcaacctcttcctcagcaacgccggggcgacctacgccaacgcgttgcccggcgcacttctgcttctgtcagcagcggctctcttctgcccattcaacgtcttctaccgctccacgcgctactgcttcatgcgcgtcatgcgcaacatcatgctgtcgccgttctacaaggttctgatggcggatttcttcatggctgaccagctaacaagccagatcgcactgctaagacacctcgagttcacggggtgctacttcatggctggaaccttcacgactcacgcgtatgggagctgcaccagcagctcccagtacaagaacctggcgtacgtgctttccttcctgccttactactggagagcaatgcagtgtctgagaaggtacctggaagaaggccatgacatcgaccagctcgccaacgcgggcaagtacatatcggcgatggtagcagctgctgtcaggttcaagtacgccgcggcaccgacgccgttctggatgtggatggtcatagtgtcgtccacaggcgccaccatctaccagctctactgggatttcgtcatggactggggcttcttagacctcagatctaagaaccgttggctccgagaccagctcatcctcaagaacaagccgatctactatgcttccatgatgctcaaccttgtgctgcgcctggcctgggccgagagcgtgatgaagctccgtctcggtatggtggagtctcgcctgctggatttctcactcgcttcactggaaatcatccggcgagggcactggaacttctacaggctggagaatgaacacttgaacaacgctggaaagttcagggcagtgaagaccgtcccgttaccattccgtgaacttgaaactgattgatcaagtcaaagataagaacttgccagcatgttcccaggaatttaaggaggggggcaagagttccaggaatggacacactgcccctgctagtgcttgcgcaaggattggtgttcaagtgggtaataaaacaaatcagagagcataactgcacaagagcaa

SEQ ID NO: 482 - DNA, 1553 bp, Oryza sativa
ccgccatggcctccatctccgccgcctcccccgtcgctgggaaggccgccgccttcgcccacaagaacgagctcgccgccgccgccgtggcgccgtcgcagcagcagctgcagcggagggtgagtgggaggagggcgcgttcggggagggtccgcgccgtcgccacgcccgcccgcgccccccgcgccccgtcctccactggctcggtgaagagcgccatgacgatgacagagaagatcctggcgagggcgtcggagcgcgccagcttggagcccggggagaacgtgtgggtggacgtcgacgtgctgatgacgcacgacgtctgcggccctggcaccatcgggatcttcaagcgggagttcggggaggacgccaaggtttgggaccgagagaaggtggtcatcatcccggaccactacatcttcaccagcgatgagcgagcaaaccgaaatgttgatatcctcagggatttctgtatggagcagaacatcaagtacttctatgacatcaaggacctgagcaatttcaaagcaaatccagactacaagggtgtttgccacgttgctcttgctcaagagggtcattgcagaccaggcgaggttctccttggtactgattctcatacatgcaatgctggagcctttggccaatttgcaactggaattggaaacactgatgctggttttgtgatgggcactgggaaggctcttcttaaggtgcctccaactatcaggtttgtattagatggagaaatgccaccttatttacttgcaaaggatctgattttacaaattattggtgagatttctgtatctggcgcaacatacaaatccatggagtttgttggatcaactgtggaaagtctaaatatggaagagcgaatgacactgtgcaacatggttattgaagctggtggcaagaatggtgttgtgcctgccgatcaaactacatttaactatcttgagggcaagacatcagttgaatacgagcctgtctatagtgatgctcaggccagatttgttagtgactaccggtttgatgtatccaaattggagccagttattgccaagccacattcacctgacaaccgtgctctagcaagagagtgcaaagatgtcaagattgaccgggtctatatcggttcttgtactggaggtaaaactgaggacttctttgctgctgcgaaggtgttcttagcttcggggaagaaggttaaagttcccacttttctcgttccggcgacacaaaaggtgtggatggacatttatagcatccctgtaccaggagccggtggcaaaacttgctcacagatatttgaggaggctggttgtgatacaccagctagccctagttgtggtgcttgtttgggtggtcctcgtgatacatatgctcgcatgaatgaacctatggtgtgtgtgtcgacgacgaacaggaatttccccggcaggatggggcacaaggaagggcagatctacctggcttcgccgttcaccgcggcggcttcagccctcaccggatacgtcactgaccccagggacttcctgatgtaataa

SEQ ID NO: 483 - DNA, 782 bp, Oryza sativa
acaccatggcggcggcggcggcggctccggctctatccttggccgaggcggcgccggtgacagcagttctggcaccgtgtcccacgccctcgaggacgttccgccgccgcagctgggtcgcggctatctgccggcccgccctgaaatgccaccacagtcgtcccctgaccgccgtggtcgccgcggctgcggctgccgctgcggcgggggactcgacgtcggccggcgtattccacggcgagtgcttcgtcgtgggggataacatcgacaccgaccagatcatcccggccgagcacctgaccctggtcccgtccaagcccgacgagtaccgcaagctcggctcgttcgccttcgtcggcctccccaccgcggcctacccgacgccgttcgtcgcccccggcgaggagaccacccgctacgccgtcatcatcggcggcgccaacttcggctgcggctcctcccgcgagcacgcgcccgtcgccctgggcgccgccggcgcccgcgccgtcgtggccgagggctacgcgcgcatcttcttccgcaactccgtggccaccggtgaggtctacccgttggagctagcggacactggagcctggaaggagtgcaagaccggggatgtggtcacggtggaacttgataattgcgtcatgatcaaccacacatccggcaagcagtacaagctgaagcctatcggcgatgccgggccggttattgaggcaggcgggatctttgcctatgcccggaagaccggaatgatcgcatccaagtctgcgtgataa

SEQ ID NO: 484 - DNA, 1466 bp, Oryza sativa
gcgagatgaagcagtcgatgcggagccggcaggagccgcggcgggtgagcaacggcgtcatcatcgccgccatgctgctctccctctgcgtcctcagcatcgtcaaggccagatactgctccacccccttcgttaagcccgacgaccagctacaggagcagatgaactccagcatcaggatggagaccgacgagccggcgaccatggcggcgggagagcaagaggaggacgaggaggaggagagctctggcggtggcggcgctgagcctgaggtcagcgccacccctgccgtcgtggtcaccgccgcagccggcggcggcggcggcaagaggaagccgacctgccgcatgacgagcaagcggtcggagcggtgcgaggcgagaggggacattcgtgtggaggggaacgcgtccaccatctacatcggcgggatcgacaaggagtggaagacgaagccgtacgcgcggtaccacgaccccgtcgccatggccgtcgtccgcgagttcaccctcaagccggtcaccgagtcgtcgccggcgtgcaccaggaaccactcggtcccggccttcgtcttctccaacggcggcttctccggcaacctgtaccacgactacaccgacgtgctcgtgccgctgttcctcagcacccaccagttcaagggccaggtgcagttcttgctcagtgggctcaagccatggtgggtgaacaagttcaacctcttcttcaggcagctcaccaagtacgacatcctcgacatcgacaacgacaaggacgtgcactgcttcccccggatcgtggtcggcgccaccttccacaaggacatgggcgtggaccccaagcgctcgccggggcacgtctcggtggtggacttcaagcgcgcgctccgccgcgccttcgggctggagcgcgtcgcggcgtcccgaggcggcgccacggggaacggcaagccacggttgctaatcatttcccgcaagaactcgcggcggttcctcaatgagcgggagatggcgcaggccgctgccgctgtgggcttcgaggtgcgcattgccgagcccgatcagcacaccgacatgtccacattcgcccagctcgtcaattccgccgatgtcatgatcggtgtccatggtgctgggctcaccaacatggtgttcctcccccgcggcgccgtcctcatccaggtggtgccattcggcggcctagagtggctcaccactgtcaccttcaagaatccggcgaaagacatggaggtcacctacatggattacaatgtgcagctggaggagagctcgctgatcgatcagtacccgcgcaatcaccaggtgctcactgatccctacgccgtgcacaagcaaggctgggacgcgctcaagacggcgtacctggacaagcagaacatcaagatggacatggacaggttcaagaagacattgcaggaggcgctcgacaggttgccgccagcatgataa

SEQ ID NO: 485 - DNA, 785 bp, Oryza sativa
agcagatggcggccaccggcgctggagaaggcaaggagacggccgccgtcgccggcggcggcggcggaggtagcctgcacagtaagaccctcctcaagagcgagccgctctaccagtacgtgctggagtccaccgtgttcccgcgcgagcccgactgcctgcgcgagctccgcctcgccaccgccaatcaccccatggcggtcatggcggcctcgccggatcaggtgcagctgttcggccttctgatcgagctgatcagcgccaagaacgccatcgaggtcggcgtgttcaccgggtactcgctgctcgccaccgccctcgcgctccctgacgacggcaagatcgtggccatcgacgtgagccgggagagctacgacgaggtcggagcgccggtgatcgacaaggccggcgtggcgcacaaggtcgacttccgcgtcggcctcgccatgccggtgctcgacgagctcgtcgccgaggaggggaacaaggggaggttcgacttcgcgttcgtggacgcggacaaggtgaacttcctcggctaccacgagcggctgctgcagctggtcagggtcggcggcctcatcgcctacgacaacacgctgtggggcggctcggtggcggcgccgccggcggcggccgacgaggcggtgccgtcggggcgggaccgctcgctcgccgcgctcgccagggagttcaacgcggcgatcgccgccgaccgccgcgtcaagccgtgccagctcgccatcgccgacggcgtcatgctctgccgccgcgtggcctgatag

SEQ ID NO: 486 - DNA, 1859 bp, Oryza sativa
caggcatgcctcttcttatcgtgcagcccgtacccatttcgacaggtcctattgcctgcgctagcaccgcgcgtcctgcagcagcggcgcacgatgacgacggccaccttttcgacgatctcgtgctcggctacggcggcgacgacaagacgagcgccgacgccgacgatccagcgaggaagctcgagtggctcaggtcgcaggtcatcggcgcggacgcggagttcgcgtcgccgttcgggacccgccgcgtcacgtacgccgatcacaccgcgtccggccgctgcctgcgtttcgtcgaggacttcgtgcagcgcaacgttcttccctactacgggaacacgcatacggtggacagctacgtgggcttgcacacgagcaagctggcgtcggaggcggcgaagtacgtgaagcgcagcctgggagccggggcggaggacgtgctgctcttctgcggcacgggctgcaccgcggccatcaagcggctccaggaggtgacgggcatggccgtgccaccgacgctgcgctccgtggcgctggacgtcctgccgccgtcggagcggtgggtcgtcttcgtggggccgtacgagcaccactccaacctgctcacgtggcgggagagcctcgcggaggtggtggagatcgggctgcgcccggacgacggccaccttgacctcgacgccctggaggcggcgctggcggcgccggagcgcgccggtcggcccatgctgggatccttctcggcgtgcagcaacgtcaccggcatccgcaccgacacgcgcgccgtggcgcgcctgctgcacggctacggcgcgtacgcctgcttcgacttcgcgtgcagcgcgccctacgtcggcatcgacatgcggtccggcgaggaggacgggtacgacgccgtctacctgagcccgcacaagttcctggggggaccgggaagccccggcgtcctggcgatggcgaagcggctctatcgcctccgccgcaccgcgccgtccaccagcggcgggggcaccgtcgtctacgtcagcgcatacggcgacacggtgtactgcgaggacacggaggagcgcgaggacgccggcacgccggcgatcatacagaaggtccgggccgcgctggcgttccgggtgaaggagtgggtcggcgaggcgtgcatcgaggcgcgcgaggaccacatgctcgcccttgctctccgccggatgcaagcgtctccaaacctgcggctgctgctcggcggcgaccggcccagcggagggcgctgtctccccgttctctccttcgtggtgtactcaccgcgcgacggctccgagcaggatgagcggccgcagctgcactgccggttcgtgacgaagctgctcaacgacctgttcggcgtgcaggcgcgcgggggatgctcctgcgcggggccctacggccaccgcctcctcggcatcacgccggcgcgagccaaggccatcaaatccgccgtcgagaagggctaccacggcgtgcgccccgggtggacgcgcgtcagcctggcctactacacgtcgacgcgggaggcggagttcgtgctggacgccatcgacttcgtcgccagtttcggccaccggtttctgccgctctacgctttcgactgggaaaccggggactgggagtacaaccacagcttcggtcgtgtcctggcaaacaacaacgccatcagcaatgctgccgctgctgcttctagtggacgggtcaaagcagaggacgagtaccggagctacatggcatttgcacggagcctagccgactccttgggcggatgtctggataacactcctgctagacacgttcccaagggcatcgacccacagttgctttacttccctatgtgataa

SEQ ID NO: 487 - DNA, 1145 bp, Oryza sativa
aattatagccttcctcctcctcctttcctccctctcgaggcccaggtgttcgtccgtgtcctcttctccactccacacacgcacacgcacaagccaagcagcaagcagcggcgccgatgagaggaggagtagctgggcccaccgccggcgagccgccggggacggaggcggaggcggaggaggtggaggagagctcagctggggacgacgaggagctggagctcgggctcagccttggctccaagaaacagcagcagcagcagcatgcgccgtgccgaatcctgacggccagggacctgcagccggcggcggcgctgtcaccggactcctccgtgtcgtcgtcatcccccgcggcggcggcggcggcgggggggaagagggctgagggccccaccgccaccacctcgcctgggacggttgcttccggccatccacacagctttggagtggtgggatggccaccgatccgacagttcaggatgaacagcctgttcaatcaggctaaagaaaacacatctgaaaccgacaccaagaagaccgccaccaatgaatctgatgtgcagaaggacaaggaggagggcgaaaagaaaggacgggttgctggatgggtgaaggtgaacatggatggagaggtcattggaaggaaggtggatctcaatgcgcaccgctcatacaagacccttgcattagcccttgaactcatgttcacgaagccgtccattggcctttgcgcttctcataatacaaactcgctgaaactactagacaactctgccgaataccagctcacctacgaggacagggatggtgactggatgctcgttggagatgttccttgggaaatgtttgtcagctctgtgaagaggttgaggatcatgaggacatcagatgcgaatggtcttggtcagcgataccagggaattcacagaaccattgcttcaacaagaggcagatcctgagagcgtgtgacaaggaaaagagctataccgctggtgaagcttggagcgtgcttgatggttaattacttgtccagttaaaatagcagaaggctagtaagaaagagccacagggctcacccggttctgttatatttttgcctttgtggtgcctgtttttgtttgcactgtcgatctgcaagagcatat

SEQ ID NO: 488 - DNA, 362 bp, Oryza sativa
taggcatggccaggtcatcgtcgtcgctgctcgtcctcacggtcctggtggtggccgcggcggcgtgctccactacggcggcggcgcgcagcgtcccggcggaggagaagaagacggctgcgccggtggcggcggcggacgtgaagcagccggagacgttccacgaggggacggtgttgatccctgggctcgggcggttcgagctcggcagcacctacgtgccggacatcaccggagtcgaccacagcgtcccggcagccgagcacgggcagttcctccccggcgccgacgacacatgggtccccaaccccggcttcgaggtgcccaaccccttccagcccggctcgtcttctccctgataa

SEQ ID NO: 489 - DNA, 230 bp, Oryza sativa
gagaaatggcggtggctgcgagggctccgctcggggtggtggcggtggtggccgtgctcgtcgtcggcatcttcatgcccgccgcggcgcaggccccggcgcccgcgcccgtcagcgacggcacatcgatcgacctggggatcgcatacatcctgatgctggtggctcttgtgctcacctacctaatccatccactggatgcttcttctccctacaagcttttctaataa

SEQ ID NO: 490 - DNA, 2491 bp, Oryza sativa
gaagacaatgtcagcttcggagttcaggattccttaccagcaagtatcatcttcacagactactgagaatgcaggccagttcaagatctgccgatgtggggaaggagacccaaatacaaacacatctgaaactggtgataaatcgccaactagttgtcctaattgccaggttcttaagagtggacatttactgctctcatctaaaggaattggttggacaacatggaaaaagcgctggtttattcttacaagggcatcattggtgttcttcagaagtgatcctaatgcacctcccagaggaaatgaaccgattgttacactaggtggaattgacttgaataactccggaagtgttgtggtcaaagaagacaagaaacttttaacagtgttatttcctgatggccgcgatgggcgaactttcactctcaaggcagaaactacagaagaactcaatgaatggagaagtgcactagagaatgctctggcacaggcacctgttgtagcaaatactgttggccaaaatccaattttcagcactgacatagcagagcctgctgaagctccagctgaacagtcggacaataaatctatcattggcagacctgcagagtttgcccttgtagatgctgatggtagtccagctttcctggagaaggccttaaagttcattgaagattatggtgtcaaggtggaaggaatcctacgtcagtctgctgatgttgaagaagtcaaacgaagagttcgggactatgaaaaggggaaaaatgagttctccccagaagaggatgcacatgttattggtgactgcatcaagtatgttcttcgagagatgccttcatctccagttcctgcaccatgttgcactgcactggttggagcttaccgaactgacaagacaagaaggcttgatgctatgaatagagtaatttatgaagttttcccagaaccaaaccgacaactattgcagaggactcttaagatgatgcagattgttgaatcacacaaagctgtgaataggatgtctcaatctgctttggcggcttgcatggcaccactccttctccgacctcttcttctcggtgaatgtgaaattgatagcgactttagtatggctggggatggttcattccagctgcttcaagctgcagctgctgccaaccatgctcaagcaatcgtcatcattatgctcgaagaatacgatcagatatttgatgacttggaagacggttcctactcttcagatgcatatactgagtccgaagacggtgattttgacaaggaatattccacagacaacgatggccctgaagaggatgactcttatgattctggtgaagataacattgaagaagacatggatgatgatactgagcactcatctggtggcagtgaatgtgacaacaacattaagaccagtgtctctgatgacaaggttaaaagcaataactctggcacagcatctaatggcaacgatcagggtttacaacctcctaagaaagcagcaagaacaggacatggtgcggtaagggaagacacctgccaaattgaaagcaatgatacatccaatcgaaaacaagaattatacgaatcaaatggatccacagaccaaatagaaaagttaaatgttcgctcatcatcagcaagagcaaaatttatggagaaatcaagcagctcaagaaataagagcaaaaagaccttatggggccgtacttcagcaagaaaagacctgtcagcagaggagattgactattgcagtgatgacgagactcttattgagaagcttgagaacagcaagacagatctccaatctaaaattactaaggaggcgaaagaaaattcaatcctacaagcaagtctcgaaaggaggaaagtagaattgcataaacgccgattagcactcgaaaaagaagtggaaaatttgcgagatcagctacagaaggagagaaatttgagggtctcattggagtcagggctgatgaatttgcgaagagggcaggcgtccttcccatcaacaattgacaacaagggttctgatctccgtggacaactcaacaaccaggtccagatgagctccgcctcattatgtgactcatgcaacaaacgactgctaaatacagacaagctaaccgaaggtgaacagagtaccacatcatcaaatgttgggcccaattctatatctgacatggtatcggctacacacatggctcaaagaatgttgatttctaagggtgagattgtgaaggatggccaagatccattggcatcaaagtggaaccttgcacagaaacaatactcaaataatccactattaggcaggcttggatctagaacagaggattccggggcaccatctgcattagccaagctgacaaatcgactcaatttcttgaaagaaagaagggcgattcttgcaagtgagatgcagaacttagatttggctcgcccgccagggcctccagctccagctccgaagagagactccacatgatga

SEQ ID NO: 491 - DNA, 413 bp, Oryza sativa
gaaacatggcactgcccatcaagcttctcctagtctctgcatttctctccctcctcctcctgatccaaggcgcggcggcgaggtcgtcgccggcggcggggaagtgcgcggcggcgagcgtggaggtggagcaggcgaacaccggcgagaaggcggggtacgacccggtgttcgaggtgacggtgcgcaaccggtgcgcgtgcgcggcgcgcggcgtgcgcctccgctccgaggggttcgcgagctccgtcgccgtcgacccgcggctgttccgcctcgaccgcgacgccggcgactacctcgtcggcgacggccgccgcatcgagccctccgccgccgtcacgttccgctacgcctgggaccgcgccttccgcatggcgccggccgccctgctcgacgactgctcctgataa

SEQ ID NO: 492 - DNA, 1077 bp, Oryza sativa
gagctttcttgcgtgttgtagctggagtgttcgaaggaattactggctggcacgcacgcgcgcacgggcatggtggcggtggtgatgatggcgatgaggaagaggatgcgcggcgcgctgctggcgctcgcgctgctgctcaccgcgacggccgtcgtgccgctgctcctcctcggagaggccggggacgacggcgtcggggccgtcgccgccgcgccgccgttcaacgcgtcccgcgtcagggcggtgtcgtggaggcccagggtcttcgtctacaaggggttcctctccgacgacgagtgcgaccacctcgtcaagctggggaagaggaagatgcagaggtcgatggtggcggacaacaagtccggcaagagcgtcatgagcgaggtgcggaccagctccggcatgttcctcgacaagcgccaggatccagtggtgagcaggattgaaaaaagaattgcagcatggacctttcttcctgaagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggggtgggaaaatcagcccaaggatgacactttctctgaatgtgcacaaaaaggattggcagtgaaaccagttaaaggcgacacggtgctcttctttagccttcatatcgatggcgtaccggacccgctcagcctccatgggagctgcccagtgatagaaggtgaaaaatggtctgcaccaaagtggatccgtatcaggtcctatgagcatcctcctgtctcaaaggtgacagaaggatgctccgacaacagtgcacgttgcgcgaaatgggctgaagctggagaatgcgagaagaacccggtatacatggtaggtgccgagggtttgcccggcaattgtcggaagagttgtggcgtttgtgattcctaggatgtgtttattttcctaaatctgatgtttgtgtcacttgctgaatag

SEQ ID NO: 493 - DNA, 662 bp, Oryza sativa
agaagatgagcttgtttgggcggagctccaggagccagctgacgttcaggcccaagaagagctccccttccgggagcaagggcttgccgctgaagaagcacatcgacgccaccctgggcagcggaaacctgcgagaggcggtccgtctgccaattggagaagatctcaacgaatggctcgctgtcaacaccgtagacttcttcaaccaagtgaactttctgtacggaaccctgatggagttctgcacttcatctacctgcccgatcatgtctgccggaccaaagtacgagtacaggtgggctgatggaatgaaggtgaagaagccagttcaagtgtctgctccaaagtacgtggagtacctgatggattgggtggagagccagcttgatgatgaggccattttccctcaaaagattggggctcccttccctcaaaactttcgcgaggtgatcaggaccatcttcaagcggctcttcagggtgtactcccacatgtaccactcgcattttcagatgatcctcaagctcaaggaggaggcccatctcagcacttgcttcaagcactttgtgctcttcacttgggaattccatttgatcgacagggcagagctggctcctctcaacgagttgatcgagccgatagtgtttcggtatttttaatag

SEQ ID NO: 494 - DNA, 1130 bp, Oryza sativa
cggagatggccggcaaggagaacgccgcggcggcgcagccccgcctcacccgcgccgccgccaagcgcgcggccgccgtcaccgccgtggccgtcgccgccaagcgcaagcgcgtcgcgctcagcgagctccccacgctgtccaacaacaacgccgtggtgctcaagccgcagccggcgcccaggggcggcaagagggccgcctcccacgccgccgagcccaagaagccagctccgccgccggcgccggcggtggtggtcgtggtcgacgacgacgaggagggggagggggatccgcagctctgcgcgccctacgcctccgacatcaactcctacctccgctccatggaggtgcaagcgaagcggcggccggcggcggactacatcgagacggtgcaggtggacgtgacggccaacatgcgaggcatcctggtcgactggctcgtcgaggtcgccgaggagtacaagctcgtctccgacacgctctacctcaccgtctcctacatcgaccgcttcctctccgccaaatccatcaaccgccagaagctgcagctcctcggcgtctccgccatgctcatcgcctcgaagtatgaggagatcagccccccaaatgtggaggatttctgctatataaccgacaatacctatatgaaacaggaggttgtcaagatggagcgcgatatactgaatgttctcaagtttgagatgggcaatcctacaaccaagacgttcctgaggatgttcatcagatctagccaagaagacgataagtatcctagccttcccttggagttcatgtgtagctatcttgccgagctgagcctgctggagtacggctgtgttcggctcttgccatccgttgttgcagcctcagtggtgtttgttgcaaggctaacccttgattcagacaccaatccttggagcaagaagttgcaagaggtgaccggctacagggcatctgagttgaaggattgcattacctgcatacatgacttgcagctaaacaggaaagggtcatctctaatggctatccgggacaagtacaagcaacataggttcaagggcgtatcaacattgttaccccctgttgagatccctgcatcatacttcgaagacctaaacgagtagtaa

SEQ ID NO: 495 - DNA, 1745 bp, Oryza sativa
tgcttatgatggaaggtcatagcaatgaactgggacgggccaacaccttgaagaaaggaggtcttcgaccaatcccggtcatcatcgcaaatgaagtatctgaacgaattgtgagcgcatcagttactgcaaaccttattatctaccttacaacaaagtatcacctcggtgctgcaagtagtgcaatcatcatctttgtgtatcaagcagctgcaaattttttgcctgtgtgtggtgcaattgtgtctgatgcactattgggtcgttacctgatggttacattaacattgttctcctgcacaactgggacttttatgctattcctaacatcactaattccaaaattaacacccccagattgtggtctttcaaatcaaggttgtacttcgccatctccactacaactgtttgttctgtgtgcctctcttggtttcatgtcgctcggagcgagtggtgttcgcccctgctgtcttgcctttgctgaggatcaaattgctcattgggacgaagcccaaaaggaccgtgcactccgtggtttgttcagctggtactatgtatcggtcggcttcgcgcagatagtggctgttaccatcctcgtctactttcaagatcaggtgggttggaaggttgggtttgggatttcagccgccgttatgctatccatcacacttgtgaacttggcagcatcacccttctatgtgaagatgaagccacagaggagtatatggatcagcttactgcaagtggttgttgtgtctcttaagaaccaccacctggtacttccgaagacatatcagagtgctcagttccataatgcctcgggattaagagagctagttccatctgaaaaaatgagattcttgaacaaagcatgcattctgagataccatgcaaccaatgtgagcgatggagcaggcagaactaactcatggaacatctgtaccgtggagcaagtggagaacctcaaatctgcactcagcgtgataccgatgtggtcagcaatgataatgaccttcctgatacaaagctcatccttcggggtactacaagcagccaccatggaccggcgagttggcacaaaaaagttccaactaccggcgggctctatctcaatctttgagatcataaccttcacgatatggtcaggctgctatgaccggtacattgtgccatttcttagaagaatcacaggtaggcagcaggtgctaacccttaagcaacggatgggcattggtgtgtccttgtccattgcatccatgcttgtggcatcagcagtggagacatacagaaggaaggttgcggttaagggagggttgcagcacgatgctaagggaacattggaaatgtctgtgctgtggctggcacctcagtatgtcataataggccttgcaggcgcatttagctccattgggcagatcgaattctattatgcggtgcttcccaagtccatggggagctttgtgctagcattgctcttcttcggtgctggtgtcgcaagcatcattgcaacattagtgatcaaggccatcaacctgatcaccggtagaaatggcatggcaccatggctgtccaataacctaaatgagggtcactataactattactacttccttcttgctgtccttggtgccattgacctgatctatttcatagtttgctcttatgttttcgacgaaaggacacaaaacatgtccctggaaactagtggtgatgcaaaagacatggtagagtttcaaggctagtag

SEQ ID NO: 496 - DNA, 2105 bp, Sorghum bicolor
gaagtatgaatccttactttgttgggattcttgtccctgtcgcggtctcccttttgctccgcaagaggagaaaggccgaaaggaagaggggagtgccagtcgaggttggtggggagcctggatatgcagtccgtaactatcgatttgagcagcccgttgagacacactgggagggggtctccacacttgctgagctgtttgagcaatcttgcaaagagtatgtcaacatgccactccttggcaccaggaagctcatctcgagggaaactgaagcagcacctggcgggagatcgtttgagaagttgcatctgggcgagtatgagtggaagtgttatgcagagtgcttcaagagcgtttgcagcttttcatctggactaattcgagtaggtcacgagaagaatgaacgtgttgctatttttgctgagacacgggctgagtggcagattgcgttgcaggcgtgcttcagacaaaacattacagttgtcaccatctatgcctcattgggggaggaagcattgtgtcactcactaaatgagactgaggtcactactgtagtttgtggtcagaaagaactaaagaagttgattgatataagtgggcaacttgacactgtcaagcatgttgtctatatcaacgaggaaggcatatcagctgaagtttctttagctcaaaactgcactagctggaaggttgaatcatttgaggaagtaattaggttaggatctgaatcacctgttgaagccaacatgcctctcccttctgatgttgcggtgataatgtacacaagtggtagcaccggattgcccaagggagttatgatgacccaccgcaacgtcctggctacactctcagcagttatgaccattgtgcctgcacttggcagtaaagatatatacttggcctacctcccacttgcacacattcttgagttggcagcagaggcactaatggctgctgttggggcctccataggatatggatcacctttgaccctgactgatacatccaacaaaataaaaaagggaactctaggtgatgcttctgcactaaagccaacattgatgactgctgtacctgctatacttgaccgtgtgcgtgatggtgtgaggaaaaaggtggatgcaaagggtggtatagcaaagcaattgtttgacattgcctataaccgtcggcttgctgcaatcaatggaagttggcttggtgcctggggtttggagaaacacttgtgggatacgcttgtgtttggaaaggttcgtgctattttgggaggaaagattcggtttgtactttcaggtggagcacctctatctggtgatactcagagatttatcaatatatgccttggggctccaatagggcaaggttatggtctgactgaaacttgtgctggagggacattttcagagtatgatgacacatctgttggccgtgttggtgctccactaccttgttcgtttattaagttgatcgactggcctgagggtggatacttgactactgatttaccaatgcctcggggagaaatagtcattgggggtccaaatgttactaaaggctatttcaagaatgaagctaaaacaaatgaagtgtacaaggatgacgaaaaaggtatgcgatggttctattctggtgacatcggacgattccatccagatggctgccttgaaatcattgaccgtaagaaagatattgtgaagcttcaacatggcgaatatgtatcgctcgggaaggtggaggctgctttgattgtgagcccatatgtggagaacattatgatccatgctgatcctttccacaattactgtgttgcgcttgtggtagctgcacacattgagctggaaagctgggcttcacagcaaggaattaaatacagtgatttctcagatttgtgccagaagcaagaggctgttaaagaagtgcttggatctttagcgaaggctgcaaagcaagcacgacttgagaaatttgagataccagccaaaatcaagttgataccagagccatggacccccgagtcaggactcgtcactgctgccctcaagctcaagagggaggtgatcaggaagacgtatgagaatgatctggctcagctgtacgcatgatga

SEQ ID NO: 497 - DNA, 2224 bp, Sorghum bicolor
cctccacctccacgtatgcggagacagccagacagggcaagggccaagggcgcaaggcaagctccagccccagcgccaaatgcgtcgcgccgccgccgccgcagtggcggtcgacccgcagctcctagcgggcgcggtcgaggcggcgatcgcctcccggtccccgcggctcggccgagcggcgcacgcgcgcgcgctgaggctgctggctccggccctcccgcccttcatctgtgcgcacctcgtcaacctctactccaagctcgacctcccgggcgccgccgccgctgcgctggccgcggaccccagccccaccgtagtgtcctacacggccttcatctcgggcgcggcgcagcacgcgcgcccgctccaggcgctctcggcgttcgccgccatgctccgcctcggcctccgccccaacgacttcaccttcccttccgccttcaaggccgccgcctccgcgccgccgcgctgcgccgcggccgtcgggccgcaggtgcacgccctcgcgctcaggttcggctaccttcccgacgacgccttcgtctcgtgcgccgcgctggacatgtacttcaagacgggccgactcgcgctggcgcgccgcctgttcgacgaaatgcccaacaggaacgtggtcgcctggaacgcggtcatgacgaacgcggtgctcgacggccggcccatcgagacggtggaggcctactttgggctccggggggctggtgggatgccgaacgtggtctcggtctgcgcgttcttcaacgcgtgcgctggcatgacgtgcctgtcccttggggagcagttccatggttttgtggccaagtgcggctttgacaaggatgtgtccgtgtccaattctatggtggacttttatgggaagtgtcgatgcatggggaaggccaggttggtgtttgatgggatgggagttcggaatagcgtgtcctggtgttctatggttgttgcgtatgcgcagaatggggcagaggaggaggctttcttggtgtacttgggtgcaaggagagctggggaagagccgactgacttcatggtttccagtctgctcaccacttgtgcgggtctgctaggacttgaccttgggcgtgctctgcatgcagttgctgcccgttcctgcattgatgcaaatatttttgttgctagtgcgttggttgacatgtatgggaagtgtggtggtatccaagatgctgagcaagtatttttcgagatgcctcagcgaaatcttgtcacatggaatgcaatgatagggggttatgctcatattggtgatgcttggaatgcacttgcagtgtttgatgaaatgataatgggtcgagaaacagcacctaattacatcacaattgtcaatgttctcacggcctgcagcagaggaggtttgacaaaggaagggtatgagttgttccagacaatgaagcagaggtttgggattgaaccaagaattgagcattatgcttgcgtggtggacttgcttggtcgtgcaggaatggaagagcaagcttatgagatcatacaggggatgccaatgagaccttccatttctgtctggggagcactacttgggggatgcaagatgcatgggaagacagagctaggaagggttgctgctgaaaagttgtttgaacttgatcctcaggactcgggcaatcatgttctgctctcaaacatgcttgcatctgctggcaggtgggcagaagcaacagatgtaaggaaggagatgaagaatgttggaatcaagaaagacccagggcgcagttggatcacatggaaaaatattgtccatgttttccaggctaaggacacaacacatgagatgaatagtgagatccaggcattattggccaagctcaaagggcaaatgcaaggtgctggctacatgccagacacacaatatgctctctatgatcttgaggaagaagagaaagaatcagaggtgtttcaacacagtgaaaagcttgctctggcgttcggattgatatgtataccacctggtgtacctataaggatcatgaagaatctgcgaatttgtgtagattgtcaccgggcttttaaattcatatctggtattgttggtagggagataattgtgcgggacaacaataggtttcatcacttcaaagattatgagtgttcatgcaacgattattggtgaaagttttatccaccagtatactgatgcatgttttgttggcatctctagaaccacttctgc

SEQ ID NO: 498 - DNA, 1412 bp, Glycine max
ctcctattcggattcgccacatacagatggagggctcaaaggaaaactgtgtgcctcggattccgctcataccctcttcaaatcttcaaggtccaagaatgaagcctctcctccatcaccggctgcctctcggcaacatcagtcagaatgttaatatgcctcattctcaagtcaacaaactagatctttcccgcaagtgtacggctcacacaattcagcaccacttccctcaagaaactaagaaacagaacctgttggccccgaacccgagttgcaagttagattgtgatatcgtagatattgatgatgacgatggggatggcagtgacgatgccgttccagtatttgtcaagcacactgaagccatgcttgatgaaattgacaagatagaggaagttgaaatggaagatgtggaggaggaacctgttttggacatcgatgcctgtgataggaaagatccacttgcagtggttgagtacatagatgatatatacagtttctacaaggacattgagaattcgagctgtgtctctccaaattacatgactagtcaacttgacattaatgagaggatgagggcaattcttattgactggcttattgaggttcactacaaatttgagcttttggaggagacgttgttccttactgtcaatctcatagacaggttcttggagcgtcaggcagtgatcagaaataaacttcagttagttggtgtaacagctatgctaatagcttgtaagtatgaggaggtcacagttcctaccgttgaggattttattctgataacagacaaggcatatacaagaaatgaggttttagatatggagaaattaatgatgaacatcttgcaattcaagctgtctatgcctactccatacatgttcatgagaagatttcttaaggcagctcattctgataaaaagctggagctcttgtccttcttcttggtcgagctttgcttggtagaatgcaaaatgctgaagttttcaccatctttgctggctgctgctgccatttacacagctcaatgtagtctgtaccagtttaagcaatggactaagaccaccaagtggtacactgattactcagaagagaagcttctcgaatgctcaaggctgatggttactttccatcagaaagctggatcagggaaactcaccggtgtatatagaaagtacaatacatggaagtatggctgtgccgcgaaaatagaaccagccctgtttctactggataattaagggaatgcaagtaaacttctagtttctaatgcattgctttggttgttttgagagtttgcttgtgctagaagtttgttttgagagcttcagagacctatcaacagaagttggcctttactctttcagtaacgtgtgtctttttctttacactcaatcttggctttcagg

SEQ ID NO: 499 - DNA, 1418 bp, Glycine max
ctgcaatggcaatggcaattgcaatggttcctcaacctctgctgacccttttcctctttttctcccttctctcaattgccaactcttctccttcccaacaccttcagatcgccaatgccgaacgcaggattgatttgacttctcacattattaaggtgtacttgacattgaaggttgaaaatttggggacatctcctgcttcagaagtacatattgccttttcgcccactgaagtagaacatctagcaatagtcaaagctgctgcaacttctgggaagaggaagaagaaaacttatgttcctctagatgtcaaatctgctgagctacctgatggaccaaatggaactaagtttttctctataactttgttaactccactaagtaaaggtgaaaccacaacactagaggtgctttacatattgacacattctctggaacctttcccagtagaaataagtcaatcagagtcacagttggtttatttccgtgatagtgcaatattattgtctccctatcatgtcaagcaacagacaacttttattaagactccaagcacccgggtagaatcattcacagtggtggaccccactaaacgtgctggtacagagttgaaatacgggccatatgaaaatcatcccccgtattcatattctcctgtacttattcattttgaaaataacaatgcatttgctgttgttgaggagctagaacgtgaaattgaaatatctcactggggaagcattcaagtcactgagcaatatagcttggtccatgctggtgctcgacataaaggtgttttttcaagggttgaatatcaaactaaaccaggtggtactggtgtttcttcatttaaacatcttttagcgaaactaccccctagggttcactcagtatactacagggatggaataggaaatatttcctcttcacatctacgtacagattcttggaagtcagaacttgaaattgaacctcggtatcctctatttggaggctggaaatcaacctttgtcattggttatgggctaccattgcaagacttcctttttgagtctccggatggcagaagatacctcaattttacttttggttgccctcttgtcgagacagtggttgacaagttgattgtaaaagttgtgctgccagagggatccaaagatcccacagttgagattccttttgaagtgaagcaacatctagagatcaagtattcatatcttgatgttgtcggcagaactgtggtggttctagaaaaaagaaatgcagttcctgagcataatgctccttttcaggtgtactacagttttaaccccatattcatgcttgctgagccattgatgctggtatctgcatttttcttgttttttgtggcttctgtggcatatcttcacattgatctttccatacgcaagtgatag

SEQ ID NO: 500 - DNA, 2221 bp, Helianthus annuus
aaaccgcattccatatctcaactttcaccgtcggtatatttttatttccaaattaatctcacataacaccaacaggttacttttctctcaaattctaccctaaatgttgctcaaatgttagagatattatgttgttttgatgatcgagataactgtgcattgttttgagaatcaatttcaccggaaaacttgtattttggtagattagtttacggttaaattctggttgaatttgatataattgtgtgccctaagtgttattcatatacattcaccagttcggtgacaattcggcggttttcgtggtgaatcgtgatcattatttagatatttagggatagttagggttttgagttgtggatgtgtgattgagagatgtgtaaggtagataattagcctcaagtagcatacattcagcggtttggtgacaattcagcggttttcgtggtgaatcgagatcattgtttagataattagggttttgaggtgtggatgtgtgacagagaaatgtgtagggtggaggatagagataagaagaggaggaggtttgcaattggaacaatgggattaaggaaattgggggaaattagggttgagaagttgaagaattctatggtgaatgtaaggtcgggtaagatgaagatgatgttaataagggcgatgacgacggtgttattgtggatttgtttggttcagttgactgcattaggaggttctttgggacctagggttttgaaagggtggccttcttgctttactcaagattctcattcggctgctgcgttggatgttaagttgttgcctgttcatgccagagttcttccgcacaagagggtttacaagaacaatggttacttagtggtttcatgtaatggaggactgaatcaaatgcgttcggctatttgtgatatggtcgcgattgctagatatttaaatgttactctaatagttcccgagctggataaaacttctttctgggctgatccaagtgagtttgcgaacatttttgatgttgatcatttcattacatcattgagagatgaagtccggatacttaaacaacttcctccaaggcttaaaaagagagttgaaatgggaatcgtgcataccatgcctcccgttagctggtctgatatttcttactatcataaccagattcttcctctgattcagaaatacaaagttgtgcatttgaacagaacagatgctcgtcttgccaataatggtcaaccccttgagcttcaaaaacttaggtgtcgagtaaatttccgtgctctgagattcaccaatcaaatagaggaattgggtagacgtgttgttaaacttttgagacaaaacgggccctttttggtgcttcatctcagatatgaaatggacatgttagcattttccggctgtacacaaggatgcaacgctgaagaggttgaagacttgaccagaatgagatatgcttacccgtggtggaaggaaaagataataaactctgatttgaaacggaaagacggtttatgccctttgacccctgaagaaactgctcttacacttagagcactcgatattgaccgtgatatccagatttatattgctgccggtgaaatatatggtggaaaaaggagaatggatagccttgctgctgcctacccgaaactggtaagaaaggagactctgttaggagcagctgaccttcaatatttccaaaatcactcatcacaaatggcagcattggattatcttgtgtcactcgagagtgatatttttgtacctacttatgatggaaacatggccaaagttgtcgaaggccatcgcagatttttgggtttcaagaagacaatactcttggacaggagggttctggtcgaattaatcgacaaatatactagtggcttgctgggttgggatgaattctcgagtgctgttaaggatacacatgcgcaacgtatggggaaccctagaaaaagattggttattacagatagacccaaagaagaagattacttctatgcaaatccagaagagtgcttgcagccatcggatgatgatgatgaagaagaagctgtgaacatcctatgatcaaggatttgcggttaatttgatatgaacttacgagagtatgatttttggtcctcgaccctgtcggtgtacaatgagtgtttgttcaaaatacgaggatgccgcgcattttggcgagagaccatggcagatgacaatgtttccacgaatg

SEQ ID NO: 501 - DNA, 1219 bp, Helianthus annuus
cgaaaatgatggcagttggtgtgtcggccctgcaaataactgcagcaaggccgtccgtttttcttacacaaagaactctcggggctacgatggcaacttttgtacatgaatccgatagaattttgtcatctaagcttaccagctcttctcatctgtcatcggtgctaaatattaagcataagtgcacaacaagtcgtcctaggtttcaaaagttcgttacgaggtcgatgtcagaagcttctggaagcaagtcggtttcccagctgtccattgatttaaaaggtaaaagggcgtttattgctggtgttgctgatgacaatggatatggttgggctattgcaaaatcgttagcggctgcaggtgctgaaattcttgttggaacatgggtgcctgccttaaacatatttgaaatgagtctacgcaggggcaaatttgatgaatcacgggtgttgccagatggttctttgatggagattactaaagtttatccactggatgctgtctttgataaccccgaggatgtacccgaagatattaaaaccaataaacgttatgctggagcaagtaactggacagtgcaggaagttgcagaatcagtaaagcaagatttcggtagtatcgatattttggtgcactcacttgccaatgggccagaggtcacaaagccgctgttggaaacatcccggaaaggttatctagccgcggtatctgcgtctagttattcctatgtttctttgctcaaacattttcttccaattatgaaccccggtggttcgtcaatatcgcttacgtatattgcttctgagaggataattcccggatacggtgggggtatgagttcagcaaaagccgcactcgagagtgacacaagagtgcttgctttcgaagcaggaagaaaacataaaattagggtcaacacaatatccgcaggtccacttggaagccgtgctgctaaagcaattggatttatcgatacgatgattgactactctttcgcaaatgcacctctacagaaaacactatctgcagatgaggtggggaacacagcagcattcttggcatcaccattggcttctgccattacgggtgctcttatatatgtagacaacggcctgaatgcaatgggtgtgggggtcgacagcccgttgtttaaagatcttaatgttccaatggacaaacattagtaaaatgtacaagtcgaaaggtatgtgttgagaat

SEQ ID NO: 502 - DNA, 2357 bp, Helianthus annuus
caattcagttgaataacgatgacggttggagcaggtatatctgtaactgatcggaagctcaatgtgttcggaaatcctgtgttgaaggacgtacatgacaatgttttcgtcacttcttcaaccggtgatggtatgatcaatggcgcgttcatcggcgttcgatcggaacaaaccggtagtcgtatggtgtttccggttggaaaactcgagggattgaggtttatgtgtgtgttccgtttcaaactatggtggatgacacaaagaatggggaattgcggtcaggacatacctaccgaaactcagtttcttatagtcgaaacgagtgaaggttcacatttcggagaaaataatgaaatcgatgacggatcacaccaatctgctctatatacagtcttcttgccaattcttgagggtgattttagagcggttatacaaggaaattctaataacgaattggagatttgcttggaaagtggagatcctgctgtaaaagagtttgaaggtagtcatctggtttttgtggctgctggacccgacccgttcgatgttatcaccaacgcagtcaagagtgtggagagacatttacaaacattctctcatcgcgaaagaaagaagatgccgaatatgttggattggtttggctggtgcacatgggatgctttttacactgatgttacttctgaaggtgtaaaacaaggccttgaaagttttcagaaaggaggtatctcaccaaaatttattatcattgatgatggatggcaatcagttggtatggaccccactagtgttgaagctaaagcggataatacggctaattatgcaaataggctaactcatattaaagaaaatcacaaattccagaaagacggtaaagaaggtcacagagtcgaggacccgtctatgggacttcgttatgttgttacagacattaaagatcatcacaacgtcaagtatgtttatgtttggcatgcgttaaccggatactggggcggagtgagacctggaacggggcaatacgattcaaaactatcatttccgattccctctccaggaatcgaatccatcgaaaactgtgatgcttttatagccattgccaagaacgggctcggtcttgttgaccctgaaaaagtcttcaacttttacaatgaattgcattcttacctcgcgtctgctggtgttgatggtgtgaaggtagatgtgcaaaacattctagaaacacttggagcgggccatggtggtcgggtcaaacttacgaggaagtaccatcaggcgttggaagcttcagttgctaaaaacttccctgataatggcatcatttcgtgcatgagtcacaacacagatggtttgtacagtgccaagaggacagctgttatgcgtgcatccgatgatttttggccacatattacagcttcacacacggtccatattgcttctgttgcttataatacagtcttccttggagaattcatgcagccggattgggatatgtttcatagcttgcatcccatggctgattatcacggtgctgctcgtgctgttggcggctgtgctatttatgttagtgacaagcctgggcatcatgactttaatttattaaaaaagcttgtgcttcctgatggatcgatactgcgggccaaacttccagggagaccaacaagagattgcttgtttactgatcccaccagagacggaaaaagccttttgaagatctggaacgttaacaattacactggagtggtgggagttttcaactgccagggagcagggtggtgcaaagacggtaaaaagatcctcacgcacgatgaacaaccaagcaccatcactggcgtcatcagggctaaagatgtaaattacttgcctaaagttgccgattctacatgggatggtgatgcagttgcatacagtcacgtcggcggtggactggtttacctaccaaagaatgcatccatcccagtaacattgaaaccgagagaatacgaggtttttacagtagttcctatttcgaaactgtcatgtggtgtcggttttgctcccataggtttgacggaaatgttcaactctggaggggcgatttcggaattccggtatgagacagagaaagaaggaaatgtggagttgaaagttagagggtgtggtgtgtttggcgcgtattcaactagaaaaccgactagagtaattattgattcgaaagaaaccgaatttgggtatgaagaaagaagtggacttgttagtattaaactgagtgttcctgaaaaggaaatgtatttatgggatatcatcattcaagtgtgaagaggcgtttagtgtcggtttgcaactcagaatgggttcaagagcttgcagggctataagtacca

SEQ ID NO: 503 - DNA, 2536 bp, Solanum lycopersicum
taaacaatcacttcactcttcaactcgaaaagcttcagctggccgttaatggcggcctcttcagataccgttacgccgtcgagcctccggttggctttcggcaatgtgttctcgttgttcattctcatactgatcggagttctcgctttctcgatccgtatcttctccgtgattaagtatgagagtgttattcatgagttcgatccttatttcaactatagagtcactcagtttctgactaagaatggaatttatgacttctggaattggtttgatgatcggacctggtatccacttggacgagtgattggtggaactgtttaccctggactgacattgactgctggcactttgtggtggataattaattccttgaatattcctctttctgtggaaacagtttgtgtgtttactgctcctacattctctgcctttgctgcttgggcaacataccttctaacaaaggaagttaaaggggttggggctggactaactgctgcagctcttttggccatggttccatcatatatatctcgatcagtggctggaagctatgacaatgaagctgtggccatatttgcattgatcttcactttctatctctatataaagacactgaacacggggtccctcttttatgctactctaaatgccttgtcatacttttacatggtttgctcctggggaggatatacctttatcatcaaccttattccaatgcatgccctactttgcatcgtaactgggcgttattcttcacggctttatattgcctatgctccattagttatcttgggaacactattggctgctttggtccccgttgtaggttttaatgcagtaatgacatcagaacattttgcctcatttctggtgttcctaattctcaatgttgtggggcttgtctattacatcaaagggatgctcacaccaaaaatgttcaaagtagctgtgactcttgttgtatctgcaggcttgattgtttgctgcgctgtggtagctgtgctagttgcgcttgttgcctctagcccaacaaagggatggagtggacgaagccttagtctgcttgatccaacttatgcgagcaagtatataccaattattgccagtgttagtgaacatcagccacctacttggccttcttactttatggacataaatgtattagcatttttggtccccgcaggcattattgcatgctttttgcccctgactgatgctagctcctttgtgattctttatttagtgacttcagtgtacttttctggtgttatggtccgcctaatgcttgtactggccccagctgcatgtataatgtctgggattgctctatcatcagcttttggtgtttttactcgatcaatcaaatttgcatcaactggaaaacaggctgatgcaggggataatggtgatggggttacacagaatgatgtggtgaaatctgatagaaatgaagaactcccaaaggaaaaagcttcgagaaaaaagaagaaagaaaaggagaatgttgaaaaagttcccattgctaataaaaaaagtgagaagaggcttttgatgttacccatggaggcttcttttgttgctattctattacttgtgttgctgggtgccttttatgtggttcattgtgtctgggcagctgcggaagcttactcagctccttctattgtactaacatcacaatcgcatgatggacttcatgtttttgatgacttcagagaggcttatgcatggttgagccacaatactgatgtagatgataaagtggcatcatggtgggactatggctatcaaactactgctatggccaatcgcactgttatagttgataataacacctggaacaatacacatattgcaacagttggtacagccatgtcctctcctgaaaaagcagcctgggagatcttcaactctttggatgtaaaatatgttcttgttgtctttggaggtcttgttgggtatcccagtgatgatatcaataagttcctctggatggttagaatcggtgggggtgtcttccctcatatcaaggaacctgattatctgagagatggccagtaccggattgactctatggctactccaaccatgctgaactccctcatgtacaaactgtcttattacaggtttgtggagacagatggcaaggggtacgatagagtaaggcggactgaaattggaaagaaacattttaagctcacccactttgaggaggtatttaccactcaccactggatggttcggttatacaaattaaaacctcctaagaacagaatccgtggaaagacaaagaagtctaaatcgaaagctacttcttctagctcgagaagaagcgcaactcaaaagaagaatccctggcaatgaagggctactcataacaagtaacttctatttatcagctacatgataggaatacttcatacgatgagtagcttcatgtgaaaggattgtgctttaaaacgcggtcctcttaggtttttcgttcaagttttgaattgcgttgatattatacacagagaagacgattatcccg

SEQ ID NO: 504 - DNA, 2189 bp, Solanum lycopersicum
gggttgcaagatttcttgttgaatacagtaaaaaactgatctttcttgtttttttctatcaagaaaatgtggggagctgaaagaaaacagagattcaagaaaggaatagagtgaaaaatcaaatattttttctcccctcttgcatttttatagcctgctacattcaatcagcacaatgaggaagcatggatggcaacttccctatcatcctctccaggtggtagctgttgctgtgtttctggcactgggatttgctttctatgtcttctttgcaccttttgtgggaaagaaattgtttcagtatattgtgatggggctttatactcctcttataattagtgcatttggcttgtatatctggtgcgctgctgctgatcctgctgatccaggagtttttagatccaagaagtatattaagaagctagaccacgaaaagcaagttcaacttaaagaatctaaattagggtgcgagacgaattcttctatacaagatgctaatgctgcatcgattggggaaaatgcatctggaaaaagcaacaaaggagctgaaccagctgcagatcacaatgaaactgaacagaaaattacagctactcgtgaacgatctttctcttccggattgttggctctactaccttgtgctcttatcagcaactgcacaggcagacatgaggagtcttctcagcaacagttgagtgaagatggcatgttctactgcagtttgtgtgaagtagaggtatttaaatacagcaagcattgcagagtatgtgacaagtgcgtcgatcagtttgaccatcattgcaggtggataaacaactgtatagggaaaaggaactatcgcaagttctttgcgctcatggtttcagccctcctgctgcttatacttcagtggtcaactggaattcttgtactaatctgctgctttatcgagaagaagaaattttctgcggaaatcacctccaaattaggaagcagtttctccattgttccttttgttattgtagtggctgtctgtaccatcttggccatgatagcaaccctgccactagctcaacttttcttctttcacatacttctcataaagaagggaattagcacctatgactacatcattgctctcagagatcaagagcaacaaggagttgcaggtcagcaaagtccacaaatgtctactgttagctccctaactggattaagcagtgcaagctccttcaatactttccatcgagcagcatggtgcacaccacctcgcctttttgttgaggatcagtatgatgtagttcctcctgatacagtatcggtcagttcacttgggaaaaggtcaatggcggatgaacctatcaagaaaaagaatccagctgccgtgaagattagcccatggacactagcacgattaaatgcggaggatgtttcaaaagctgctgctgaagcaaggaaaaaatcgaaaattcttcagtcagtggtgagaaacaaagaaccttacattcttgaaacaaatagcagtttaggaagtagcgggcgtcgcatggtgcctaggcttgataacaatagaaggagagctagtaaacgagttagactccctgcagagttaccctttgaaaccatgagtaaaattcccaatgatatagctcaaaacagcagaagacccatgctaactgagtcatcaagcagtttagctccccttcagcttgaagcacggagtgatttccgaacaacccgaggactgtccacctcaggtgttgttgttgcttcttcacctgagagtagtttggactctcctgacattcacccactccggatgtcatcctcaggagttgaagatgctgcacgtcttgtaggtcacctatcatctggaatgactcttcaaaaggatacaccattgtctagatcaactagtgatggatacgaggcatctggtggggaggatagtgatcgtgtgcctacccgaattgtgcaaaggtcaacaaggtggagtagcattctttttggttctgatcaacaagatgatagagtcagaagattgatggtcccgtcttcatcaacccaggctaacatcaggaagcattaagcctccaaacatacttgggaattcttctgtaagctcttgaagctacatgatctgttgacatttcttaatttgttgatgatgtttgtccagtagtatataccatcaacttggtctgttccat

SEQ ID NO: 505 - DNA, 899 bp, Solanum lycopersicum
cagaaatgccgatctgtagctcttcttcatcatcttcttcctctagctccgcaaaatcatggatccttcacggcttagccgtcggagcagcagcagcagccgtagctctcggcgctcacgcttaccttagccgatccggcaagtttcggagccgggtcataggtatcatacccgctcgttttgcttctactcggtttcaagggaaaccgctcgttcagattctcggcaagcctatgatccagagaacatgggaaagggcaaagcttgctgagacattggatcaagttgttgtggcaacagatgatgaaaagatagctgagtgctgtcgtggttttggcgctgaagtgataatgacttctgaatcatgtagaaacggaaccgagcgttgtaatgaagctcttcaaaagcttgataagaagtatgacattgttgttaatatacaaggagatgaacctcttattgaacctgaaataatagatggcatcgtcaaagccctacagtctgcaccagatgcggtctttagcactgctgtgacatctttgaaacctgaggatgcatttgatccaaatcgtgttaaatgtgtggtagacaatcgtggttatgcaatatatttttcacgagggctcatcccttataacaagttaggcaaggttaatcctcagtttccttacttgctgcacctcgggatccagagttatgatacgaagttcctgaaaatatatccagagctgacaccaacaccgttgcaactagaagaagatcttgagcagctaaaagtccttgaaaatggatacaaaatgaaggtgataaaagttgaccacgaagctcacggtgttgacatcccggaagatgtcgagaagatagagcagttcatgcgtgagaggaacatggcttagtag

SEQ ID NO: 506 - DNA, 1544 bp, Triticum aestivum
tgggctctcagtacttggatttacggcgatggcgagggataacggcgacgggctggcggcgattgccgggcggatcggcgtgctcgggtccgtcgcgctgaacatcgtggcgctagcaatctacctccgtggccgcgccgccgccgagaagcaggccagcaagaaggtgaagaaggcggcggctgtggcgccgtcgtccggcaagccgcccgtcgcgtgtgactcggtcatcaacttggaccacggtgatccaacgatgtttgagccgttttggcgcggaccgattggcgaaagcgctacgctggtgattccagggtggcagacgatgagttacttctccgacgtcggcaacctctgctggttccttgagccaagcttcgagcgtgaggtgcgccgcctccaccgcctcgtcggcaatgccgccgtcgagggctaccacgtcctcgtcggcaccggatcctcgcagcttttccaggccgcactctacgcgctcgccccacccactgctgacacgcccctcagcgtcgtatctaccaccccattttactccatgtacccgcccttgacggacttcctcagctcggggctctaccgatgggccggcgacgccaacacattcgacggcgacgactacattgaggtcgtctgctcaccgagcaaccccgacggcagcatccgcgaggccgtcctcaagtccaagtccggcaaggacatccacgacctggcttactactggccgcagtacactcccatcacccaaatgcttgcccacgacatcatgctcttcaccgtgtcaaagtgtacgggccacgccggcacgaggatagggtgggcgttggtgaaggacaaggaggtggctcagaagatgagcaagttcatggagcaaagcaccataggcgtgtccaaggacgcgcagctacgcgccgccaaggtactcggggcagtcaccgacggctacgagcaccagcttgccaccgctgccggtggggacgcgaacctcctcttccattacgcgcggcggaagatggcgcaccgctggtgtgcactccgtgctgccgttgcagcctccggcatctttagcctccccaacgaggtggccggcttctgcaccttcaccaaggacactgtcacctctaatcctgcattcgcatggctgcgctgtgagaagcaagaagtggaagacctagagagcttcttgcgtgagaacaagatcataacccgcagcgggactaagttcggagctgatcaaaaggtggtcaggatcagtatggtcgacactgatgaagcattcggcatattcgtcaatcgccttgccgccataaaatgaggacaccggacaccggataagtgaataatgtgtttgtttttgtggccagtgaatgatgtgttgtttctcttagcttctctatattttcgtacctccctagttagggatcgatcaatgagctttgttttcgaatacccagtttagtgatccagctaaataagttcaattttcataggcttcttttcttatgaaacaacctgagatgctatttattccg

SEQ ID NO: 507 - DNA, 1652 bp, Triticum aestivum
gtctccgtttctgcttctgctccactccactggccggccggtcgttcatggccgcgatgatggggatctccgctttgcgctcccaccacccgctccccctgtcgaccgcgcgcccggccacggctctcccccgcgccacgtcgccgacgtcgcaccaacccagctcgctcacgcctctacgatgccgatgccgatgccgacgcagcctcccccattcttgctgcagctcctcccctcgcgcctcgctctcgccaggcgcccccgactcggccgctgctttcatggcattggctcccaacaatgccgcccttcgccaccgcctcatcgcccccaactccaccgccggctccggagacgccgccgccaccggaggcctgcccagcgttgttggcatcgcgcacctggcggtgtcgctgggcatcgtgctggccacggacaagtacctgaagcaggcgttcgtggcggcgtccatcaagttccccagcgccctcttcggcatgttctgcatcttctccgtgctcctcgtcctcgacaccgtcgcgccggcgctggccaaggccttcatggacttcttcgagcccgccacgctcttcatccagcgctggctgccgctcttctacgtcccctccctcgtcgtcctgcccctcgccgtcagggacgtcccggccgcctccggcctcaagatctgcctcatcacattcggtggctggttcgcctcgctcgcggtggcggggtacacggcgctcaccgtgaggaagatcgtcaagacggagctcatcgcggccgagccgatgggcaagccgtccaccttcgcgacgttggagttctgggcgtggggcgccgtcttcgtcgcctccttcgccacggcgttcgtgaaccccacggcgcttggcaccacggccaggacgtgcctcccgttcatgctcgcttccactgtactgggatacatggttggttctgggttaccgcctggtatcaagaaattgttacacccgatcatctgctgcgcgctttccgcgaatttgtcggcggtcgcatacgggtacctctccgggtccggaatcgatgctgcgctaggtgattacctgacaaaggtgccatcaaatcctggagctggtgacgtcctgatgggctttcttgggtctgtcatcttatcatttgccttctcaatgttcaagcagagaaagcttgtgaagaggcacgcggcagaaattttcacgtcgatcgcgattgcgtcgacattctccctgtactcgacagccatcctaggacgcctgattgggttggagccaacattgaccatctcgatattgccaaggtgtataaccgtggcgttggctctgagcatagtctctttcttcgaaggtgcaaacacttcgctgacggccgccgtggttgttctgacgggcctgattggcgccaactttgtgcaagcggccatggataagcttggcctcaacgaccccatcgccagagggatcggaacagcttccagtgctcatgggttgggaaccgcggcgctgtcggccaaggagcctgaggcgctccctttctgcgccatcgcctacgcgctcaccggcattttcggctcattgatctgctcctctgcagccgtcaggcaaagcctggtgttcatagccggctgacactga

SEQ ID NO: 508 - DNA, 1889 bp, Oryza sativa
agaagatgacgatgatggggtgtgccgtgctgctcgtggtggtggcgtccatggcgggggaggcggcggggaggttcgtggtggagaagaacagcctgcgggtgacgtcgccggcggggctccggggcgtctacgagtgcgccatcggcaacttcgggatgccgcagtacgggggcaccatgcacggggtcgtcgtctaccccaaggccaacaagaaggcctgcaggtccttcgacgacttcgacctctccttcaagcccaagcccggcggcctccccatcttcctcctcgtcgatcgcggagactgctacttcacaacaaagggatggaatgctcaaaccgctggagctgcagctgttcttgttgccgatgatagattggagcctttgataacaatggactctccagagtctagtggcacagattacatagagaaaattactgttccttcagcacttgtaacgaagaagtttggggacgaccttaagaaagcactggaaaacggtgatatggtcaatgtccttctggattggagggaatctctccctcatcctgatgagcgtgtagagtatgaattctggacaaacagcaacgatgaatgtggtgccaaatgtgacatgcaaatgaattttgtgaggaacttcagaggaacagcacaggttcttgagaaaaggggttacactcagttcacccctcactacattacatggtattgtccggaagcttttgtcctgagcaagcagtgcagatctcagtgtatcaatcatgggagatactgcgctccagatccagagcaggatttcaacattggatatgatggaaaagatgttgtgcttcagaacctgattcagatttgcttgttcaaggttggcaatgaaactcacaaaccatgggtgtggtgggattatgtacacgatttttcaattaggtgcccaatgaaggagaagaaatacacgcgtgaatgcgctaatggtgttatcaagtcacttggattggaccttgagaggatcaacaagtgtgtgggagaccctgaagctgatgaagaaaatcccgtgcttaaagcggaacaagatgctcaaattggtcaaggctctcgaggagatgtcactatattgccgacccttgtcgttaacaacaagcagtacagaggtaagctggagaaaagtgctgtgttaaaagcagtatgctcaggatttgaggagacaactgaacctgatgtttgtttgagtcaagagatccaaacaaatgaatgtttggagagcaatggagggtgctggcaggacaagactaataattttactgcgtgcaaggacaccttccgtgggcgagtttgtgaatgccctattgcccgtggtgtgaagttcgttggtgacgggtacactcactgtgaagcttctggtgtcggtaggtgccaaatcaacaacggaggctgctggaaggaaactaaaaatgggaagacggtttctgcctgctcaaatgaagaatctaaaggctgcaaatgcccaccaggtttcaagggtgatggtataaaaagttgtgaagatattgatgaatgcaaagacaagcttttctgccagtgcaaggactgctcttgtgagaatacatggggaagctatgagtgcagctgtggtggaagtaatatgttatacatgagagagcatgacacttgcatcagcaaagttgcttcttcgtcagtgggctggggcttcctttgggttattttctttggcctcgctttggctggaattggagcatatgccgtatacaaatatcggctacggagttacatggattcagagattcgtgcgatcatggctcagtacatgcccctggagaatcaagaaacaccgaatcaacatcgtcctgtggagcatgctgatatctgatga

SEQ ID NO: 509 - DNA, 2348 bp, Zea mays
cgggaatggggtgcacggcgtccaaggtggagcaggaggacacggtccggcgctgcaaggagcgccgccgccacatgaaggacgcggtagcggcgcgccagctgctggcatccgcgcacgccgactacctccgctctctccgcgtcaccgccgccgcgctctcgcgcttcgcgaagggccacccctcgctcgccgtttcgcaccacactacccccgtcctcctctccgctgccgcaccgccgcctgcccccagcgccgcccgtgcgctccccacaccggcgccgtccaccgccgcgtcgtcatcgctcccgcctccgacgccgctcgcccagcacccacacccgccgccgcagccgccggcggcgatggcggcgccgcaaccggcgccggcgagggcaccgcgtccgcggcggctcagggtgccccacatcctgtcggactccagcgtggccagccccgcgcggtcgtcgttccgcaagcagccgccggtgggcacgccgtcctcctcgtccgcgtgggactgggagaacttctacccgccgtcgccgccagactccgagttcttcgaccgccgcaaggccgaggtcgagcatgccagccgtctccgggagctcgaggaggaggagaaggcccgggcctacctccagcaccacacccagtacaacctcaaggaagaagacgaggccgccgaagacgacgacggcgaggtggaccatgaaccggaggggatgcattgcggcggatgggaggacgacgagcactacgcgtccacgaccacatcggagaccagatcggaggatgagggcgagatgggggacagatcagaatgcgggttcgcggccagatcggagtgcgggttcgtggccagatcggagtacggcgggacggcaccgtcagagtacgccgccgtcccattgcccctgaggagggatgagaggtcggaggctggcgactcctccacggtcacggcggcgacagagatgcggatggtggtgcgccatcgcactctcgaggaaatcgtggcggccattgaggagtactttgtcaaggcagccgactccggcaacgatgtgtccgagctcctggaggccagccgcgcacaactcgaccgcaacttccggcagctcaaaaagacggtgtaccattccaacagcgtgctatcagcattgtcgtcgacatggacatcaaaaccgccattggctgtacgatacaagttggacactaatgcactggagatggagtcgacggaagggaagagtcatggatccactctagagcggcttttggcttgggagaagaagctctacgaggaggtcaaggctagagagagtgtgaagattgagcatgagaaaaagctttctactctgcagagcctggagtacagaaggagggatagcgcaaagctggacaagaccaaggcctccataaacaggctgcaatccctgatcgtagttacgtcgcaggctgccacaaccacatcatcagccattgttagagtccgtgacaatgagcttgcaccacagcttgtccagctctgttttgcgctactgggcatgtggaggtcaatgaaccatttccacgagatacaaaacgagatcgttcagcaagtccgcggcctggtggacaactccatggccgagtcaacatccgacctccataggcttgcgactcgtgatctcgaggccgctgtcgcggcatggcactcgaacttcaaccgtctcatcaagtaccaacgcgactacatccgctctctgtacggctggttgaagctcacgctctgccaggtggacagcagcgtgccccaggaagtccatgcctcgatgatctcgcgcgagctcaccagcttctgcgacgagtggaagcaggcgctggaccgcctcccggacgccgtcgcctcggaggcgatcaagagcttcgtgaacgtggtccacgtcatctacaccaagcaggccgaggagatgaagatcaagaagcgggcggagacgtactccaaggagctggagaagaaggccaactcgctcaggtccatcgagaagaagtactaccagtcctactccatggtcggcctcggcctccccggcagcgggcgcgatggcatcgaaagccacgctgcgtacgatgcccgcgaccctctcgcggagaagaagaccgagatcgcccagtgccgccggaaggtggaggacgagatgacgaggcacgccaaggccgtcgaggtcacgcggtccatgacgctgaacaacatacagaccggcctgccgggtatattccaagccatagctgggttctcggggacagtggtcgaagctcttgatgtggtctgccgccgagctgggtctgtgcggtagtaa

SEQ ID NO: 510 - DNA, 2174 bp, Zea mays
acccaatgggttcttctccttccaaagccactggagaggatgccctggttctgtgcaaggatcggatgcgccacatcagacaagctattgactcgagagatgcactgtcagcagcgcacttatcttacacacaatctctccgtagtgtgggtactgcactgcggcagtatgctgagtctgagatctcaccggaatcatcgctctccatttcagaagtggataagtcaccatcacattcctctatggcatctccttcgccttcgcgtgcagtagagagtgttgcctctctggggcatcgagcaagtccatctattactccaccctcaacacgaatccattgcatgaaagcagcagcaaccactcctttgacctttgtgatagatcaatctactgctgaatttgtggggcgcgaatccccagtatcagcttttgtcccacccccaccaccattgcctccagaattatgtaccacgtgggacttctttgatcccattgatgctgctggtacctcttcctccaacaatgagaatgaggtaaccctgaacttcagtagattgagggatctaagagagtcaagggtagctgaagtagttccattgaaagaagttgaagaggaaatcatgtccagaaggcatacagaaatttctgatgataatacaccacctgagcaggaaagagagccaaagcaaggtgggaccggaaaaccaagtcagttggtggatacttcaaccaaagctacatctgagcaggttgctgcaaagttggaggaaagtgaaatggaaaaagaattatgtgcagaggcagaggacccttcagagttcatcactcatcgagccaaagattttgtgtcgagcatgaaggacattgaaacccggtttatgcgtgcagctgaagcaggaaatgaggtttccagaatgcttgaaaccaagaagatccgacttgacatatgtgctaaaataccaggttctccagtcaagctaccttctgcccgatttgtgtcagcacttcgagtgtgctgcaatcgtgatgttattctcaaccaggaaactgcgcagcatgtttcaaaggttgtcacatggaagcgttctgtctcatctctttcatcatcatctaagagtgcacttatgacatcgataatgaaagatgatgtggatgacagtaatagtgattttgttgaggaattcgccatggtatccggaagccattcttctacgttggacaggctacacgcatgggagagaaaactatatgatgaaatcaaggcaagtgaaaatgttaggaaggcctatgatgagaaatgtaacctactccgacgccaatttgcacgaggcctaaatgcgcaggtgattgataagactagagctgttgtgaaggatctccattccagggtatctgttgtgattcaagctgttgatgcaatctccaaaagaattgagaagataagggatgaagaactgcagccacagcttgtcgagctaattcaagggctaatcagaatgtggaaactgatgctggaatgtcaccacaaacagttcatcacgatcacattagcataccacgtgaaagactcgacctcggcgcgtcaaggtgagcaccaccatcaccgccaggcggcgatgcatctgtggaatgagatggacagcttctcctccagcttcagaaactgggtcaccgctcacaaatcgtacgtcgaggccctcaacgcgtggctccagaagtgcgtcctgcagccgccccaggaccggcgcaggcgcaaacgcaaggtctccttccctcctcggcaggctgtctcccctcccatattcatcctctgcggggactggctcgccaggacagaacctctccctgctgacgagctatgcagatccctcaaagacgtgatgcagctcctccgcggctcgttcgagcaccgcgacgagcagaacaggcccagaagcggcgagtcgcaggagtgcgggatgctggagaacagtagcgagcaggaggcggcggctaagagtgggagttgtgcagcatcagctgaagggctgcagtcgagactgacggcggttcttgaccgcctgacaaagttctcggaggcatcactgaagtgctacgaggagctcaagcagaactacgagatggcctgtgctgattataggagagttggaccaaatgctcagcttgcttagtga

SEQ ID NO: 511 - DNA, 1334 bp, Brachypodium distachyon
gggccatgatggagacgaagccgccgtcgccggggacggcatcggccgcggcggcggcgcaccaccaccggcgctgggcggcgccgctgctcgcgtccgtactgctctcctccctcctcatctcagcctccctcttcttctcatcctcgcgggcgctgctcctctccttctcgcccctcccgtccgcggcctccgcggagccgctcttcgtcgaggccaagctgcggcagcagcagcagcagatgcggcccgacggcgtcgcgcggacgcagcgcgccgtgcccaggatcgcctacctcgtgtccggctccgcgggggacggggtcgcgctgcggcggacgctcagggcgctctaccacccggccaaccgctacgtcgtgcacctcgacctggaggcgcccgcggccgagcgcgccgagctcgccgccgccctgcgcgccgaccccgtctactcccgcttccgcaacgtcagggtcgtcacccgcgccaacctcgtcacctaccggggccccaccatggtcgccaacacgctgcacgccgcagccatcctgctgcgcgagggcggcgattgggactggttcatcaacctctccgcctccgactaccccctcgtctcccaggacgatctactgtatgtgctctctaccttgccaagggagcttaacttcattgaacacaccagtgacataggatggaaggagtatcagagggcaaaacctgtaatcgtcgacccagggctatacagtctgcagaagtcagatgttttctggattacagagaaaaggagtgtgccaaccgcgttcaagctcttcactggatcagcatggatgatgcttactcatcagtttattgaatactgcatatggggatgggacaatcttccaaggacagtcctgatgtattatgccaattttctctcttcaccagaggggtactttcacacagtcatctgcaatgtcccagagttccgcaataccacagttaaccatgatctacatttcatttcttgggacaacccaccaaagcaacatccccattacctcaccctcaatgactttgatggtatggttaacagcaatgctccctttgcaaggaagtttggaagagaagatcctgttctagacaagattgatcaggaaatattgggccgtcaacctgatggatttgtggctggcggatggatggatatgttgaatacaacagtgaaaggaaaacatttcactgtcgaacgtgtacaagatctccgcccagggcctggtgcggacaggctaaagaatcttgtcacaggcttgctcacccaggaaggttttgatgacaagcattgcttgtgatag

SEQ ID NO: 512 - DNA, 1424 bp, Oryza sativa
cggcgatggcgcggtggccgtggaggtggagggtgctgctgccgctgcttctccttcactcctcccccgtcttcgcgcaagaaggccaagataatgatccctctactttgttcaaacgagcctcagaaatgatgaacctaaggaaatatgatggatcacttggtctgctaaatgctgtgttggaggttgacccaaatcactcagaagcttacaggcagcgtgcatctgtgcttcgtcacaagtgcaggtacaaggaagcggagggtgactatagcaaatacctggagctaaaacctgggagttcttctgtggaaaaggaattatctcaactgcttcaggctcaaaatgcattagagtctgcttatggccaatttgaatctcatgacttctcaaaagtcctggagtacatcaacaaaattgtgcttgttttttctccaaactgcttaaaggcgaagcttctcaaggctaaagcattgctagcacttgaagactactcaagtgttatctcagaaacaggatttattctgaaggaagatgaagataacctggatgccttgttgcttcgtggccgagcatattactacctcgctgatcatgatgttgcatccaggcactaccagaaaggccttcgtctagaccctgaacattcagaactgaagaaagcatattttgggttgaaaaatcttctgaagaagactaagagtgctgaagataatgctgccaagggtaagctacgtgtgtctgctgaggactacaaggcagccctagcaatggatccagatcatacttcttacaatgtacatctttatcttgggctatgtaaggttctggttaaactcggaagaggcaaggaggctatcagtagctgtacagaagcactcaacatagatggagaacttgttgatgcattaacacagagaggtgaagctaagcttcttacagaagactgggaaggagcggttcaggatctaaaagaagcttcccagaaatctccccaggacatgggaatccgagaagcactaatgagagctgaaaagcagcttaagttaagcaaaagaaaagattggtataagatccttggcatttcaaagacggcatcagctgcagatattaagcgtgcctacaagaagttggcactgcagtggcatccagataaaaatgtagataaccgagaagaagcagaaaacatgtttcgagaaattgctgcagcttatgaggttcttggggatgaagataaacgtgtaagatacgaccgaggagaggatcttgatgagatgaatatgggaggaggaggtggtggtttcaatccttttgggggaggtggtcagcaatacacattccattacgatggtggattctatggaggaggaggattccccgggggcggctttcctggaggatttcagttcaactttggatagtag

SEQ ID NO: 513 - DNA, 989 bp, Hordeum vulgare
gcgcgatggcgacgctccagcaccagaaccagggggcggcggcgccgatgaccacgaccggcggcggcctgcgcgccatggacctctacgagaagctggagaaggtcggggagggcacctacgggaaggtgtacaaggcccgggagaaggcgacgggccggatcgtggcgctcaagaagacgcgcctcccggaggacgacgagggtgtgccccccacggcgctcagggaggtctcgctgctgcggatgctgtcgcaggacccgcacgtcgtgcgcctgctcgaccttaagcagggccagaacaaggagggccagaccatcctctacctcgtcttcgagtacatggacaccgacctcaagaagttcatccgcggccaccgccagaaccaccagaagatccctgcccacaccgtcaagatcctgatgtaccagctctgcaagggcgtggctttctgccacggacgcggtgtcctgcaccgtgacctcaagccgcacaacctgctcatggaccgcaagaccatggctctcaagatcgccgatcttgggctcagtcgtgccttcacggttcctctcaagaagtacacgcacgagatccttactctgtggtacagagctcctgaggtccttcttggcgccacacactactccacgcccgttgacatgtggtctgtgggctgcatatttgctgaattgatcactaccacggcacttttccctggagactctgaggtgcagcagctcctgcacattttccagttgttgggcactccaaatgaggaggtctggccaggagtaggcaagctccccaactggcatgagtaccctcagtggaacgtctcaaagctgtcttctgtaattcccagtctcgatgccgttggtattgatctgcttgagaaaatgctgcagtatgagccggcaaagcggatctctgcaaagaaggccatggagcacccatacttcgatgatgtggacaaggcgctgtactgatag

SEQ ID NO: 514 - DNA, 459 bp, Hordeum vulgare
gaacgcagcacacaggtagaccaccctctttaaaattcctaggttcggctaccggagagcacaactgtgcccgcgcgagatgggaatggaggaggcagctgcggggggtgccgcgaggcaggcgaaggagtcgctggagctggcgttccagatgtcccagatcctggacaccggcctcgaccgccacaccctctcgctgctcatggcgctctgcgaccgcggcgccaacccggaggcccttgctgccctcgtccgtgagctctcctccgccgctcccccaacacccgccacccccaccgcgcccgcctccaacgcggcggcagccccgactgctccctcgctgttcccctccggctttcgccagctctaggctagggttcgtgccctcgaccccttcttctttttcctcccagatgacaccgcttgtcacttggatgcgttgtatgtgtgcacttaggc

SEQ ID NO: 515 - DNA, 960 bp, Zea mays
aaagatcccaaaccctagcatctctcatggacgacggcgacggcggactgagcttcgacttcgagggcggcctcgactctgccccggcggccgggggccccgtgccgtcctccactgaccctggcgcgggaggcggcgacgggccgggtatgcacgggcgcggccgaggtcgcgggagctaccgccagacggtgtgccgccactggcttcggggcctatgcatgaagggcgaggcgtgcgggttcctgcaccagttcgacaaggcccgcatgcccgtctgccgtttcttccgcgacttcggcgagtgccgcgagcccgactgcgcgtacaagcactcgtacgacgacgtcaaggagtgcaacatgtacaagatggggttttgtcccaatggtcctaattgccggtacaagcatatcaagctacctgggccaccgccttctgttgaggaagttcttcagaagattttgcagatgcgctcttttaacagatacagtcagaatagaaatagtaattataatcagcaaggggagaggccacaacatccacagggttctgcgttgcctaaccaaaactcagcagaaaatgctactgctgcagctccaccagctggtggacaacaagcacaaacgctgaatcaacagccaccacagcagcagcagaagccaaatacaaatgaccaggcccaaggtgtttcaaatggccatcaggccactagaatcgccacaccccttccacaaggaccatctaggtgtgtgtggagtttctagtcatgcttgtaaagcttttagaactgtgaaaactacatacatagttttggttgcaatagcgtatctcataaaactactatattatattatatgttttgacacttgataagctgtacacttgtacttaattttaagcttatgtcatctataactaattgaaagaaaaaagttcgtagtcatgttgctctttgga

SEQ ID NO: 516 - DNA, 2426 bp, Sorghum bicolor
gagggagaagttgacagcgagggggagacggaggaccaggagcggcgtcgagctaaaagcgccggcggcggtcatggccaccgcggaccggacccggtctttcatgaaggatgttaaacgcgtcatcatcaaggtgggcactgcagttgtcacgaggcatgatgggcgactagctctgggtagattaggggctctttgtgagcaggtgaaggagctgaacgccctaggatacgaggtgatcattgtgacctcaggtgctgttggtgtggggaagcagaggcttaagtacaggaagcttgtcaatagcagctttgctgatctgcaaaagccacagatggagctggatggaaaggcctgtgctgccgttggacagagtggcctcatggctctttacgatatgctatttactcaacttgatgtatcctcttcccagcttcttgtgacagacagtgattttgagaatccaaacttccgggagaggctccgtgaaactgttgagtcactattagatcttaaagttgtaccaatatttaatgagaatgatgccatcagcactagaaaggctccatatgaggattcatctggtatattttgggataacgatagtttagccggtcttctggctatagaactcaaagcagatcttcttgttctactcagtgacgtggatggcctctatagtggtccaccaagtgaacctcaatcaaagataatacatacctacatcaaagaaaaacatcacaatgaaattacttttggggataagtcacgtgtaggtagaggaggaatgacagctaaagtgaaggctgctttcgtggcttcaaacagtggcacacctgttgttattacaagtggatttgcgtctcagagcattgttagagttctccaaggagagaaaattggtactctctttcataaggatgcaagtttgtgggaaccatccaaagatgttagtgctcgtgagatggcccttggtgcaagggagtcttcaaggcgtttgcagaatttgtcatctgatgagcgcaagaaaatattgttggacgttgcagatgccttggaagagaatgtggatttaattagaactgagaatgaaatagatgtatctgcagcacaagaggcaggatatgaaccatctttggttgcgagattgactttgaagccaggaaagatagcaagccttgcgaaatccattcgcactcttgcatatatggaagacccaatcaatcagataattaaaagaacagaggttgctgaagatctggttctcgaaaaaacatcttgtcctctaggtgtgctattgatcgtttttgagtccaggcctgatgccttggtccagattgcgtctttagcaatccgaagtggcaacggtcttctcctgaaaggtggaaaagaagccatgaggtcaaacacaatactgcataaggttataactagtgcaattcctagcaacgtgggtgaaaaacttattggccttgttacaagtagagatgaaattgctgatttactaaagcttgatgatgtgattgatcttgtcattccaagaggcagcaataagctggtgtcgcaaatcaagtcatcaactaagatccctgtccttggtcatgctgatggtatctgtcatgtatacatcgacaaatcagctgacatgaatatggcaaaacgaatagtgctggacgctaaaattgattacccagcagcctgcaatgctatggagacattgcttgttcataaagatcttataaatgctccaggtcttgatgacctactgctagcactcaaaacagaaggagttgctatttatggagggcctgttgcacatgaactattgtgcattccaaaagcagattcattacatcatgaatatagctctatggcctgcacaattgaattcgttgatgatgtacagtcagcaattgaccatatacatcgttacggaagtgcacatacagattgcattgttactacagatgataaagtagcagaaacttttttgcgtcaagttgatagtgctgctgtattttataatgcgagcacacgattctctgatggggctcgttttggattgggtgctgaggttggcataagcacagggcgcatacatgctcgcggacctgtgggtgttgaaggtctcttaacaacacgctggatcatgcgagggagtgggcaagtggtgaacggtgacaaggatattgcatacacccataagaaccttcctttgcaatgaggcagggcatttttgtgcttaatcaggattcgtgtcgatccagtgatgtatgatagtttcatcagataggagcagagaatggtgaatcttttcgattgaggactgtgaatccatggactgcaatgttcagtcagtgtgtagaccatcattctggtggttcattctgtatgagcttggaggccaccctccctaataaagcagt

SEQ ID NO: 517 - DNA, 1909 bp, Sorghum bicolor
ccgccatgccgaagcactaccgccctgcgggtaagaagaaggaggggaatgcggcaaagtacatcacgaggaccaaggcggtcaactacctgcaagttagcctcgcaatcttcaggaagctatgcattctaaagggtgtctttccgcggcagccaaagaagaaggtggaagggaaccacaagacctactaccacacgaaggatattgcattccttgctcatgaccctttgatcgagaagttcagggagattaaggtccatcgaaggaaggttaaaaaggctgttgctaagaaaaacagggatctcgcagacaggctgttgaatcggccaccaacttacaaacttgataggcttgtccttgaaaggtatccaacatttgttgatgctcttcgtgacttggatgactgccttacaatggtgcatctgtttgcggcattacctgctgttgatggtgaacgcgttgaagtcaaacgaattcataactgccgcaggttaagccatgaatggcaagcatacatatcccgaactcattccctgaggaagacatttatttccgtcaagggcatatatttccaggctgaagttcaaggacaaaagatcacctggctaacccctcatgctcttcagcaagtattaaccgatgatgttgatttcaatgtgatgctctcttttctagaattctatgagactcttttaggatttgtgaacttcaagctctatcattcaataaatgtaaattatcctcctattctggatccacgtctggaagctttagctgctgagctctatgcattgtgccgatacatgtctgctggttccagaagaatgattgggaattcacaatctgacgaagtaatggaggataaggatgagaagagtaaagctgatggaataactgaggaagagaaggatgtgaagaataaagcaagctcaaaagcagatgaatctgagctcagattagcacagcttcaacatcagctcccaactaatgaacctggtgcactgatgaatcttgtagaagaatcaactgctgatgatgcagatgatgacgatactaaagaatgtaaaggtttatttaagaacttaaagttctacctgagtcgggaggtgcctagggagtctctattatttattatcccagcatttggagggactgtttcatgggaaggagaaggagctccatttaaagaagtagatgaagatatcacccaccagattgttgataggccgacacaaagccatgttttcctctccagggagtatgttcaaccgcagtgggtctttgattgtgtaaacgctcgtatcatattgccaacagaaggttatcttgttggaagagtacctccaccacatttgtctccttttgtggacaatgatgcagagggctacattcctgagtatgcagaaacaataaagaggctgcaagctgctgctcgcaatgaggtcttgcctcttcctggtattggtgatgaagatctagacaattcattggtagcagcaatgatggatcgaacagaatctaacgaagctgctgaaaagaagaggaagttggagatgctagagaagcaataccatgatgaactgaagatggaaattgacggtgttgctttctctagtctgtcaaataaggaagcaaataaatcaccagatgccaaagatgatactcagtcagatcacgaggcggatgccattaaacaagaggagaaggatgatgatgacattggtactgctctcatgtctcgcaagcagcaaggcctttataaagctatgaagatgggcaaagaaaagaaaaaagagaaaattgagctacttaagaagaggaaaaagaatgcggattctagtgcttcttccaagaagcggcactgatgctcagagttcgcttcatagcattggtgtggcatctctagtag

SEQ ID NO: 518 - DNA, 1685 bp, Glycine max
aagaatagggttttgctatggagaagctagaagcagagaacgttctggtccttccctctgagcaacccaacaacaataggccaaagccaaaaccaaagcgtttcgtgaaaaaccaaatcccagactcaatccttaacaaccctcttctgagcgccgcaatctctgtgctcccttccaactacaacttcgaggtccacaagtgcgtctggcgcgtgctctccacgggagcaaaacgcgtggctctccagttcccggagggtctcctcatgtactctctcccactctccgacatcttcaccaccttcgccggcgtcacccactgcttcgtcctcgccgacgtcacctacggcgcttgctgcgtcgacgaccttgctgcctccgccctcggcgccgacctcctcatccactacggccacagctgcctcgtccccatcgacgccaccacaatcccctgcctctacgtcttcgtcgacatcaaaatcgacgtccctcacttcgtcgacaccctcagcttaaacctcctcgcccaaaccaaaaccctcgtcgtcgctggaaccattcaattcgcctccgcaattcgcgccgccaagccccaattggaggagttaggatttagggttttgattcctcagtccaagccgctctccgcaggtgaggttctgggctgcaccgcgcccaaggtatcatcgtcgaaattgctcggtggtggtggtgacattggtgaatgtgttttggttttcgtggcggatggaaggtttcacttggaggcgttcatgattgcgaatccggggattagggcattcaggtatgacccttacatggggaagttgtttttggaggaatatgatcatttgggtatgaagaggtctaggaaaaatgcgatttttaaagccagggaggctcggagttggggtctggttttggggacgctggggaggcaagggaatccgaggattttggagaggttggagaggatgatgagggagagaggcttggattatactgtggttttgatgtcggagatgagtcctacaaggattgcgctctttgaggattccctggatgcttggatacagattgcgtgtccgaggttgtccatcgactggggggaggcttttgtgaaaccggtgcttactccttttgaggctgaggttgcgctcggagtgatacccgggtggtgggagaagaatgaggtttgtgaagagggtgagggttgttgcaacaagagtgggtcttgttgtgaggatgcaaagggaggggaagattttggtggggattatccgatggattactatgctcaagatggtggggagtggaattcatcttatgtgaaaaagtctactcgtcctgccagaagagtttccgtgtcgtctgttgctgatactgccatttcccaacagccttagatttgctgcttagttacaagtccaaggttttaaaagacagtcttgaacatgacttcagccacaacgttaagatttgtgttgtggctgcattggctgtatttctctgtgatttctcgcagtatcaatgatagcaactggaaatttaaaacatttgttataacaatttttttctctgaaaggatagagtctatatagtctattgttttcttttgtttttagctttgtcttatttaggataaattatgttggatgagtgtttgggtgagaaaacatgttgaa

SEQ ID NO: 519 - DNA, 1119 bp, Brassica juncea
catctgaggaaactcatcaagcttttttgcaggtgatcctgatccaaattacgatgggatcaacgttccgtgatcgcacggcggagtttcgttcactctaccaaacgttgaagaagatcggagcgatcccgtccgtccatcaacccgaaagcgatccgacaacatcctccaaacggtcgccgccgggatcttcaagatccgagttcaacaagaaggcttcccagatcggtctgcgtatccacgagacgtctcagaagaccgcgaggctcgctaaattggcgaaagaatcgtcaattttcaacgaccgtactctggagatacaggagctaactgtgttgatcaggaacgatatcacggggctgaacatggctctctctgatctgcagacccttcagaacatggagatcgctgatgggagctattcgcatgacaaggtcggtcactacactgcggtttgtgatgacttgaaaaccagattcatgggagctactaagcagtttcaggatgttctaaccgcgagatcagagaacatgaaggctcatgaaaaccggaaacaactcttttccgcaaaaaatgcaggagtagataagcagaataatgcaaaagctgtacctgagcctcctccttggtcaagttcatcgactccttccgggaatttacaacagccactattgccgccagtaaatagtggagctccttctggtagccagcttagacgcagatctgctatcgagaatgctccatcgcagcaaatggagatgtccatgttacagcaaacagtcccaaggcaggagaactatagccagaaccgagctgttgcgcttcacagtgtggaatcaacgataacggagctcagtggaatattcacacatctagctaccatggtcactcaacagggagagctagctatcagaatcgatgacaatatggatgaatcgttggttaacgtagagggagcacgcagcgctcttctgcagcatctcactcgaatttcatcaaatagatggctcatgatcaagatcttcgctgttatcatattgttcctcattgttttcctattctttgtggcttgaaacaatacctttatatcttgttgcatcaaattccagaggtaaaagt

SEQ ID NO: 520 - DNA, 541 bp, Phaseolus vulgaris
ttacaagttagaaatggcgagcgcgtttcggagcgtgaaggtgcttccgaactcggcgagtatggaggaggcgcgtcagcgcgtgttcaatttcttcagagaagcgtgccgttctctaccctccgtcatggaaatctacaacatatacgacgttacttctgtcgcccatctccgttccaccatcgcctccgagatccgcaagaacatccacgtcagcgatcccaaagtgattgatatgctgcttttcaaagggatggaagagctgaaaaacgttgtggaccattcaaagcagaggcatcatatcattggtcagtacgtagttggtcagcacgagcaagtgccggattcagcctcaaaagacccggccatctctccctttctgaagaatttctacagcagcaattacttttgaaacttggtcatgagctgttctgtttcctcaaataaagagttatcttaaaatgtttttgtatgtccatactggatgagataatgcttttggttttggatcaaactactgcattcattcttcctggcttaa

SEQ ID NO: 521 - DNA, 1414 bp, Glycine max
gtacgagaaatggcatgtcgctctgttctttcatcttctcctcacataacgaactccatggccatcaaggagggtgtcctctccttcgcacccaaccctcctctgcttcttcgtctcccgaaagccgttacctttctctccttttctgcttccactaaaccccccactaagtcttttcaagtgagatcagttgctggtactacagaagctgcatcggggtttgatgagatgatttctgggactaagaggaagtattacatgcttggtgggaaagggggagtagggaagacaagttgtgctgcttcgcttgctgttaaatttgccaataatggacaccccactctcgtggtttccaccgatccagcgcattctttgagtgattcttttgctcaggatttgactgggggtgcattggtgccagtggaaggacctgattatccactttttgctcttgaaattaaccctgagaagtttagggaagagtttcaaaatgccgcccagaaaaagggtggaaccggagtcaaagacttcatggatggcatgggccttggaatgattgcagatcagttgggagaactaaaactgggagaattactggattcacctcctcctggactggatgaagctattgcgatctccaaggttatacaatttctcgaatcacaggaatatagcatgtttactcgaatagtatttgatacagcacctacgggtcacacattacgattattgtccttacccgatttcttggatgcatccattgggaagatactgaagctaagacaaaagatagcttctgctacctcagcaattaaatccgtatttgggcaagaagaaacccgacagaatgctgctgataaattggagaaactcagggagaggatgataaaagtgcgtgaactctttcgtgatactgattcaaccgaatttgtcattgttacaatccccacggtgatggcagttagtgaatcatctagattgagtgcttccttgaagaaggaaaatgttcctgtgaagagacttattgtcaaccagattcttccaccgtctacatctgattgcaagttttgtgctatgaaaagaaaggatcaaatgcgtgctcttgatatagttcagaatgatccagaactctccagtttatcaatgatccaggcaccactcgtagatgttgagataagaggtgttccagctctcaaatttcttggtgacattatttggaaatgatttacacagttactcaagcaatgattaggttaaatttagtaatttgctgaagttggcagttgaaaccatagacacatggcatgatatcagggctcatcagattttgtatgatgaagttttggagcacttgagatgttcagattctggtactggcagttcttaaagagacactggcttccaatattcacac

SEQ ID NO: 522 - DNA, 1151 bp, Medicago truncatula
aagctatggacgagaatgatgtatcaaatgaagtagtgaaagggaagaagaaagggaagcacgataaaccaaaaccatgggatgacgatcctaacatcgaccactggaaggttgagaaattcgatccatcatggaacgaaagtggaatgcttgaagtcagttccttctccaccctctttcctcaatatcgtgaaaaatatcttcaagaagcttggccacttgttaaatcctccctcaaagaattcggtatctctgctgaactcaacttggttgagggttcaatgacagtttcaacaaccagaaagactaaggatccttatattattgttaaagctagggatcttatcagacttctttctcgaagtgttcctgctccacaggcaataaaagtacttgacgatgaaatgcaatgcgacatcattaaaattagtgggttggttcgcaacaaggaacgatttgtaaaaagaaggcaacatcttgtgggtcccaattcttccaccttgaaggctcttgaaatactcacaggttgttacattctcgtccagggaaacacggtttctgtaatgggttcatacaaaggtttgaagcaagttagaaggattgttgaggaatgcatgctgaataaaatgcaccctgtctacaacattaagattcttatgatgaagaaggaacttgaaaaagaccccgcacttgcccaagagaactgggataggtttctcccaaagtttaacaagaaaaatgtaaagcaaaagaaggttaacgctaaaccgaagaagccgtatactcctttccctcctcctcaacagcctagcaaggttgatatacaattggaaactggggagtactttttgagtgacaaaaagaaatcggcaaagaaatggcaagagaggcaggtgcagcaagcagaaaaaactgctgaaaacaaaagaaaacgagacgagtcctttgtcccacccaaggaacctgcaaatctggtgggtaactctgaggatgctagtaataatgtagctgaaatggcaatgtccttaaaggaaaaagctaggaagtttggcaagcgcaaatcggaagaaaatataaatgccgagacatatattatggggtcatcagaccaaccatcaaaaaagaaatctaagaagcaaaagtcttgataa

SEQ ID NO: 523 - DNA, 2427 bp, Medicago truncatula
cgctcctttcatcttctcttccaaaatctcattttctcttcttcggtttgaataatggatcccaagaacaatgtgaagaacgacgatcctccagcggaatcaccaacttcagttcttgaagaagaggaagtggaggtgaaatcggaggaagaggtgattgcggatgatggatcatcgcttgtaccgaaaacaatggcggaggaagaagagaagttgctgaaagttcgtgtaaaggaagaagaggaaaagattgaagttgcgccgaatctgaatgattcacagtttaataagttggatgagcttttgacacagactaaactctactcagagtttcttttggagaaaatggatgatattacaatggctgcgggtgaacaagagaaacaggatgaagaagagagtaaaccagttgctaaaaagaagggccgtggatcaaaaagaaaggcagcttcacaatgcaacactggaaaagccaaaaaggcagttgaagccatgattacaagatctaaagaaaatgtgaagactgaagatgtggatttgactgaggaagaaagaactgagaaagagcagagggagctgatgcctttactaactggtggaaaattgaaatcttatcaactgaagggtgttaagtggctgatttccttgtggcaaaatggattgaatgggattcttgctgatcaaatgggtcttgggaagacaatccaaacaattgggtttctttctcatctaaaatcgaaaggattggatgggccatatatgataattgctcctctatcaaccctctccaattggatgaatgagattaataggtttacaccaacgctccctgctgttatctaccatggtaacaaagatcagagagaggaaatcagaaggaaacatatgcccagaacagttggtccaaaattccctctagtaataacttcttatgagattgctatgaatgatgctaagaagtgtttaaggtcatacagttggaagtatcttgctgttgacgagggacacaggctgaaaaacgcaaactgcaaattagtgaggatgttgaaatacatcagtgttgaaaataagcttcttttgactggtacgccactccagaataacttggctgagctatggtcactgctgcacttcatcttacctgatatattctcatctcttgaagaatttgagtcatggtttaacctgtcaggaaagtgcactactggagcaacaatggaagagttggaagagaaaagaagaacccaagttgtggccaagcttcattcaattcttaggccatttctgttgcgtaggatgaagtctgatgttgagctaatgttgccacggaaaaaagagatcattatttatgccaacatgactgagcatcagaagaacttgcaggatcatttaattaatgagacattggggaaatatttggataagaaacgatcaattggacgtgctccaacgagtcttaataatttggtaattcagcttaggaaagtctgtaaccatcctgatctcttggaatcagtctttgatggttcatatttttatcctcctgtgaatgagataattgaaaaatgtggaaaatttcaattgctcgaccgattgctggagcggctatttgcacggaatcacaaggttctgatcttcagtcagtggaccaaagtgctagatataatggattattactttagtgaaaagggtttcgaagtttgcaggattgatggttcggtgaagctggatgataggaaacggcagatccaggacttcaatgatacaaccagcaactgcagaatctttcttctttccaccagggctggtgggttgggaataaacctcactgcagccgacacttgtattctttatgacagtgactggaatcctcaaatggatttacaggccatggatagatgtcacagaatcggtcaaacaaagcctgttcatgtttacaggctcgctactgcacagtcagtagagggtcggatgttgaaaagagctttcagcaagttgaagcttgagcatgtggtgatagagaaaggaaagtttcatcaggagcgcacaaagccttccattatggatgaaatggaggaagaggatgttttggcattgcttcgagatgaagaaaccgctgaggacaaaatgatacagaaagatattagtgatgaagacctggagaagctcttggatcgcagcgatcttgttatcaatagctcaactgatgataaagctgcagttagtaccttttctcttaaagggcctggatgggaggtggtgatgccaactgcggcagggggcatgctttccactcttaacagctaatttcccaatctgcaacagaactttttgagggctgaatattttcaaaaaaattgccttttgtggtgtgagatgtaattgactttttaattttgagacaatctcagccagtgatgtcaattg

SEQ ID NO: 524 - DNA, 1993 bp, Medicago truncatula
ttccctcacttcctaaacacacccccttaaccttcaacacacccccataactcaaaacttcaataaaccaaacaaaatgataagtgctttagacttataccatgtcctcacagcagtagtaccactctatgtagcaatgatccttgcctatggttctgtaaaatggtggaaaatcttcacaccagatcaatgttcaggcataaaccgttttgtagcactttttgcagttccacttctctcattccacttcatctcaaccaacaatccttacactatgaactacaggttcatagcagctgattcacttcaaaaaactatcatcctaacactccttttcatttggtcaagaacaagctcaagagggtcattagaatggtctataacactcttctcactttcaacacttcctaacacacttgtcatgggcattcctttgttgaaaggaatgtatggtgatgattctggtacccttatggttcaaatagttgttcttcaatgtatcatttggtatacattgatgttgtttttgtttgagtataggggtgctaggattctcattgttgaacagtttcctgatactgctggttctattatatcattcaaagttgattctgatgttctttctttggatggtaaagagccacttcaaactgaagctgaagttggtgaagatggtaaacttcatgtgaaagttagaaaatcaactagttcaagaagtgagattttttctagaaggtctcatggtgttaactctggtgtttctttgacaccaagaccttctaatttgactaatgctgagatttattctcttcaatcttctagaaatcctacaccaagagggtctagttttaatcatactgatttttattctatggtgaataatggaagaaatgttagtcctagacaatctaactttggaagtttaggttttgatgaggaaagtggtgttgctaaagctaatggaaatggtggaaatggctaccctgctcctcatagtgcagggattttttcacctgtggctaataagaaaaagggtcatggtggtggtgctggtgatggtggaaaagatcttcatatgtttgtttggagttcaagtgcttcacctgtttctgaaggtggaatccatgtctttagaggtggtggtgattatggaaatgatcagcttaatggagtagctcaccaaaaagattatgaagaatttggtcatgatgagtttagctttggaaatagaactgttgctaatggtgtggacaaagaaggaccagtgctatccaaacttggttcaagctcaactactgagcttcatcctaaagctggatctcaaggtgaagctaagccaacaaacatgccacctgctagtgttatgacaagactcattttgattatggtgtggaggaaattgattaggaatcctaatacttattccagccttattggtcttacctggtccctggtctcattcaggtggaatgttgttatgcctgctattgttgctaaatcaattgcaattttatctgatgctggccttggaatggctatgtttagccttgggttgttcatggcattgcaaccaaggattattgcttgtggaaacaccgttgcttctttcgcgatggcggttcgcttccttaccggccctgctgtcatggctttttcttcatttgttgtaggactcaggggagttctgttgcacattgctattgtacaggctgctcttccccaaggaatagtcccttttgtgtttgccaaggaatacaatgttcatcctgacattcttagcactggggttatatttggaatgctaattgctcttcctatcacattagtttactacattttattgggactttgaagcaaatatttgaggacttgaaagaaagaatgaagactaatttcagtggattaggctcttacatatatataactactacattttagtgtttttttttgggctattatctaacaatgtagaaatttggcagttggtaagatt

SEQ ID NO: 525 - DNA, 3386 bp, Oryza sativa
cgagctcaagctaaaccctaaacccccgcacgctctcgccttcccgccgccggcggccacctcgaatccaaccatggccgccgccatcgccgccgcagccgatgactccatcgtctacaagctctccgctctcctcgaggaggtgcggccgagcgccgccgcactccgcgccgcgagcgaggccgcggatgccgtcgcgggcctcgtcaagaggatcccgacgcagcaggcgactcacgaggctgtcgctgggttcgtgagggacctggggctcgcgggggagaagctcgcgttcacgttccggccgccggaggtcgttcgggtcgctgggagccacgcggccggcggcgccgtcgcgaggcccgacgtctccgctgacctcctcgtgcgcttgcctaaggaatgcttccatgaaaaagattttctaaaccacagataccatgcaaagaggtgtctttacctccatgtcattgagaaaagcttgaggtcttctccattaattcagaagatttcatggtctaccttcctagacgaggcacggaaacctatccttcatgtatacccagcaaaagaaatcgcggaacttcctgggttctatgtcaggataataccaactgcaagctttttgttcaatgtttcaaagatgaatttatcaacaagaaacaatgttcgtgcatacacaaaagatggcataaacctgcccacaccaaagtacaattgtagcatattggaggatatgttcttggaggaaaatgtagaatttatcagcagttcagttgcagattggaaagccttgcaagaggcattggttttgctaaaagtttgggcacgtcagagaacttcaatatatacacatgattgcctcaatggatacttaatatctgccatccttgtgttccttactgtggactcggcaggaagcatgattaatagatcaatgacatcgagacaaatttttcgcgttgtgatgaagttcttggcaacttcgaagatgtggacgaagggcttggtgattcagccaactaagaagcgtacaatcaccaaagaggatatggtttgtttcctgaaaacatttgatgttgtcatctgtgatgtatctggacatgtaaacttggcatctcgaatgacgaagtcagcattcatagagcttcaagatgaggcagcttgtgcgcttaattgccttgataaatgcaaagatggtggatttgaagagctttttatgaccaaggttgatttaggtgctaaattcgattcatgcttgaggataaacttgaagggaaacttgaaaattactacatcaagcttttgcttggatgatttggcttggagaaaacttgagaaggatgtccagtctttgctgcaacaaggtcttacagatagaacaaagatgatccgtgtcctgtggagaagcacaccttctgaatggaatataatggatggtttttcagaatttggtagcagtcctctgcttgttggcataatgcttagctcgttggagaagagtttccgtctagttgatattggtccaaaccctgagaatcgagatgaggctatcaaatttaggaaattttggggagagaaagctgaacttaggagatttaaagatggaactattgctgaaagcacagtgtgggaatctgaatcttgggagaagcacacgattatcaaaaaaattgctgatcatgtgcttaccaagcatttgtcgttgcagaaggaagacttgattcatgttgttgatcagttagacttttgcctcctggttggtggccaagatccggtctcgtcgtctggagctttgttcgaagcctttgattctttagcgaagaaattgcgcctattgggtgatgttcctcttaaaatatcaaccgtgcaacctctagatccagcttttagacacacgtctgtgtttcctcctgagcctcatcctttggcatatgaaaaaaggtcttctcagaggctgccaaattttacagctacttgcatgcgatcattagaagtaatgattcagctagagggatctggtaactggcccttggatcctatagccatggagaagacgaagtctgcatttcttttaaaaatgggtgaaagtctggaggatcaaggaatgtttgttactgccagtgaagatgaggtcaatgttcttacatctggatattcattcttgcttaagatatttcacgaaagaggtttgctgttacaaaaacgagatggagacggtaaagctcaaaatgttccatcagaagacaaggaactctttcttcggagccagcactcaagtatgatcaatggtctgcatggtcgttaccaggtgtatgggccggtagtaaggctagcaaaaagatggatttcggcacatctattttcttcatttatctcagaggaggcagttgaattgttggttgcatacctattcttgaagccatatccattcaacgtcccttcttcacgggttgctgggtttcttaggtttttgcgattactgtctagttttgactggaccttttcacctatgatcatagacataaacaatgacttcaacctgaaggatgagaaggagataaatgaaaactttatgctgtgtagaaaatcttatgaacaaaatcctcatgatatagagcctgcaatgtttcttgctacatcgtatgataaggcatctgaagcttggacgagacattcaccaagcaagccggttcttaaacggatggcttcttacgctaaaagcagtgcagagcttttaacaaatcttataatccaaggtcaatcaggccaatatacatgggagtgtgtcttccgaacacctttaagcaattatgatgctgttgttctcctccaccaagagaagctttgtcgtcctcaccaagtacttttccctgctgagacccctaatggcaagctggtaatttgtggcaaaccatgtaaagatttccacccttatatgccactcaataaaggagttgtgaaaagcttgcatgattcaagagagaaaattttggtaaattttgacccaaccacatactttctgcgggatttgaagagtgcatttcctaaaactttcaagctgtggtatgattcaatcggaggagacgcaatcggtcttacatgggagaactcaaagaagcgtggcagagacgaggccgatgaaaccatgctggatccagcttctatcctaaaggaggttggaaatgttggcaaaggtttggtaaggggcgtgtatctcctcaaagcaccaaagcttcagtaaactattgaaaactcgctgaaagttgtgtggaagagagaggcttgtgctgtttgtgcaattaacacaacttctaaccgatattcttacactggcaagagcaagacggtggtttccatggcactgattggacatggtaagggat

SEQ ID NO: 526 - DNA, 620 bp, Oryza sativa
cgtttccgtcgattcaggtagaggagatgagttccgcgggcggcggcggcgggagggggaagtcgaagggctccaagtcggtgtcgcggtcgtccaaggccggcctccagttccccgtcggccgcatcgccaggtacctcaaggccggcaagtacgccgagcgcgtcggcgccggcgcccccgtctacctctccgccgtcctcgagtacctcgccgccgaggtgctggagctggcggggaacgcggcgagggacaacaagaagaaccggatcgtgccgaggcacatccagctggcggtgcgcaacgacgaggagctgagcaggctgctcggcgccgtcaccatcgccgccggcggcgtgctgcccaacatccaccagacgctgctccccaagaagggcggcaaggacaaggccgacatcggatccgcctcccaggagttctaggatcccctcttgggtccgctactcggaatcaagaaccttgttgctccctgttctttgatccgattcttttccccctcccatcttagtaatatccatcctttgtaggttgttaggttaggttttgatgaacggttggatgatggtgtgatgggtttggtgcttgagaaatcttgttgg

SEQ ID NO: 527 - DNA, 1418 bp, Oryza sativa
agcccatggcctcctcgtcggagaacgtggaggcgccgcgagacgagcagcgcgacccgccgccgtcaccgccgaaccctagcgaggaggccggggcgggcgaggagatggaggcggagggggagggggaggaggaggtgaaaaccctagagcgggcggaggagctgttcgagagggggtccaaggccatcgaggagggggacttcgtcgacgccgtcgactgcctcagccgcgccctcgagatcagggttgcacatcatggagaacttgctccggaatgtgttagcacatattttaagtatggatgtgccttgctatacaaagctcaggatgaggctgatcctttgggtaatgttcccaagagttcatctaataaggagtccatgaagagtactactaacaaggatgatagtggaagctcaaagacccccggtagcaatactgaggatgctccatccacggataaagctgatgctgaagaagggcaaaactcaactggaaaaggtcaagaggaggaaaacggtgacagtgacaaggatgatgatgagatggtgggagatgaagatgattctgatttggatcaggcctggaaaatgttggatattgcaagggctatagttgagaagagcccagatgacactttggagaaagcaaaaatcttttctgctctagctgaagtctccatggaaagagaggacattgataactcactcggtgactactttaaagctttagccatattggagaaattgtttgagcctgatcatcgtcgaattattgatctaaacttccgcatatgtttggtctatgagttggtgtcgaagatttcagatgcaattccatattgcgctaaggctatttcattatgcaagtcacgcatacaaagcctaaaaaatgacaaagatgctttgttggctggtaaagatgataacgcatcagctgctgatggaggctcagaaaagtccgctcctgagggtgagatagagcagctcagtggcattttgagtgaacttgagaagaagctggaagacttggaacaagcaatgtctaccccaagctctgttatggatgagattatgaagaggattgcctcaaaggcaggtggtgaacagaatgctactgacacaatgccagcggctgcttctttcaattcttcttcacagatggctggatcaagcaacggctttgattcgtcaactctgtctacggcagctacaaccggaagtactggaagcactgtaaccgatcttggggttgttggtagaggtatcaaacgtgctaatatcaagccaatctctgctgaacctcctcccaagagagctgcagctgattcgctctcagtaaaaggtgatagcagcaacaactcagatgttcataccccagcacaagagggcgatgattctgtatcaaagtaataa

SEQ ID NO: 528 - DNA, 2736 bp, Oryza sativa
cctcctcatttcctctctcacctctccgcgcgccgcctctcgccgccgcggacgaaaccctagctaaaaccctcctctccctctccctctccctctcaccgagccgcgcggcctcgccaaggaccggcagcgatggggaagagcagcagcaagaagaagaaggacaaggtgatcctgcccccgcagctgccgccggaggtggacgacgacgacgtggtggtctctgacgaggacgtcgagttcttcaggggcaacgagggccacgcccgcgcgctcgccacgctcgacaggaagtccatcgacagctacgtcaccagggtcgcccaccacgacgaggacgaggtcgagcgcctctacgaggagcgcgagcgcaggaggaaggcggtcgaggccctcaggcccaagaaccacgacgacgacgacttcgaggtcgaccgcgtcgacgccctccccgtcaagaccctgcaaggggagctggtctacaacaacgccaagaaagcgagatttgatgacagttctaataatgttgaatctaaatctgaagacaaagtaggaaattccaaacaaactattcaaaagggagaacggaaggaaaaatccaaaagcaaaaagggagatggtaaattgcaaaatgtgcaagctcaaactgaagcttcaaatggaaaattacaatcaaaagtgctggaggaggtgaaggaggaactttcagctgaggaattatttgagaaaaagaaggcccagctggctgaaatagggatgtctatgcttgaagatcctgaatcacatattagatctctaaatgatatgttaaacatatgcaatgacaaagaccagaaggttgttaaacttagtctgatgtccttgcttgctgtgttcagggacattattcctagttaccgcattaggcagttgacagaaaaagagcttacggtagaggtttcaaaagatgtaaaaaagatgagatattatgaatacacacttcttcgctcctacaaggcatacctgcaaaagttaatctccttggagaagcaaccaaatttttccgctctggctgttcgttgcatgtgtactttactagatactgctccacatttcaacttccgtgaaagtatacttgccagcgtggcaagaaatttaagttctccagatgatgcagtgaggaaaatgtgttgtgaaacgataaggtctctatttgtagatgaaggaaagcatcgtggtgaggcaactgttgaagctgtgagattgattgctgatcatgtgaagctaaacgattgccagcttcatcctgatagcattgaggtcttcctatctttgagatttgatgatgatcttggaaaagatgacacagaggaagaaaagggaaaaccaaagaagaacaaacgacgacaaaaccaggaagtcccaaagcaattgccagtgagtgataataagaaagccaaacaggaattgatctcaaaggctagagaagaggttgatgctgaacttagatctgtttcctttactcttgatccaaaggaaaggagaaggatacagaaagaagcactctctgctctttttgagacttactttcggattttgaagcatagcatgagtatttcaaattccaggggcaaggtcattaatgtctccccagatggctcacacccactacttgctccatgtttggagggtttaggaaaattctcacacttaattgatttggatttcatgggtgaacttgtcgcgtgcctcaagaagctttctgggtataccgaccatcactctggcacagtacatgacaatacactgtctgtatcagaacgtctgcagtgctgcatagttgcatttaaagtctggaggagcaaccttgaagctctgaatgtagacctgcaagacttctttgtgcagctttttaacctcattctggagtatcggcctgacagagatcgtggtgaggtattagctgatgctctgaagacacttctctgggaaggcaaacagcaggatatgataagagcagctgctttcattaaacgcctagcaacctttgctttgtcctttggttctgcagaagccatggcagcattaatcacactgaagcatcttcttcaaaagaatagcaagtgcagaaacatgttggaaaatgattctggtggtggctccctgtcttgcttagttgcgaaatatgacccagaagctaaagatccttatctgagtggggcacttgcctcagtcctatgggagcttagccttctgcagaagcattacgattcctctgtttcctcaatggcctcaaatatcttgagcatggccaatttgaatcctacacagaatcctgttccaatttcaaatgcaagccctctagaagcatatagagacttgtcaatggaacggaaattgtctaaaccagcgaataaattgttgccactaaactgcagaaagaagaggcgtggtaaggagtttgttgccctaagccctgcagcgctcgagggatcagattgcgttgcgggtggagatgaactcaaagagaagttaaaaaatcattttgcggtactaagaggtatctcagagaatgagagattgagagctgagctgaaccacacgttgtcatccatcaacttgtacaaggaatacaagaagcagaagaaaagcaggaaatcaaaggctgttaagaaaaaggtttcaagggcttaagttgtgctgcgtttgggggaaatttttgcacaccagggaccaaaggtgtgcagaatgaactag

SEQ ID NO: 529 - DNA, 3769 bp, Oryza sativa
tcatcaagaaccaacattcaacaggttcgcatgtgttaattgttgccatggtggatgcaagggagaaatagcctcaccgttgggtccacctgccatgataaagccaagggtcaactggtcggatcatgcaaatgctgttcaaagctcctgtatcaaagatgaattcctgagttcaagttttttgttctctttaccaacacaaaggcctaatcaggaagcagattgtacgggaatgcttcctttaaggtctgctgcttgcagaattcaaggcctagagcgtcttcaagctccatccattgagaaggcctggcgttctctacgcaacactcaggttgcacggaagaattatttaagacctggtttatctggaaaagtgaaagattgtgatagcgaccatgctcatacttatgggacaagttcttcatataatgttaacaaaatggacagtgtgtccagaaataggaatcccacccaggaaagtatgcatcagacgactgaaagtggtactatggagaagaacagtagccatctgcctgcaggcaccaagtcctgtacaaggacttacctgaacaatcatgtggtgcaggcagataccattacaacaacaaatcaaagtcttgcaagaactggtcctgaattattcaagactgctccttttattgacaacatgtgtgatgatgctaaattagatgccatggatgaggatgagcttctagcgagtattgatgtggaccgaatagtcatggaacattatcaagcaacaaatacacccagagggtcatccaaatctccattagagaagtgcaacttcaatggatttgatgagaataatttaccacaagaactctctataatgtgtgaccacggtagcaagctagctttttgcccagaggcgaagtctcatttgcttgaaatgaaggataacttgcttgcaatatcccatgagcttattgacggtcaactcagccctcaacaatctgatgatcttcatcaaaagagagcactcctaaagaagcagattgagctgcttggggagtatacggcgaggttaacccaagatgaagagcgacagcaatctcattctatggcctccacaacagctcatcagggccatcaccccactagcatcctaagtagctcttttgtaaaggataccaatatattccaatcaccgatttacaccaggaatgaacctggggaaagtggtttatgcttttcttctgctccatattcctatatggatggtttaagcatgccattaccgtctgttcagagagattacactccaagggctattgatatcagttacactgaaggttctggtgataaacagtggagtagtacacactttgcatggactaaggaactcgaggccaacaacaaaagagtatttggaaaccgttcttttcgcccaaatcaacgagaaataatcaacgccacaatgagtgggaatgatgtttttgttttgatgccaactggtggtggaaaaagtttgacatatcagcttccagcactcatttgtaatggcgttacattggtagtttctcctctcgtatcgctcatccaagaccagatcatgcatttattgcaggcaaatatttctgcagcttaccttagcgccagcatggagtggtcagaacagcaggagatattaagagaattaatgtctcctacatgcacgtacaagttactgtatgttacgcctgaaaagatagccaagagtgatgctctgttgagacaattggaaaatttatattcgcgaggccatctctctagaattgtcattgatgaagcccactgtgttagccagtggggtcatgatttccgacctgattaccagcatctaggcattttaaaacagaagttcccgcagacgccagtcctggccttgactgcaacagcaactgcaagtgtcaaggaagatgtcgtgcaagttctaggccttgcaaactgcattattttcagacaaagttttaatcgtccaaatctgaggtattttgtatggcccaagacaaagaagtgcctcgaggatatccataactttatacatgcaaatcataataaagaatgcggcatcatatattgcctttcgaggatggattgtgagaaagtggctgctaaattaagggaatatgggcacacggcatcacattatcatggtagcatggatcctgaggatagagcaaatatccagaaacagtggagcaaggataggatcaacataatatgtgctacagttgcatttgggatgggtattaataaacctgatgtccgttttgttatccatcattccctgcccaaatcaattgaaggatatcatcaggagtgtggacgtgctggtcgtgacagtcagctttcaacttgtgtcctgttctacaattattctgattatattcgtctcaaacacatggttacccaaggatttgcggagcaaggaacatcagcaccacgaggaggttcttcgcaggaacaagcgcttgaaacgcataaggaaaatctcctgcgaatggttagttactgcgaaaatgatgtggactgcagacgtctactacagctgatccactttggagagatgtttaatccttcatgttgtgcaaaaacatgtgataattgcttgaaagagttgagatgggtcgaaaaagatgtgaccaacattgctagacaattggttgatctggtaatgatgacaaagcaaacatattcaactactcatattctcgaagtatacagaggttcagtaaaccaaaatgtcaagaagcaccgccatgatactttgagtcttcatggagctggaaagcatctagctaaaggtgaagcagcgagaatattgcgccatctagtaattgaggaaatactcattgaggatgtcaaaaagagcgaaaactatggatctgtatcatctgtcttaaagactaatcataagaaaagtggtgatcttctctctggcaagcacaacgttgtcctcaagttccccactcctgagaaggctcctaagatgggtgtactcgatgaatcgtcagttccacgaattaataagactaatcaacagagtcaagtggacgggagccttgcagccgagctttatgaagctttgcaatgccttaggactcagataatggatgaaaatccacaattattggcataccacatatttaaaaacgagacattgaaggaaatcagcaaccgaatgccaagaacgaaagaggaacttgtggagataaatggcatcggcaagaacaagctgaacaagtacggggaccgtgtgcttgcaaccatagaggatttcctcgccagatatccaaatgcgaccaggaaaaccagcagcggcggcagcaacgagcacagcgaggcggtcaagaagcgaagaggcttctccgtcaccaacacctctaccaactgtgacgactttgaggaacgcacggtccagtccaagaaacgcgctgcaaagacacgtacaaggcaggaaatatctgatgctgccagcatcgtccaggacgtccgctacatagatcttgagctagatggttgtgaacaagtcaatgaagtgccatacagtgtacaaaagcctgtggcttctggtagggttttacctgcgtggcagtccgccagaatagcctagggttaacaccccctagtagtttctaatttatgtgaagaatttatatgcattaagtaggatcctaggctaaccccattgagctttatgtaggccttgggccaactacttgtaagatggcaccaaccagaccacatgttaggttgcttctga

SEQ ID NO: 530 - DNA, 1235 bp, Glycine max
aatccagaaggcgaagaagaagaaacgacagagcaagaaggaaatggcgaccaacattgggatcatggatgcggcttacttcgtcggcagatctgagattctttcttggatcaactcaactctgcaactcaatctctccaaagtcgaagaggcatgttccggcgcggttcactgccagcttctcgatgccgctcatccagggatcgtgcctatgcacaaggtcaatttcgacgccaagagcgagtatgagatgattcagaactacaaggtccttcaagatgtcttcaataaactcaaaatcaccaagcacatcgaggtcagcaagctggtgaaaggaaggccactggataacctcgagttcatgcaatggatgaaacgatactgcgattctgtcaattccggccttcagcacaattataatcctctggagaggagagaggttagcaaaggtggaagagaaacgagcaagaaatctgcaaactcgcaagcctcaacgaagggttctactgcacagagacctcagtcttctcataattctcgaagaaatgaggtttctaatgctaaccctacaaatcaagctgcaaaggttgcgagagcagcaccttctgccggaaaccctgcctatgaagaaaagataacagagttgaagttgtcgattgatagccttgagaaggaacgggatttctactttgcaaagctgagagatattgagatactgtgccagactcctgagatagaacactcaccgattgttgctgcgatacagaagatattatatgctacagatgacaatggaacggctgtggctgaagctcaagctatgatttctgttggtcgtaaggaaatagagggattgagccccattgctgaggtttcggaggagaagagcagttcagaaactcacaagagaaagaatattgccaatattgattttgatgttgctgggcttgcaacgttgtctcccagacagaggctttctgatgtttcagatgttcattgtagcgagtcacctcttatgacttgttagggatcacgttctgttgttaattcaattagcaacttgttaaaactgtttttggtcacagtaattcctgtttcatgtgtgaattgaccgcgatattcataatgattaggggtttttagggagactattctgttataaagtatcagtatcagcccagaaaaatgtaaccagatatgttttgcctttatagaatttgctgctagtgctttga

SEQ ID NO: 531 - DNA, 3374 bp, Glycine max
gtgaaagtgtgagagaatgtctaaccctcaagaccagaaaccatggaaggcggaatacgcgaagtcgggaagatcgtcatgcaggacgtgcaagagccccattgccagcgaaacgctgcgtctcggaaagatggttcaatccaccaaattcgatggcctcatgcccatgtggaaccatgctgcttgcatattgaagaaagccaatcagataaaattacttgaagatgttgaaaacttagagtcacttcgttgggaagatcagcagaagatcagaaaatacatagagagtggcggcggcggcggcggcggcggcggcggcagtagcagcagcggcagcgcggcaaagtcggactccaagactgtcaaagatactaaatgtggtattgaagtgtcacaaaattctcgtgccacttgcaaggattgcggtcaaaaaattatcaaaggagaggttcgtatatctactaagcctggtggtcaaggtgctaaaggtttggcttggcaccatgccaagtgtctcatggaactatcaccatcaattgacgtgtataagttatctggatggaacaatctctcatcttctgatcaatcagctgtcagtgacttcgctaaaaagggtggtagtgatacaaaaattgagactgaggagggtaaagaatccacacaacaacaaacttccaaaggtgggataaaacgggggaaggatgttgatagtgagcggaaatcaaaagttgctaaggccaagggagatgtgtctgtgggcagcgcaatgttagtgaaatcaggggaagcatgtgatctggagaagaaaatggagacccagagcaaagaactctgggatttgaaggacgatctcaaaaagcacgttacaacaacagagttgcgtgaaatgctggaagccaatggtcaagattcatcaggatcagaaattgatttacgtgaccgctgtgctgatggaatgatgtttggagcacttggtctttgcccaatatgttctggctttctgcgttactctggaggaatgtaccggtgccatggctacatttccgagtggagtaaatgttcttactctacctgtgaaccaaaccgtattgaagggaagtggaaaatcccagaagaaacaaataatcagtaccttaaaaaatggttcaaatctcaaaaagggaagaaaccagttaggatattgcctcttccatcaccaaggaaatctgctgaaagtcaaatgattgctagtcagcatcatcattcatcaaatagtgaaaatttgcgagatttgaaagttgctatctgtggattacctaatgactcaattgcagaatggaaacgcaaaattgatggcataggtggggtgtttcatgcaaaagtaaataaggatactaactgcttggtggttgttggatcactcaatgatgaagctgagatgcggaaggcaaggaggatgaaaaaaccaatagtcagagaggactatttgattgactgcatagaaagaaagaaaagacttccatttgatatgtacaaggttgaaatgattggtgagacttctagcatggtcaccattaaagtgaagggacgtagtgctgttcatgaggcttctggcctacaggattccggccacatacttgaggaagggaaaagcatatataacacaactttgaatatgtctgatttgtctactggtactaacagctactacattctccagataatcgaggaagataaggggtccgattgctttgtgtttcgtaaatggggtcgagttggaaatgacaagattggaggaacaaagctggaggaaatgtcaaaatctgatgcaatatgtgaattcaaacgattattctatgagaagactggaaacccttgggaggcgtgggaacaaaagactatccagaagcaacctggaagattttttccattggatattgactatggagttaacaaacaggtcccaaaaaataaaaaaaatgatgctgacagcaaattacctcctccattaatagaattgatgaagatgctcttcaatgtggaaacatacagagctgccatgatggaatttgagattaatatgtctgaaatgccacttgggaaactgagcaaaagcaatatccaaaaggggtttgaagcattgacagagatacaaaatctgttaaaaattagcaatcctgatccatccgtcaaggaaagcttactcattaatgccagcaatcggttcttcaccatgatcccttctattcatccacatattattagggatgaggatgactttaagtccaaggtgaaaatgttagaagcccttcaagacattgaaatagcctcaagattagttggatttgatgctaacaatgatgattccattgatgataattataagaagcttcactgtgatatatctccacttcctcatgatagtgaagagttttgcttaattgaaaagtttctccagaatactcatgcccccacacatacggactggagtcttgagctagaagaagttttttcacttgaaagggaaggtgaatctgataagtttgctccttacagggataaacttggaaacagaatgctcctatggcatggttctaggttgacaaactttgtgggcattcttaaccaaggactcagaattgcacctcctgaagccccggctactggctatatgtttggcaaaggggtttactttgctgacctggtcagcaaaagtgctcagtattgcttcactgataagaaaaatcctgttggtctaatgcttttgagtgaagttgcgcttggaaatgtctatgagctcaagaaagctaagtatatggataaacctcccgaaggaaagcactctactaaaggactgggcaagaaaatgccacaggaatcggaatatgtaaagtggaggggcaatgtcactgttccttgtggcaaaccagtgccatcaaatgtcaagagttctgagctcatgtacaatgagtatattgtttataatactgctcaagttaagatgcaattcttattgaaggtgaggtttcatcacaagagatgaggactagagagaagtttcttgttctggggtgtcatctacactaagcagttttttgaccatgactaggcatgctagtgcagggatgtattagttgaaacccgtcacttagaccaaaaacatctcatccaatttgtgatctggttatctgtatagaactgctattttaatctcaaactttttattgagctcttcccttttaaatatgtgttgcatcagtataagtgcttttatcatatacaaacacaaatcagttaagggtttttttttatcttaccagtctagtaaattttcaaataggtatgcataaatagaagagctatttcccttcctctgtgaaggaggtaccctgaag

SEQ ID NO: 532 - DNA, 1391 bp, Glycine max
ggcgcatgtcggcctcgcgcgctccccccgccggcgccggcgcctctaaaccgccggaccagatcatgcactccatgaaacgccaactcccgttctcctctatgaaacctcccttcgtcgccgccggagactaccaccgctttgcccccgaccaacgccatgacgccgccgaagccatcgtcgtcaagactccccaactgaagcggaagagtgaagcggctgattttgaagctgattccggtgataggatgactcctggattcactgaagcagctaatagtccttttcagacacctgtatcaggaaagacggggaagggaggcaaatcctttaggctgacaaagggcaacagacttggaactcagaccccaggctcaaatattggttctccttcaggcaataatctcactcctgctggtccatgtcgttatgacagctctttaggtctgttgacaaagaagttcatcaatttgatcaaacaagctgaggatggtatccttgatctgaataaagctgctgacacattagaggtgcaaaagaggaggatatatgatataacaaatgttcttgaagggattggacttatagaaaagaaactcaagaaccgaattcaatggaagggactggatgtttcaagaccgggtgaggctgatgatagttttcctagtttacaggcagaagttgaaaatttaacaatgaaggagcgccagttagatgaacaaataagggagatgcaagaaagactgcgagatcttagtgaagatgaaaataatgacaagttgctttttgttactgaggaggatataaagaatttgccctgcttccagaatgaaaccttaatagctattaaagctcctcatggaaccacattggaggtccctgatcctgacgaggctgttgattatccgcagaggagatacaggatagtcctcagaagcacaatgggcccaatagatctttaccttgttagtcaatttgaagaaaagtttgaagagattaatggtgttgatgttgcacccaaacttccatccagtccagatggtactaaacatcaatcaacagtggtcccggaggatagagggaaggacatagaagtgcagggacaagaagctcctgggcctagttcagattttactacctcccaggattttgtgagtgggatcatgaagattgttccttctgatgttgctagtgaagctgattattggcttttatcagatgccgacgttagtataactgacatgtggagaacagaacctggagttgaatggaatgaactggaaccactccaagaagattattgcatgactcgcgagaacactgcgaccccaagtcatccttcaaatgtagatgaagtgtcttctgcacctaaatctactggaggttgatga

SEQ ID NO: 533 - DNA, 1997 bp, Glycine max
ccacaactatttcccttgcttgttgaagcctagtatcattattgtctagttcttgctgtgcttttttgtgttctctctctctctctctctcttttatggatcttggggtagtgggtttggagggggtggtgggttcagaaagtggttgcgtgtttggttcctctcttgcttcagatcctgagacaaagcacaagtggtacggatctggtgtgctcaagcaagagagatctgccatagcaagtgaagatgatgagtggggaacttataaagtggccaaaattgatcatgacatgtcttctgcccctaaagcaatgatctttcagcaaagaaacaactctttgttgagatctaataatgctactcttttttctgacggccatcaccaatctcaaatgttgagtttctcttctccaaagtcagagactttgttggtagatacagcttcctcaaatgccacattgcctttttcttaccatcaattgtctagttacagcagaaatacaggttacagttcaggaagcataagcatgcatggggctttggctggtgtgagagggccattcactccatcacagtggatggagcttgaacaccaagccttgatctacaaatacatcactgcaaacatgcctgtgccaactcatcttctcatacccatcagaaaagcacttgattctgttggcttctgcaacttctcaactggactcctcagatccaactcattgggatggggaggtttccatctgggattctcgaacagcacggaccctgagccagggaggtgcaggagaacagatggaaagaaatggcgatgctcaagagatgccgtagtagatcagaagtattgtgagcggcacatgaacagaggacgccatcgttcaagaaagcctgtggaaggccaatcaggccatgccctcaccaccaccaccaccactactaacacacttaatgcttcctcaaactcaaccgtggtgcccggcaacaacacctttgcacacaacaaagtgcaccaccctcttccacctaattcctctccagccaataccatcaataggatgtttatgaataataaagagaataacagcacgagtgagaggatggaggattgctctgcccttcccatgctacctcccactcttgagctgaaaccgaaggagaaaaacaatttcatgattcataaacaccaagacccctatgatgaatcctcaaggaacaacaatgagtttggactcgtcacttctgattccttgcttaaccctacacagaaaagaagctttgattcttcttcttcacaaaaggatgattctgagtcccaacaacaacattccctcaggcacttcattgatgactctcccaaaccaccatctcataatcatcatcgttcgtcgtccatttggcccgaactcgacaacatacagtcagataggactcagttatcaatctccataccaatatcttcctcagacttcatgtcattcactacttcctcaccctccaacgagaaactcacgttgtcgccacttaggctttcgagggcgttagaccccattcaaatggggttgggagtgggaagcggtgcctccaatgaagcaaatcctaggcaagccaattggattccaatcacttgggagagttcaatgggtggccctcttggagaggttttgaaccttagcaataacagcaatgcaagtgatcaatgtggcaagaacaacacttcagctctcaacctcatgaaagatgatgatgatgatgggtgggacaatagtcctccactagggtcatcaccaactggggtgttgcaaaaaacagcatttggatcactctccaacagcagtgctgggagcagtccaaggggggcaccagagaacaacaaagaatagagatttctgattccttgttttcaagtttgaactggttttttgttgttcttcttcctcaaaagtttgtttgggaatggattggcgtttgtggaatgtggaccacacgagttgtagctg

SEQ ID NO: 534 - DNA, 1748 bp, Glycine max
atttttctggctctttctgaggggctatttttagcgggttgaagttgaagctgtaaatgccgctgagatagatttacatggggaagaagggaagtggtagttcgtggttaaccgctgtcaaaagggcattcagatctcccaccaaagacagtgacaaaagaagtggcagaagaagagaagactgtgatcaagaagaagacgaagaaaagaagagggaaaagagaagatggattttcaggaagactcacatgagtcacgaaggagtgaacaacaacagcaaccacactactcaacaaaaggtgcagcatgatgtggcagcaagtgggggtggttcaaggacagaccaggatcagaagcatgcacttgctgtggccatggccaccgcagaagccgccatggccaccgctcaggcggcggcggaggtggcaaggttgtccaaacctgctagccatgccagggagcattttgctgctgttgtgatccaaactgctttcagagggtatcttgctagaagagcgcttcgtgcactgaaggggttggtgaagttgcaagctttggttaggggtcacaatgttaggaagcaggcaaagatgacccttaggtgcatgcaggctttggttagagttcaagcaagggttcttgaccaacgcataaggtcttcacttgaaggtagtagaaaatccactttcagtgacactgctagtgtttgggactcacggtatcttcaggacatttcagataggaaatcaatatcaagagagggaagcagcattgcagatgactgggatgaaaggcatcattcagttgaagaagtgaaggccatgttgatgcagaggaaggaagctgctgcaatgaagagggacaagaccttatctcaagccttttccgaacagatttggaggaatggtagaacatcatcaattggaaatgaagatgagttggaagagagaccaaaatggctagatcggtggatggccacaaagccatgggagaatagaggaagggcttcaactgatcaaagagaccccattaagactgtggaaattgacacatctcagccttattcatatctaggaaccaattacagaagatcacatccaaattatcaatacaacccaaaccatcaccaaccacaaaggcattccattgcttccccactccatagatctcaccaaaatggatcctcccttcaccaatcccctgccaccccttctcctgccaaatcaaggcctatccaagtccggtcggctagtccacgttgcgttagagacgacagaagctaccacacctcccaaacaccaagcttgaggtctaattaccactacacaggaaacttgtaccaaaatggaaggattgtttcaactggaactagtagtggtggtgctactgctacattgcctaattacatggcggcaactgagtctgcaaaggctcgaattcggtcgcaaagcgcgccgaggcagaggccatccacaccagagagggacagggttggatcagcaaagaaaaggctttcttttcctgctcctgacccttatggtgtgggagtgagttatggaaactatggacatagtttaaggagtccaagcttcaagagtgtgagtggatcacactttggagggttagagcaacaatcaaactactcctcttgctacactgagagtattggtggtggtggtggtgaggtttctccttcttcaactggtgaccttaggaggtggttgagatgatttgttgcactttaatga

SEQ ID NO: 535 - DNA, 1827 bp, Glycine max
agaaacctttcaccaacactgctgcttaaattgttgttagttgttactatgagagagcaaaacgttgagtcgttctacgctaagcttcgcgagtccgcgctatcttcttcctcttctccggttctgatttttccctcaacctccgacgtggactctctctgtgccctaaaaatcatcttccacatcctcgaatccgattccatccaatacgcgtgctacccagtgtcgtcttttcacgagatccacaagtacacgtcatcttcctcctcaaacgacgagcctctctccgtcgttttggttaattggggcaaccacagagacctcagcaaaaccctcaacctcgcccccaacgcccgcgttttcgtcgtcgacagccaccgccccatccacctccgcaacctcagcgatcaaaacgacgccgttctggtgctcttcactaaagacgacgagaaccaatccgatctcgcatccgacttcaacctcgccacgctcgccaacgccgcccccaccgtcgattcggattcccagtccgactccgaatctgaatccgattccgactccgactccggctccgaaagaaatggatctagaaagaggagaaagaagaaccctgaggatgatgatgaagatccaattaagctctaccggaagctgaagaaaggctattaccgattggggacgtttcacgggaagccctctgggtgtttgatgtatgaacttgctgacaagctcaggaagaacaccaacgagttgctctggctcgcatgcatttccctcacggatcaatttttgcacgatagattgagcgatgagaggtaccatgatggagtcatggagcttgagcagcacataaacagttctggtaatttggatgtggttactttggttactcttaaggatggcaccaagattcgtgccccgaatttgtcgcggattacttatgaggaccagccgaggctcatgctgttgcaggagtggagcctctttgactccatgatgtgctcctcgtacattgccaccaagttgaagacgtggagcgagaatgggatgaagaagctgaagcttctgtttgggacgatggggttcgctcttggtgattgccagcagaagtttcagcacatgaatgtggaggtgaagcgcaatatgaagaaggagtttgagaggtttttgcctgagtatgggctcactgatttttactacaggagtttcattaggactctcaagtatagttctaagatttctgctgcggatgtggtgtatggtgtcactgcattgcttgagtctttcgtgagatcagatggttcttgtgcttctaagcagtttggtgtggcctatgatgcgctttctttgaacaatattgacaacttgagaaccgggatgcagcatgctattaagattcagagagcaattttaaggcaaggcagtgctgcaattactaagattgggtgtataaggagtggaaggagtttccggtggctgaagctggaggattccaatgatgctatgctgttggggtacccacaggctttgactaagttctgtttatttatcatggatgctttgcgagagaaaggggccaaaatgaagcctttgatttgtgtttgtgtgtctcaggagcccgggaaggtgctgattgtgggggtttgtgggaggccgcgtttgggtggggctcaagcaaatgcatttgggattgcatttaggactgcggcagaggagattggaactgagttctttcatgagttatttgaatcatcgtggattgttctggatgcttcagctgtgaattctttcatggttaggttgaccaagaagctgtgatgctgctga

SEQ ID NO: 536 - DNA, 3152 bp, Glycine max
taactcaaccttcttcaatcttcacacaccccttttagaatataacaaggtttatttgtcattcaatggctagttgcttgatttgttgttgtgtcattaagtctagtgttgcagttgtagcgttaagtgtggttgtgttttagtgagggaaaaaagaaagaaagttggaagctttggttggtggggtggtgggaattgtcatgggtgcggatcgtctgatactgccaacagttggaccgccattaaaacggcgagcagggttgcggaggaagcaggctggaagagggtcctacagagggagctaggtgtgagtgagtgagtgtgtttttggaggattcaaattctcgggggtgccttcggggtgttaaaagtttctgacttgttaggggggggacaacatgggtaccaacttgcaccaagtactcggaagcctctgtttgaatactcactggaactacgccatcttttggaagctcaaacatcgtgctcgaatgatcttgacatgggaggatgcatattataacaatcctgatgatttcgactcttcagaaaataaacactgccagaagaccttggaacagattggttgtgggaaattttcacacagtgcattagggttagcggtggctaagatgtcatatcatgcatattcattaggagaaggtattgttggacaggtagctgttactggaaaacataggtggatctgtgcagataatcaagttgcgagttctggcttgtcttttgagtttgctgatgggtggcagtctcagttttctgctggaatcaggactattgctgttgttgctgtagtccctcttggtgttgttcagcttggctctctaaataaagtgattgaagatatggggtttgtaactcatatcagaaatctttttttgtctactcaaaattactcaatccaatgtcctagtcaaatacagggtagtttgaagagttcatctcagctggacaaatcgaaggaaaatttttcttcagatattatgcgtacttgcttttacgatacacagaaatctatgaaaagtgaaacagcagatgttttaatgccccttcaatgttctgggactgggaggaactgtacacctccttctgcttgtgagaaaatgtctgataatgtggccaagcaagaggggcctgaattgtacaatgatgaaagttccattttgcttcagtcgatatccaatatgatgaatgtggactgtcaggaatttgaagagatgaaacctctatatgggacaaagtatgaaggaggaagtagtggctgcaaagatatgagattggaatcagaaaaaaatgtctcatcatttttaaatgattttgttacagataatgctagcttcaatgatgtaatatgtccatcagaaaaagtcagagttgattctgcatgctttccttcagtttttcttgatacagttgtttgtgaaagtgataaattgcattatgcagatattaaccaaaaaggggcagtgaattttgcccaaccttcagaagcaaactcccagcaacatattgaaaagtcaaagtttcatactgagccttgttacaaggatatcccagacttccaaactgaaccttgttacaaggatgcctcacacatattgaagttccctgctggctgtgagctacatgaagcacttggaccagcttttttgaaagggggtaaatgtttagattggccagcacagattaatcaagaaatgaaatctgttgaaatgtcagatgagattagcactagtcaattgacttctgaatcttgtccagaacatcttttagaagcaatgctggccaactttagccatagtaataatgatgttaatagtgaattatcattttgtaaatcaaagcaatctgcaattgtctctgcaaaaaatcatgaggcttctattcacaatgtgcatactattaattcagaaggctattcgatagatcagctctctcttgtcagagaggacaaacaccattctttgagttcatcatcagggatatgtggtgtgatgtcctcaaaaggtatttcatctacatttcatagttcaaatagtggacagcttgaaaggtcgtctgaaccatctaagaacagcaaaaaaagggccaggccaggggaaagttgtaggcctcggccaagggacaggcaactgatccaagatcgtatcaaagagttgagagagctggtgccaaatggagcaaagtgcagtattgattcactcctggagcgcacaataaagcacatgctctttctccaaagcataactaaacatgctgacaagttaactgacttttctgatacgaagtcaaagttgcatcataaggaagcagacattcttggatcatctagttatgagcagggctcaagctgggccatggaggtagggggtcatctgaaagttcattcaatattagtggagaatcttagcaagaatggacagatgcttgttgagatgctatgtgaggagtgcaaccattttcttgaaatagcagaagccataagaagtttgggccttaccattttgaagggtgcaacaaaagctcatggtgaaaagatgtggatatgctttgttgtcgagggtcaaaacaagagaaatgtacacagattggatatcctgtggccgcttgttcaaatactgcaatccaagagcaccgtgtattcacattaacttgttggttcttggaaactatggccactcattggcaagtgtaactcattcttgatctttgaaatgatgctcacctttatagtgtgttaagacataggttgtggtcgtgtttgtgtgttttcttaaatgattgaaatgtgtgattgtcgttgtttatgtttgacactgaaaatagcacaatacgttgaacatatactagtgttactctcttcacatctcagacgtcttgtttatttaccagtaaggccgaagttatattattaatgatcagaatttaaatacaatacataggtaaacctattttgacatccctcaattctctgtaagtatccatgagttatacccatttgatgccacagtaatgccaccaattaagcgttgtttctttcattctatgtgcaatgtttggtggattcaaagatgtagtagtacactttttgttgttttgctaaaaatgcaaggaaatccacaatttgttccgag

SEQ ID NO: 537 - DNA, 3386 bp, Glycine max
tggaaatggcagagcagcaaagtagccgaatcagcgtctttttcagtgcttcgaagccccttcttcctagaaaaaggccttctgattcctctccccttcaccctcaccgaatcaagagtgccggtgatgttgcttcggtttctgttgcgaagagagttcctcttgcggaagtgccgctgaataggctcaatgcaattgggagtgttcatggtccgtcgcctgatgcaattcacagcagtttcagtgcaaggactgtgtctgttcctgcagttggttctgcggatgagaacctgtgtcgatctctttttgaaactccaaggagagaacctgaaggctctaaacctaaacagctggattgtttttcaacgactggtctccttgacgacgattttgatgactcttttttggagcaaattgacattctgtgtgagcagaaatctgcagagcagcaggcggatcgtagcagtgacgagaaactttcgagcaagagtaatgttgttggtgatgttaatctgagttcagaatctggtactgtttctgagggtataggaaacggtcacctgcttagctctgggattgagctagatagtagagaagaggaagtggattcaagctggcgagatttactcaatagcaccatgcctgaggaatatttgaaatacttaaagtctttaaatgacaggcaaagagaagcagcttgcactgatatttcaacccctttaatgattgtagctggtccaggaagtggcaagacatcaacgatggtagggcgtgtattgatgctgctcaatgagggcattagtccatcaaacattcttgcaatgacatttactacagcagctgcttctgaaatgagagaacgtataggagctatagctgggaaggcaacagctaaagaacttactatcagtacttttcattcattttccttgcagctttgtcgttcacatggagaaaagttaggtcgtacatctgaattcttaatatatggacaggggcaacagcgaaatgcaattattgaggccatccgattattagaaattggaaagagtgaaaataaagatggtgcattattaattggtgaattgtccaatagtctaaataatcctaaacagttcaaggataaggcaaagaaatggcaaaagtttgtggctcaggccaaagcttcgggaagaacttctgcagaatatcgcaaaatgggcaacgaaattggagccgcaattcttaagaattacaacaacatattaaaatcttgtaatgctctggattatcatgacttgatcagctgttctgtgaagctacttagtgattttcctgaagttttcaaagaatgtcaggattcatggaaagctattgttatagatgagttccaagatactagtgccatgcaatacaagtttctaaagatgcttgcatctcatcataaaataacaattgttggtgatgatgatcagtctatttacagtttcaatggagctgacatttctggatttatttcctttcgcaatgattttccaaactacaaagagattaggcttaacaaaaactaccgatccacacgttgcattgttgaggccgcatcttctcttattcaaaataattccaagcgatgtcagttgaagaatgttcttactgataactcttctggatccaagatagttatgaaggagtgtcacaatgaggatgcacaatgcgcatttgttgttgacaaaatcatagaaatttcatcaaattattctgcagctaactgttgttatggcaacattgcaattctctaccgtaggcagatatcaggtaaagccttccaaatggctttccgtgataggaaaataccatttaacattcatggtgtggctttttacagaaaaaaggtagtcagaactatcatggccatgcttcgaacagcactgcctggttgtgatgatgggtcatatagtcgtgtcttcaaggctttaatgcctttggagaaagataaaaaaaagaggataattgaccatatcaacaaaatatcaacaattagaagatgtagcttcttgtcagctgcctctgacatctttagtgcaaagatttctggtacctttaaaaggagtgagcttacccatggaaggaagattttaatgacactagagatgatatcaaaacttattcagagggaaaaatcgatctcagctatcatatcttctgtggcaaacatgatacccgagaaataccttcttgagcaacgagcagtcgttgatgttgatggagggacattgctgaatgaagactatgacatcagatctgttcttcaatacctgttagatgacgtctctgagtttctatccactaaattagttgaagtaaaagaggaaagggaaatatctgaagataagggctgcatttttgttctaaaagcattcattgattatttacttgagcgtgagaaagaaaattttggtgctcggaggaaggacaatgaaaactctgtgacgttgactaccattcatcaggcaaaaggtttagagtgggatgttgtcttcatagttaaggcaaatgactctgagatccctctattacatgatttcaagggcaccgtaaaggacactgcagccttacttgaggaagaaagacgattattatatgttgcaatgactcgtgctcgggagaagctttttattcttcatgttatgatggactcaaactggcagatgcttcaaccttcaagatttttgaaagaaatccctcgtcatcttacagaagttcagggtgaaataagttttcaagaactactgataaagcaagaagctcttcaaaaggaaactgcccattgtaccactgacttgttgataaaagagaaacaatctgaagcagatgtgatccctatgcctcatgaaatacttgataatcattctagtgagacttccaatgagcttgcacaatttgcagaggcaaacaatagaaatgatttcttaagaagatttagtgttgagaacaggtctattgtttcccatttattccatcagtgggccaaaaagaaagcatttcaagatccaaagagattgcttgacaaggttagttttgtaattgatgaacgcctcagacagaagagaaacaaaaacaaggatttgttgaatacattaaaatcttgtttaagctgtgatgaagcatttcagtatgctcaatatgttttgagatgggagcagattcctgctgataaacgtgctcatcttatgagagaaaaacaggaacatttcctgaaattaaagattgagaatgcaatgggttcggcaacaccaactgacaagcagatttcatatttgaaaaaactgggttgcaccgcaatccctacctcccgcctccatgcatctcatcttattgagcaattcaaatcattgtaagaatcctaa

SEQ ID NO: 538 - DNA, 2173 bp, Solanum lycopersicum
tgctatcgagggcaatagatgattcgaatatttaggttgttaggtttttgaacaatttgttttggttgtatttgctaaagttgaagtggaagaagatggctgcgaaggttgctgctgcgggtatggtacatcaatcagatgcacttaattttggtggtggtagttctaaggtcactactaccacattgaaacgaaaaactccatcggagttgcggggagaacaattgaagaaaaagaatattgtggagcttgtggatgaatcaacagtccctaatggtggcccaatgagtggtcttttcccagggcccaagagatgcgatgtatcgaagaaccctagatatgttgatactcgtgtggacgagctatttcctgccagaaaaagtagcatcaggcttaaattggtttcaataaaagaaaatggcaaggaaaattttcaagcagagaatagtgataacactaaaaattgttctattccttcagctttccctactgagaatcaacagcgatctaaatgcccaaaattctctcttgcttcaagtgtaactggaaaagatcatgctactgaaacttgtagcacaagcgaaaggtgcagtgagaatactttccgcagtgtcactgagctgtcactgggtagtgtagatgtacatggcttgtctactgttgatatggataaagccttaagaggactggctactcatgagcatctaggtgctgctgctaaaattgctgaatcctttgaaactgatggtggtattaggtcaaaaaatttctgcccagaattccatgtcccatgcaagatgaccccattggatttgacgatgaaaactaacatacgagttgtatcctcatcttccattaattggtttcataggttgatcaattgtggcgctaacaatgtggtggcgaggtcctcagttaattgtttcacgaaactaaagatgaccagtttatctgaagtgacttctgtttcccaagcgattaatccaatgtcattgcattcctggatgtatcctcagtctcctctaccgccttcagttatatcagctttaaccttgtctgcttcagtgggagggcaactggactttttaagtgaaaggcagctagcatggcaggattcgtttcgaagtttatattacatgcttcggaagaatgtttgcagcatcttctacgtttgcactgctcagtttgtgatcatgttcaccagttcttattcagaggagaacaaatatgtttgtaatgcatatatttctcagtcaacccggggtttgaggtcattactcaaagaacatgatgtttcttattctatgccgctttgccactcaaagttggaggagcttaatacggaagaattggttgagctttcagagattgagaaacaaaatctgggccagactaggcgtcgaagtgcaatgtgcgatgtggataataggccagattctttgctggcattcactggaaataagaatgttcattctttatatgactttctgttgaactatcgatatttcttgacttctctaactggtgtggatgtccctgaattgtattcacctatcccatttgagaatgctgcactcactgctcctgaggtcaaatgcaaggaggtcaggagaattgatcaggcagcttttcaaggaatggagtcaaatgtgacttgtgagcctaatcaacaaccatcttctgggatgtgctatagtgttgaaattaagggccgataccttgccccatgggtaacctctgctatatgtgatgctttctgctctaacagcacaagttttgaggctagttttatcacagagccagcttcagttaacttgaatgccagtctcggcattactgggaaacgttctgatcctcaagtttcagcaaccgaagccatggacaaggataacctttgtttcggtatcccaaataccaaatcttgttcccagatgaattcaggtttcttaaaggggttgaagtacaatggtggttcttacactgcttttctttcaccggtttgacaccccctcgtctgcaacacattctgggtaaattataaactatcatctgttttttgctgcaatacatctttaccgttgtaaaaactgttcgtgtttcaacgaccttatgtcaaattccagttgtaaaattgttcagtaatcgttcgaccattatagctgtgcaggatttg

SEQ ID NO: 539 - DNA, 2976 bp, Solanum lycopersicum
tgacttgctgattggtggttagagggagttcttttttttttttttggaaagatggggtctttggttttggttttggggttgatgtaaagggaatcacagaggtttttatgggttctgttgaagagaagaacaagccagggagtttggttagtggagcacatactctacttgaggaaatgaaattgttgaaggaaatgcaggatcatactgggggaggaagaaagctaattagttctgagttgtggcatgcttgtgctggcccacttgtaactttgcctcaggttggaagccttgtgtattacttcccacaggggcacagtgaacaggtggcggtttccacgaatagaacagcaacttcacagatacctaattatccaaatcttgcttctcagttgttgtgccaagttcacaatgttaccctgcatgcagataaggagacagatgagatctatgcgcaaatgagcctccaacctgtgaattctgagaaagatgtcttccccattccagattttgggctgaagcctaataagcatccaactgagttcttttgcaaaacgttgactgccagtgatacaagcacacatggaggattctctgttcctagaagagcagcagaaaagctgttcccgcccttggattattcaatgcaacctccaacgcaagagcttgttgtacgagacttgcatgataatacttggacattccgtcacatataccgcgggcagccaaagcgacatcttctcacaactggatggagcatgtttgttggagcaaaacgccttagagctggtgactctgttctatttatcagggatgagaaatcacagttgttgcttggagtcaggcgcgctaaccgtcagcaaacttcattgccctcttcagttctgtctgctgatagtatgcatattggagtacttgctgctgctgctcatgctgctgctaatagaagcacattcacaatattctacaatcctagggcatgcccttcagagtttgtcattcctttggccaaatatagaaaatctatttataacacacaactgtctgttggtatgagatttggaatgatgtttgaaactgaggaatcgggtaaacgcagatatatgggcactattagcggaattagtgatttggatccactgagatggcctagttccaagtggcggtgtcttcaggtagagtgggatgagcctggatgtggagacaagcagaatagagttagtccatgggaagttgagacaccagaaagtctcttcatatttccttccctgactgcaggcctcaaacgaccttaccagtctacctttttgggagcacaaactgagtgggacagtttgatgcagcaccgccctttcatgcgtgttcctgaaaatgtatatggggatcttcagagctcctctatctcaaacctatggtcagaacagctaatgaagatgctgataagacctcctcctggccttactggtcttcaatgcggtgttcccacagtacaagacattaaggttgcactacctcaggaagctaggaatgtagtacagccagcaggaaaccaaaaacctgagctaataactgtagaagctacacctgcacaaagtgaaacaaattcggaagttgtccttaatcaacctgttggtgttgtgaactctatttcttcacagcaagcaactctgcaggcgaagtctaaacctccggaaaaagtagaaactgacattattggaaaaaattccgagccaagaaaagaaactagtaattcatcagttaagttagatcagtttcagtgtaatgaagacaaagtggctatcaagcctgcaagtccccatgatcttccaactgatgcgagtgtgacagcttcccaccataacagcttttctcaattacaagctagtccatggctcattcctcataaccctcaaattgattctgctgcttccaacaatatccttcaatgcccaactaataatgagtggaatatgtcctctctccaatctgctgctggattgctcaaatatcctgtgtcgacctccactttgacaaagcatgataattcttttatgttgcctgatacaattggtcatggattagctccaataggccaggatttgtgggatcatcagttgaatgatgttaagtgcttttcccagacaaaccttcaggttccactagacataactaacatgcagttcctacctgattcttatggttttaaggacctgtcagaggagagccataaccaaagtgatatatatagctgtcttaactttgatagtaacagcgggagcacagtgattgataattctgtttcgagcacagtgttagatgagttctgcaatttgaagcatactgatttccagaatccttcagattttctattaggcaacatcagttctagtcaagatgttcaatctcaaattacatcagccagtctggcagattctcagaatttctctgtacaagaatttgctgacaactcgggtggtgcatcatcaagcaatgtaaattttgatgaatgcaatcttttgcagaatagctcatggcagcaagttgctccacgtgtgcggacatatacaaagattcaaaagacaggatctgtaggaagatcaattgatgtctctggtttcaaaaattatgaagagctgcggtctgaaattgaaagaatgtttggacttgaggggcttctgaatgacactcgaggctcgagctggaagttggtatatgtggattttgagaatgatgtcctccttgttggggatgatccttgggaggaatttgttggatgtgttcgatgcatcagaattttatcgcctactgaagtccagcaaatgggagaggaaggaatgcagctactgaactctgctggactgcaaagcatcaatggatcaacatcagaattcccaaactaagctcaatacaagtgatctatgagagctcacagtgattgatcactagagttgcatggagcaacatgcaaatgtaatg

SEQ ID NO: 540 - DNA, 1755 bp, Solanum lycopersicum
gaaattccatggcgctgtatctgttgtatgagtcggcgtctgggtacggtttgtttttggctcacgggattgatgagatagggcagaacacggaggcggtccggaactcaatcgatgacctcaatcgctttgggaaagttgtaaagattgaagcttttaacccttttgagtccgctcttgatgccctaaatcaatgcaatgctgtttctgaaggtcaaatgactgaggagctacagaactttttggagcgtagtctcccaaaagtcaaggagggtaagaaagctaagttcagcttaggattggcagagcctaagcttgggtcacatatccatgaagttactaagattccttgccaaagtaacgagtttgttcttgagattttgcgtggagtacgattgcattttgagaaatttgttaaaaaccttaagcctggtgattcggagaaagcccaacttggtctgagtcatagttacagcagagcaaaggtcaagttcaatgtcaaccgtgttgacaatatggtcactcaggcaatagtcctacttgacactcttgataaagatataaatacctttgccatgagagtcagagagtggtactcttggcatttccccgagttggtcaagattgtcaatgacaactatctatatgccaaggttgcaaaatttgttgatgacaaatctcaattgtctgaagacaaaatttcagcattaactgaaatagtcggagatgaagataaagcaaaagaaatcgtagaagctgcaaaagcttccatgggccaggatttgtcaccagttgacttgattaatgtcaagctatttgcacagagggtaatggaccttgttgaatacaggaaaaatctttatgattatcttgtcgccaaaatgcacgacatagcaccaaatttggctgctctgattggtgaagttgtgggtgctcgtttaatttctcatgctggtagtctcacaaatttggcgaagtgcccttcttctacccttcagatcctgggtgctgagaaggcactcttcagggccttgaaaaccaaaggaaatacaccaaaatatggactcatattccattcttctttcattggccgtgcctctgctcgtaataaaggtcgaatggctcgttatcttgcaaacaagtgttctattgcttctcgtctcgactgtttcttagataagagtactactacttttggagagaaactccgtgaacaagttgaggagcgtctagacttctatgacaagggggttgcaccacgaaaaaacctagatgtgatgaaagctgctattgaaaccgtcgaagataaagacacagaaatggacgtggatgagccttccacgaagaaaagcaagaaaaagaaatccaaagttgatgtggtggaatatgctcaacccatgatcgaggataaaccacttgaaacaaatggtgatgcctctgaagaacccaagtctgaaaagaaaaagaagaagaaagagaagcggaaatcagaagaggaggcagagcatgaagaggatcagactgttggtaatggtaatggcgtgcatgaggatggaacagcaaagaagaagaagaaaaagaagaacaaagaggacaatggagaggaactccaagctgctgttgaaattaaaaagaagaaaaagaagtccaaagttcaagatgatgaataaatgtacaattttttctaatcttggtcttgttattttgacggtttttggtcacctcttatagttgcctgtatgctcctaggttaga

SEQ ID NO: 541 - DNA, 3125 bp, Solanum lycopersicum
gatcacaaacatgtcagatatcaggaaatggttcatgaagcagcatgacaaaggcacgggtaatgggagcatgtccaagaatagtgcagcagaaaagccttctcccactagtccaaagccagaaaacctggtacaagaaggacaagagactgccaacagaaggaaaactagtaaatattttgctacagacaaggttaaggcaaaggaagaaaaagttgaggaagtgtcagcaaaaagaaaagctccaaatgctgctggaatttcatcagcaccagctgcaaaaagaattcataaagctgaggatgaagatgactttgtaccagtggtatcggcaatgggatccagagatgtcactcccagcaaaaagtcggtaagtggctctggaaggggatccgcgcagaaaaatgtgatcagtgatgatagtgatgatgatcttaagaacaaaaattctgatctcaaatctgctggaagagggcggggtggacgggcagctaagaccagcggaaagggtgttcctcttgatgaaagtgaagatgatgcttcagctgtcaaggacaacaaatctggtggacgagggcgtggtggtaaaggaccatctgcagcaccaagcggtggacgaggtagaggtggtggaggacggggaggtttcatgaactttggtgaaagaaaagatcctcctcacaagggggaaaaggaagttcctgaaggtgccccagactgtttagctggtttgacttttgtaattagtggaactctcgacagtttagaaagagaagaagctgaggatttgattaaacgccatggtggtcgtgtcacaggatctgttagcaagaaaacaacttatcttttatgtgatgaagacgtcgagggacggaaatcctctaaagccaaggagctcggaactgcatttctcactgaggatggtttgtttgaattgatccggtcatcaaaaaaatcaaaatcagctacacaacccgagtcaaagaaatctgtggacaccattgtttcttctggaaagagaaattcacaaaaaacaagtgatggaacaggaagcactgccacaaagattctagctgccaaacaattggcacctagtgcatctcctgccaaaattagtggatctcctgctaaaagtagtgcatctcctgccaagaagaaaacccaagctaaagagtctttactaccatggacagaaaaatacagacccaaagctattgtagacataatagggaacaagtcactggtggagcagattcagcgttggctagagagctgggatgagcattttctaaaggcatctagtaagggtaaggggaaaaaacaggctgactctggtgctaaaaaagcagttctgttgagtggtatgccgggtatagggaagactacatcagcaaaagtggttagtcagttgctgggatttcaaacgatcgaggtaaatgctagtgatagtcgtggaaaggctgactcaaaaattgagaaaggaataggcggaagtactgctaattccataaaagaacttgttagcaatgaatctctaagcgccaatgttggcagatcacaccatcagaagactgttctgattatggacgaggttgatggcatgtctgctggagatagaggtggtgttgccgatcttattgctagcatcaagatctcgaaaattcctattatctgcatttgcaatgatcgctacagtcagaaattgaagagccttgtcaattattgcctaccaattgtcttccgtaaaccaactaagcagcagatggcaaagaggttaaatcaagtagcaaatgctgaaggcattcaagtcaatgagattgctcttgaggaattggcagaacgtgttggaggagatatgcgtatggctctaaatcaattgcaatacatgagtctctctaagtctgtcatccaatacgatgacataagacgccgtcttctaagcagttcaaaggatgaagatatctcaccgttcaaagctgtagaaaagctgtttgattttaattccaagaacttgaaaatagatcaaagaattgacctaagtatgagcgacccagatcttgtcccacttcttgtccaggagaattatctcaactacaaaccaagttctgctggcaaagatgataatgatttaaagcggatgagcctaattgcgcatgctgctgactctattgcaaacagtgacttaataaatgtacagattcgaagataccagcaatggcaactttctccagctggttgcctttcgtcttgcataattcctgcttctttgttgcacggacagaggcagactcttgagcagggagagcgcaactttaacaggtttggcggctggctaggaaagaattctacaatgggaaagaattaccggattctggaggaattgcatgtccacctactcgcatctcgtgaatcttatctgggaagggcaaacctgagacttgactacttttctcttcttggaaagaagttgacagatccattaaaagtgctgcctaaggatgaagctgtagagaatgttgtggctttcatggattcttactctataagccaggaggacttcgataatattgtggagatatcaaaattcaagggacaaccgaatcttctggatggtgtacagcctgctgtgaaagcggcactgacaaaggcatacaacaaaggaagcaaatcacgtgttattcgcacagcagatttaattacccttcctggaattaaaaaagctcctaagaagcgcgttgcagcaatgctggagccactagatgaaggtgtagctgaagaaaatgatgaaacacttgctgaagatgaagagaattcatcagatacagaagacatagatgttgggaaaaaattgcagtcggatcttcagagtctcagttcgagagggatcgaagtaaacatggacttgaagggtgccgggagttcaggtagcaagaagacgtctgcagggagaggacgaggacgaggaagttctaatagcagtgcaaccgctgaatcctcaggtaagagaggtggtcggggttctggagctgctgccaagagaaagaggtgaaactggaaaacatctccctgacctaattctgtcggttacaatcatcggaagctgcagtttccctggtcttcttcct

SEQ ID NO: 542 - DNA, 3092 bp, Solanum lycopersicum
ctcagtcaagtacacctaatagaagcataggttcaccctgtgttcaacgattgaagatgtcgaataaggagaaaggtgtaaacgttcaggttttgcttcgttgcaggccgtttagtaatgatgagttgcggagtaatgctccgcaagtggtaacttgcaatgagtttcagagagaggttgctgtttcacagaacattgctggaaaacacatagatagaatttttactttcgataaggtttttggcccctctgcacaacaaagggacctctatgatcaagcaattatccccattgtcaatgaagttttagaggggttcaattgtacgatttttgcttatggacaaactggtaccgggaagacatacactatggaaggtgaatgcaagaggtccaagagtgggcctaacggagagcttccacaaggagcaggtgttatacctagagccgtcaagcaaatttttgatacattagagagtcaaaatgcagaatacagtgtgaaagttacattcttagagttgtataatgaagaaatcactgacttgttagcccctgaggatttgtgtaaagtcgctttagaagacagacagaagaaacaattgccactcatggaagatgggaaaggtggagttctagttagagggcttgaagaagaaattgtgacaagtgccaatgagatattcaccttaattgaaaggggttcatcaaaacgccggactgcagaaaccttgctcaataagcaatcaagtcggtcacattctcttttttccatcacaatacacatcaaggaagcaacccccgaaggcgaagaactaataaaatgtggcaagttgaatttagttgatttggctggttcagagaatatttctcgctctggggctagggagggtcgtgcaagggaagctggagaaataaacaaaagtctactcacacttggacgagtgattaatgcccttgttgagcatcttgggcatattccttacagggatagcaaacttacacgtttgctacgtgattcattgggaggaagaaccaaaacatgtatcattgccacagtgtcacctgctgtgcactgtcttgaggagactctgagcacactagactatgcccacagagcaaaaaacataaggaataagcctgaggtgaatcaaaaaatgatgaaatcgaccctcatcaaggatttgtatggagaaattgagcggcttaaaggagaggtgtatgctgctcgtgagaagaatggtgtttatataccaaaagaacgatattatcaggaggagagcgagagaaaagcaatgtcagatcaaattgaacaaatgggcgttagcatagaaaaccaacagaagcaactcgaggagttacaaagtagacatgattgtcaggttcaacagtgctcagatttgacttgtaaacttgatgcaacacagaaacaattgaatcaaacaagcaaattgctagcctacactgaggaacagctgagacaaaatctatacactctcaaggagcgggattttatcatctctgaacaaaaaaaagctgaaaatgccctggctcaccaagcatgtgttttacgggctgacttagagaaatcaattcaagagaatgcttccttgtttcaaaaaattgctagagaggataaactgagtactgataaccggtcagtggtagacaactatcaaactgagcttgcaaagcaacttggtagtctttccagcactgtggcaacatctgtgtctcgacaaaacgaacacctccaccacgtcgagaaaatctgtcataattttcttgcatcacacgagaaggctgccttagacttgacgaataaaattaattcttcaaaggccttgtacatatctcactttgaggctatgcaaaatgtagtgaagctgcataaagccacttctaatgctgctctggaggaaatttcgactttggcttcttctaattcaatttccactaaagaatttttagatgcagagtctgttgaaacaaatttaatttttgatgaacttcagaacactctgtcaacccaccaaggagaaatggcaaattttgctagagagcttcgtcagagatttaatgacagtacagagcatttgacaaatatctctgagatcatacaaggattttttgacaaacttttagaagaatcaaaaagacttgaaagacattcaacaacagctgatgagattcaaacgaagtctattgctgaatttgagaaggcatatgaggagcaatcaagatcagatgcagaaaagcttattgctgaggtgacttccttggtctcgaatcacatgcgtcgccaaaaagaactggttggtgcaaggcttggtgatcttagagaaactgtttctggaaataagacattcttggatgggcatgtatcctctatggaaggtattacaacagatacaaaaagaaaatggcaggacttttatacgcaagcagaaggtgagaccaaagaaaatgctgatttctcagctgctaaacattgccgaatggagttactcatgcagaagtgtgtaagcacaagtgaaacaactgtgaaacggtggcaaagtactcatgaattggcaaaagacatgtgcaatcaacatgtttcaacaatgcattcagttgtcaggaacctatgcgatagcaatgagcaacatgttattgaattcgattccacaagggaagctgctgaagaagctgtgaaaaggaatagtgaagatatcattaaatctattgacggcttgtcaggggaagagagaggatctatatctggcattctggatactgccagtgcacactcggagaccctagatgaacttaagaaagatcattgcacacagtctacctccattgaacagaaggccattgaaacatttcagcagaagtttatggattatgagccaactggaacaacaccaattaggtctgaaccagatgtaccaagcaagggaacaattgagtcgttgcgagccatgccaatggagactctactagaggaatttcgagagaacaattcattggagtccttccaagtaaaggaactaaagccatcacttataccacgatctcctctctcactgattaacaattagcagattggttga

SEQ ID NO: 543 - DNA, 938 bp, Solanum lycopersicum
gaagcaaatcgccattgaaacgccagaatgggaagacttggagtgaaaactgactatgaagaactccgaaacgctcaaatcatggaaaacaaggcgcgattagccagtcttggacttcaaaaggctgtggcagagctccgatcgatcagatctaaaccacaatctgagaagagaaaacacaacaaagttgactacttctcaacccctttgcgccgatctagtcgattgaaaggaaactcttctgaatcgaattcaagcggcactacgccgctagcgaaaaggaaattggggctttttgatgatgaagatgatgaagatgatattgagaagagaccagctaatgcacctctgttgagagtgaaagatggcttaacgctgcgtcttactccagaagctttagctcggcgttgcacaagcaaggacaggggaacgttatatgacccttatttgggtatttgctgtcacttttgcaggcaaaagaaattatgtggtgaggaagactgtaagcgatgtggtgattcagacatggatcaaccttgcataggcaagacagattgttcaagttgtcattctagccaaggtgttctttgccgaggctgtcttaaggttcgatatggtgaagaaatggaggatgtgagagcaaacaaagaatggatatgtcctcattgtactgaagaaaaaggcatcaatccatattggatatgtaatagctcattgtgcctaaagaagcgaaagatggctccaacggggatcgccatattcagagctagagagatgggatacaaatcagtggcacatctgttaatggatcagcttcagggagcagtgaggggttgatgataaacaaaatttagtgcattgttaacttcttgttggtgaagtaaaattagcttcagaatgtaaaaatgaatgttatgaagaccaatcactggttgtgt

SEQ ID NO: 544 - DNA, 695 bp, Phaseolus vulgaris
caccaacacaatcctgtactccataggcagttaagaggagttattatagggttcagggaaacatgttgaaacaagcaattggcagaatttgcagaaccagtgcttatgcttttgaaggaaacagagttttgccttggattcgtgtggcttcgtgctttttccacaatggacagacgcacatggcacctagaagcttttttggggtagaggatttccttgatgatgacaatagcagaccttacacataccaaaaagggaagaagtcaaagaatccacacaagcacatatctttcaaacaaagaacgattgcctacatggagccgtttacacttgatgtgtttatctcaaaacgctttgtatcagcttcactcactcacagaatgacaagcaaacaggttgcagttgctggtaccaactccaaggacataaaagctgttctcaggtctcgttcagacataccagcatgcatatccatcggtaagattttatctgaaagagcaagagaagctgatgtttacactgcttcctatactccaagggaaagggacaagtttgaagggaaaatcagagctgtagttcaatcgcttattgataatgggattgatgtcaaggtttatctggactgagttgagtcactcaagattttgtggctatcactttaatatcaattggtgattactggtttggtctcgtgg

SEQ ID NO: 545 - DNA, 4207 bp, Phaseolus vulgaris
ttgaaatctgcgacgaataaccctagaaagatgaaccagtaccacatctacgaagccatcggtcgcggcagatactccaccgtttacaaaggcaggaagaagaagactatcgagtatttcgccatcaagagtgtcgataaatcgcagaaaactaaggttcttgaagaggtcaggattcttcacacgttggatcatataaatgtgctgaagtttcatgattggtacgaaacttctgctcacctatggttggttttggagtactgcgtcggaggggatctgctttccatattacgacaggatagtaaacttcccgaagactctgttcacgatcttgcgtatgatctagtgaaagctttgcagtttttacattcaaatggaataatttattgcgacctgaaaccatcaaatattctacttgatgaaaatggatgcgcaaagctatgtgattttggattggctaggaagttgaaagatatatcaaaatctccttcttcctcgttaccacgggcaaaacgtggaacaccctcttacatggctccggagctttttgaagatggtggagttcattcttatgcttctgacttctgggcactaggctgtgtactatatgaatgttatgctgggcggccaccctttgtgggaagagaattcactcagcttgtaaaatccatcatctcagatccgactccacctctccctggtaatccaagtcgaccttttgttaatttaattaattccctgttggtaaagaatccagctgaaagaatacagtggcctgagctttgtggacatgccttttggacgaccaaacttgctctggtgtctctgccttctcaacctgcatttgatgatatgatagagctacatactaaaccttgcttgtcagaacgaaatggagataaatcttctcataaccggacacctcccaaatatcgtgaaaaagatgtcaaaggggtgttgaagaaggacgagaactctgttttaggatctagaggcactgagacaccaacaagggcaacaccaaatggccctagaactcagataaaaggatcaagcagaacaaatgaggtaaagcagaaagaccattccaatgttaagaagggtgtgaatctattgagattgtcaagaatagcgaaaacaaatttacagagggaaaatgagaaagaaaactatcgacgccccttgcctaataattctgagaatgattctgaagttaaaattgagaacactgacatggaacttgattttaatgagaatactgaagatgatacacatgaagaaactgatggcaatgaacaaacaacttctgtgcccgatgagaagatagataatcattttctgaatcagggacaaacagaggagcttgaaaataatacacaccagttggataccccatctgctgttaaccctccagtctcagatgatccaaggtcatttgatcatgaatcaactcctgaccatcctgacatatctggtatttctcccagtgtgagccctcaggtgaaaaagcatagagctaaagaagacacaggatctggccttgactctgattcttcaaggttgtctaacaacctttccgaggttctttggcatccatctgatctctcagtcagacctgtaatgcctagcagaaaagttgataaagtctcagaagtcattccttcactcccttttgaggcattgcaagcgtctgattttgttaagatgcctaaagagcaattggaggcagtccacaaccgaatattaaccattttgaatggaaataccagcattggagagaaacaaaatgtgattaggtatcttgagatgttgagcattaatgctgatgcagctaatatcttgaccaatgggccaattatgctcatgcttgtaaaattgcttcggcaatccaaggcatcagctttgcgtgttcaacttgcttcactgattggtctgttgattaggcactccacttttgttgatgacagtttagctaattctggaattttaggtgcactgactgatggccttagagacaggcaggaaaaagtaaggaggttttccatggccgctttgggtgagttgctattttatatatccactcaaaatgcagactgcagggacaacaatcaacttgaatctccatcaaaggacaacagggcaacatatggctggcaggttccaaattcgttaatttcacttgtgtcatcaatgttgaggaagggcgaggatgatataactcaattgtatgcattgagaacaatagagaatatttgcagtcaaggagggttctgggtggggcgattgaccagtcaagatgtttttagtaatctctgttatatctatagggcggcagggaaacaagagagtatgaggctcactgcaggatcatgcttggtgcgccttgttcgttttaatcctactagcattcagtctgttgttgagaaactctcattcaaggacctagcttctgctcttgtaaagggcagtccacgagagcagcaaatcagcttaaatcttcttaacatagcaatgcttggaagtcacttgttcacaaatattggaagataccttgtacaacttgccgaggataaaaatctgatcccaagtcttttgtctcttgttgagcaaggtagtgaagttttaagaggaaaggcactagtttttgtggctctcctctgtaagcatggcaggaggtggcttccacacttcttttgtagtcaaaagttgctttctgtggtggatagactgggaaaagagaaagattcctatgtgagacagtgtttggatgcatttgtgcatattgtggcatccagtattccaggtttattggatataataacaggggaggtccagcaaatgatgggaggaaggcgccatggacacatctctgcccttaccagcagatcttcaaaagccaacattcatttgtttcctgttgtccttcatcttcttggaacttcaacttttaagcacaaagtcgtgacaccacaagtcgtacttcaattggcgaatctaattaaactcgtcgagacaccatttcagggaagagatgacttccaaataacccttcttcgaattttcgagtctctcacagaggaatctcctataattcttggcaatgctgacattttcatacgtgaaatcctccctagtttgacagttctctacaagggtaacaaggatggtgacgccaggtttttgtgccttaaaattctttttgatgtgatgatcattcttttgagtgaaccaattgacgaagagcaacgattaaaggatctgaaattcatatcaaatacccgttttcttcctctctacccaaccttgattgaagatgaagatcctattcctatttatgcccagaagcttcttgttatgctgctggagttcagttttattgcaattccagacattctacacatgaagacaatttcacaatgctttgagttcttgcttggtgatctctcgaatgcaaatgtgaataatgttaagctgtgtcttgctctagcttctgctcctgatatggagtccaaattactctctcatttaaaggtggttaggaggattggcaacttacttgagtttgtacacgcaaagggcatggaagatttgctggaaccaactcttgggttgtgtagggcttttatagcacgttcagtctgtacaaaaggcttgagcagcacaacagaaccaactctcttaggtgactgtcctcccgagttgagtggtggtgctgtggatccccagcaatgcataaaagatatcgctgactttggaagcaattttggtgtcttgctagagttgagtgcctctgcagaaaccagtattgctgatatagcttctgaatgtgttgttttactgttcaaggcttctcctagagaagccaccactggtatactaaccaatcttcccaaggtcactgtgatcctagagagctggaatagaggcattcctcacttgatggtgcagcgaatgcttcattctctaggttatgcttgcaagcaatacttactgcatgcaatgatattgtcaatatctaaaccggagatttcaagaattgaagttgttgtttctgaactcaaaagttcaggtgtaccagccttagctaaaactgctgcgctagcagccttggaattgcagcggttgcctcgctgcatttgaataattgcggccttgctaaattccagataaagttgagcgtgaattccactcaggctccactgtattt

SEQ ID NO: 546 - DNA, 3109 bp, Phaseolus vulgaris
cacaactgacaccatcttctccacaacaacctcgccggaaaattcatcgccgtttccggtcaccggcgatggcctctgcgacgtcgtttccgggtatttctcttcgtccctcagttccatttcgcagccacataagccacactcgattcgcacagtttcaagtctcctttggctttcccgcgaacccaacttcgttgaagagtttgaattcggtgccgtcgaagaaaagagaagctttctcaaatgggtcttcgagaacccgaagaaacctatcgcagttctctgttcgctgcacagtgtcatcaagtggaaaaattacacaacaggaattcacagaaatggcatggcaagctattgtctctgcaccagaagtggctaaagagaacaagcatcagattgtggagactgagcacttgatgaaagctttgttagagcaaaagaacggacttgctcgccggatcttttctaaggttggggttgataatactcggcttctagaggccactgataagcacattaagcggcaacccaaggttctaggggaatcagctggtacaatgttggggcgtgatttggaggcattggttcagagagctagggacttcaagaaagaatatggggactcatttgtgtcagttgagcactttgttcttggtttttcccaagataaacgatttgggaagatattgttcagagattttcaaatatctgagcaagctcttaaatctgccatagagtccataaggggacgccagtcagttattgaccaagatcctgaaggaaagtatgaagcattggaaaagtatgggaaagatttgacagcaatggctaaagcaggaaaacttgacccagtcataggaagagatgctgaaatacgcaggtgcattcaaattctctccaggagaacaaagaataatcctgtactaattggagagcctggtgttggaaaaacagcaatctcagaaggacttgctcaaagaattgttcaaggagatgttcctcaagctttgatgaatcgaaggctcatatcccttgatatgggtgcacttattgctggagcaaagtaccggggagaatttgaagatagactgaaagctgttctcaaagaagtaacagaatctgatggtcagactatccttttcattgatgaaatccatacagttgttggggcaggtgctacaaatggtgctatggatgctggtaatctcttaaagcctatgcttggtcggggggagctgcgatgtattggtgcaacaacattagatgagtatcgaaagtatattgagaaggaccctgcacttgagcgtcgtttccagcaagtttttgttgaccaaccatcagttgaagataccatttcaatactgagggggctgcgggaaagatacgagctgcatcatggagttcgcatttctgacagtgcacttgtagatgctgcaattctctctgatagatacataagtgggaggtttctgcctgataaagctattgatctggtggatgaagcagctgctaaactaaaaatggaaattacttcaaaacctactgcacttgatgagattaatcggtcagtcttgaaactcgagatggagagactctctctcgtgaatgatactggcaaggattctaaagatagattaaatcgacttgagacagaactctctctcttaaaggagaaacaggatgaaatgactgggcaatgggagcatgaaaagtctgtcatgactcgtctgcaatctattaaagaggagatagacagggtaaatcttgagattcaacaggctgagcgagagtatgatcttaatcgcgcagctgaattaaagtatgggagtctaaactccttgcaacgacaacttgaaagtgtagaaaaggagttacacgaatatatgaactctggtaagtctatgttgagagaagaagttacgggaaacgatattgctgacattgtaagcaagtggactggtattccaatttcaaaacttcaacaatcagagcgagagaagctgttgtacttagaggaagagcttcataagcgtgttgttggacaagatcctgcggttaaggcagtagctgaggctatccaacgttcaagagcaggcctttcagatccccatcgaccgattgctagcttcatgtttatgggaccgactggtgtaggaaagactgagctagccaaggcccttgcttcgtatttgttcaacacagaagatgcacttgtacgaattgacatgagtgagtacatggaaaagcacacagtctcgagattgattggggctccacctggatatgttgggtatgaagagggagggcaactaacagagacagttcgccgcagaccttatgctgtcattttgtttgatgagattgagaaggcacactcagatgttttcaatgtattccttcaaatcctggatgatggaagagtaactgattcacagggcaggacagtaagttttaccaacacggttatcattatgacctcaaatgttggatcacagtacattctcaacactgataatgacactgtgcccaaagagtcagcatacgaaaccataaagcagagggttatggacgcagcaagatcaatctttcgccctgagttcatgaatagagttgatgagtatattgttttccagcctctggaccgcgaccaaatcagtagtattgtcaggttacagttggagagggtgcaaaagagaattgcagatcgcaagatgaaaatccaagtgacagaagctgcaatccaactccttggaagtttggggtatgatccaaactatggcgctaggccggtgaagcgagtgattcagcagaatgttgagaatgaacttgccaagggcattctaagaggagagttgaaggaagaagacacaattttagtggacacagaagtcacagcattttccaatggtcaacttccccagcaaaagctagtttttaggagggttggaactgattcagaatccagttctactgttaaagacagccgggaaggctttccacagattctgtgaatgctctttgttactccacatgcaaggtttcacaacaaatttcagtataggtctctttcttacacttctgcaacttcgatgatcctgttcataccatg

SEQ ID NO: 547 - DNA, 1172 bp, Zea mays
ctcacatggcggcggcggaagagatgatggcggtgctggacaaggagacgctggcgctgatgggtctgggcaacgccgccgccgcggtggttgccgagtgcgagaagttcaaggagaacgcgaggccgctcaagcgcgggcgcgacgtgtccaaactcaaccacgcgctcaaggcacacgccgatcccgcccagcgcgccactcttctcgaagcccgaaagaagctgattgaggcaatctacgagtaccaaggcgaggatccgctccaaccgtggctggactgcatcaagtgggtgcaggagtattttccgaccggcggcgagtgctcagggttggtggtgttgtacgagcagtgcgtgcggaccttattggacgacgagcgctacaaggacgacctccgcttcctcaaagtgtggctggaatacgcggggaactgtgctgatgctgaggtaatatacaggttcctggaggccaaccagattgggcagggccatgcgatctactacatgtcttacgcatcgttgctggagtcaaagaacaagttgaggaaagctaatgagatctttgaccttggtatagctagaaaagcgaagcctctggagaagttggaagctgtatacagggcatttcttcgaagatcaatcaaaaagagggaacaagaggatgatacagtagatgatgatctgccaaaacgcagtttcgggaataacttgaaacgagatgaaaacagaaatcagcaagcagggaactcccacctggggagaccaagggcactgcagaggccgctttcagtttacaaagatgaaagtccattaccaaatcagggccttgacagagtgaggagcaaagaaaataacacaagttggcgcgtcctcggaacacgagcagaacggaacaaggaaaataacatgatgcctgctaaatggacgtctcacaagattccacagaagttaggagcaagaggagcggttcaatcaacccgagccagttgttccattgaagtcttcgtcgaggaagactgcacacaggaacctgctcggccggtgccaaagagcccaaatccttctgttctgaagctcaggcaaacaacaagcaaaagccttaagaaggagactgaattgctcaaggagaacccgctgcgcaacttccccctgagcaggcttaggtaatag

SEQ ID NO: 548 - DNA, 275 bp, Medicago truncatula
ctgccatggcgagcaccaaagttcagagggttatgacccaacccattaacttgatcttcagatttcttcaaagcaaagcgcggattcagatttggctttttgagcagaaggatttgagaattgaaggaagaatcattggttttgacgagtacatgaatttggttttggacgatgctgaagaagtaaacgtcaagaagaagagcaaaaaaacattagggaggatccttcttaaaggagacaacataactttgatgatgaacacgggtaaatgatga

SEQ ID NO: 549 - DNA, 374 bp, Medicago truncatula
caacaatggtcaaggttcatgagttgaggcagaaaaacaaaactgatctgttggctcagctcaaagatctcaaagctgaactttctttgctccgagttgctaaggtcactggtggtgcacccaacaagctctccaaaattaaggtggtgaggttgtcgattgctcaggtgttgacagtgatttctcagaagcagaaggctgctttgagggaagtatacaagaacaagaagtatttgccacttgatcttcgcccaaagaagaccagggccattcgcagaaggctcaccaagcaccagtcttcgttgaagaccgagagggagaagaaaaaggagacatatttcccaatgaggaaatatgctatcaaggcataataa

SEQ ID NO: 550 - DNA, 893 bp, Medicago truncatula
caacaatggcacttagacctattgacaacgctcttccaacaataacccaagaaagacccaaaaaacaacctaaaatcgctctctcaacccaaaaaccacaacattcttccaacgatgaaaatcaaatcccattggaacccaccattgattatatttcatctgataaccttaaacccatgtcagatcctgaagctcagattcaaagtttgattgaagatttggactcaaaaaactgggtcaaggtttgcgagtcgttgaacgatgttaggcgatttgcattgttcaattcgtctcttctattacccattttggataaaattgtgttggtggtggtgaaggcaatgaagaatcctcgtagtgctttatgcaaaacctctattatggctgcttctgatattttcaatgcttttggtgataaattgtttgatccttccatttctgaggcatttgatggcttgctgttgcagctgctgctgaaatcttctcaggataaaaaatttgtgtgtgaagaagctgatagggcacttggatcaatggtggaatccatgacacctcttccattgcttcagaaactaaggttatctgtgagtcacaaaaaccttaggatcagggctaaagctgctgtttctctatccaaatgtgtctccaaaatgggaattgaggaaatggaggagtttgggatggaaaagttgattgaagttgcagctgatttagtgaatgatagactcccagaggcaagagatgcagcaagaagtattgcaacttcagtgtacgaggcaatcattaaggatgtggaagaggaacagaagatggaggtgtggcagagtttctgccactctaagctaacactaattaatgctctttcaattttgaagatagttaaactttagtag

SEQ ID NO: 551 - DNA, 1193 bp, Medicago truncatula
gcaccatgtcggatgatgaaagggaggagaaggagttggatctcacttcacctgatgttgtaaccaaatacaaaactgcagctgagatcgttaacaaggctctgaagttagttatttcggaatgtaaaccaaaggccaaggttgtcgacatttgcgagaaaggagattcatttattagagagcaaactagtaacgtgtacaagaatgtgaagaagaagatagagagaggtgttgctttcccgacctgtatttctgttaacaacacaatctgccatttctctcctctagccagtgatgagacagtgttggatgaaggcgatatagtcaaaattgatttggcttgtcatatagatgggttcattgctgctgtagctcacactcatgttcttcaggaaggtccggttactggacgggcagcagatgtcattgcggctgcaaacactgctgctgaggttgccttaaggcttgtaaggccaggaaagaagaacaaggatgtatctgatgcaattcaaaaggttgctgctgcctatgattgtaaaattgtggagggtgttctaagccaccaattgaagcagtttgtgattgacggtaacaaggttgtacttagtatctctaatccggatacaagggttgatgatgcagagtttgaggaaaatgaagtttatgcaattgatatagtgacaagtaccggagaaggcaagcctaagttattggatgagaagcagacaactatttataagagggctgttgacaagagttatcacttgaagatgaaagcatctcggttcattttcagtgaaataagccaaaaatttccaatcatgccattttctgctagggctttggaggagaaaagagctcgccttggtttagtggaatgtatgaatcatgagctattgcagccatatcctgttctgcatgaaaagcctggtgattttgttgcacacatcaaattcacggtcttgttaatgccaaatggatcggaccgcgtcacatctcatccactccaagaattgcagcccacaaaaacgatagatgatccagagatcaaggcatggctagccttgggcacaaagacaaagaagaaaggtggcggaaagaagaaaaaaggtaagaaagaggacaaggctgatgagacagcagaagctgagccagtggactcaacaaatgaggccacatctcaggaatgatga

SEQ ID NO: 552 - DNA, 2036 bp, Oryza sativa
atccaatggcttcctctctcctccgcgcctcgccgctctccctcctctcccgcctaaagccgctcaaccctagccccaccgcctcgcacctccgccgcctcctactgctctccaccgcctcctccacctcgtcggcctcgtgctcgccgtctccgctccgaaccctagcggccaccgacgcggcgaccccgccgccggaggaggaagcggcggcgcccgcggccgaggcgaagcgcgagaggctgcagccgctgcagtggcctgcgagggacgcgctgtgcggcgagctcggcgccggtgacgccggccgccgcgtgcgcctctgcggctgggtcgctctccaccgcgcccacgccggcctcaccttcctcacccttcgtgaccgatccggcacggtccaggtgacaactttgccagaatatccagaagtttatgctgtggtgaacaaactaagagtagagtcagtggttgcggtcgagggggttgttcggtcacgcccaacagaagccatcaacacagatatgaagactggggctatagaggttgctgcagataatatatatgtgctgaactcagtaactcgttcattgccttttccaatcaccactgctgatactgtaaaagagaagtttccagaagaaattagactgagattccgggtgctggacttacgccgaccacaaatgcagtcaaacttgaggttgcgccataatgttgtcaagcatattcgtcgatacttggaggatagacatgattttgttgagattgagactccagttttatctaagtctacaccagaaggtgctcgggactatcttgtcccatcgagagttcagccaggaatgttctatgctcttcctcaaagccctcagctgttcaagcaaatgttgatggtctctggctttgaaaaatattatcagattgcaaggtgtttccgagatgaagatctgcgtgcagataggcaaccagagtttacacaacttgatatggagattgcatttacatcaatggaagatatgttgaagttgaacgaagaattaatgagacatattttccaagaggttggtgatatcaagctgccaaatccttttccaaggctaacctatacggaggcaatgaatcgctatggaacagataggcctgaccttcgttttgattggcagctgaaagatgttagtgatgcatttttgggcagtagcttcaagatttttgcagatacattagaaaacgggggtgtcatcaaggcattatgtgttcctggtggtgccaaagaattttcaaatactgacctaaagaaaggaactgtctacactgaagcttccaaagctggagccaagggcctgccttttctcaaagttatggacaatggagagcttgaaggaattggtccactcgtggcaagtctgaaacctgaaaagaaagagcagttgttgaaacatctagatgcaaaatcaggtgatcttatcctgtttgcactgggtgagcaatcagcggctaatcgaattcttggcagattaagattatttattgctcataagctggaagtgatagatacatcagcacattcaattctttgggtgacggattttccaatgtttgaatggaacagtgatgagcagagatacgaggcactacaccatcctttcactgcaccaaatcctgaagatatgaatgatctaccatcagctcgagccttggcttatgacatgatttacaatggagtggagattggaggaggcagtttgaggatatacaaaagtgatgtacaacaaaggatttttgagatcatcggtatctcacccgagcaggcagaggaaaaatttggctatcttttagaatgttttgacatgggtgctcctcctcatggaggaattgcctatgggttagatcgtttggtgatgcttttggctggtgaaaattcaatccgggatgtgattgctttcccaaagactacaactgctcaatgttcactcaccaaagcgccatctcctgtagatccacagcaattgaaggatcttggcttccgtacgtgatga

SEQ ID NO: 553 - DNA, 1118 bp, Oryza sativa
cagccatggcgaccgtcatgcagaagatcaaggacatcgaggacgagatggcaaggacgcagaagaacaaggccactgcacaccatcttggtcttctgaaggctaaacttgcaaaattacgccgtgagttgctgactcctacatccaaaggtggtggtggcggtgctggcgagggatttgatgtgacaaaaagtggagatgcacgtgttggtttggtgggctttccttcagttggaaaatcaacattgttgaacaagctgacaggaacattttcagaggttgcagcctacgaattcacaactttaacatgtattcctggagttataatgtacaaaggggctaaaatccagcttttagatcttccaggaatcattgagggtgctaaagatggaaagggtagaggaaggcaggttatcagcacagcaaggacatgcaatgtcattctgattgttcttgatgccattaagccaataacccacaagcggcttattgagaaggagcttgagggatttggcattaggttgaacaagacaccccccaatttgacatttagaagaaaggacaagggtggcatcaattttacatcaactgtgacgaacacaaacttggatcttgaaacagtaaaagcaatctgcagtgagtacaggatacacaatgctgatgtctcccttagatatgatgcaacagcagatgatctcatagatgtgattgagggaagcagaatttacatgccttgcatctatgttgttaataagattgatcagataacacttgaagagctggaaatcttggataaacttccccactactgcccaattagtgctcatcttgagtggaatctcgatggtcttctagagatgatctgggaatacctggatttggttaggatatacacaaaaccgaaaggtttaaacccagattatgaggaccctgtaatcgtatcctctaagaagaaaacagtggaagacttctgcaacagaatccacaaggacatggtgaaacaatttaaatatgcattggtgtggggttctagcgtgaagcataagcctcagagagttggcaaggaacatgagcttgaggatgaggacgttgtccagatcatcaagaaagtttagtag

SEQ ID NO: 554 - DNA, 3079 bp, Oryza sativa
ccataaaccctaaccgcagcgacgcactccacctcctcctccaccacgccgccggcggccgggcgccatggtgaaggcctacctccggtacgagccggcgatctccttcggcgtggtcgcctccccggagtccaacgtcgcgtacgacccctccggccgcctcctcctcgccgccgccctcgaccgcttcgccgcctgggacctcaagcgcggcctcccctccctctccttcgccaccgccgccccgtccccctccctcgccgtctcctgcctcgccaccttcccctccgccgcctccgcctccgcctcctcgattgcgagtgggcacgccgatgggagcatcaggctatgggacacggagaccggctcctgtgaggcgaccctccatggccaccgctctgcggcttccgccctcgtattcggcccctctggcgccatcatcgcctctggcagtaaggactgtgacattatcctttgggatgtagttggacaggccggcctttatcgactccgtggccaccgtgatcaggtcacgggtttggtgtttctggattcagggaagaaactagtgagctgctccaaggataagttaatccgggtttgggaccttgacacgcagcactgccttcagattgttggtggccaccgcagtgaaatatggtcaattgatgtggatcccagcgagaggtttttggtgtctgggtcggccgatcaagagctgcgggtgtttacggtccggaaatctgctgaggagggtgaggattggagcaagtgggatatgctgaagctatttggtgagattccaaggcaaagcaaggaaagggtagcgactgttaagttcaataagaacggtaatcttgtggcatgccaggtggctgggaagacggtggatatttatagggttcttgatgaaacagaggcagcacggaaggccaagaggaggatgcacagaaagaaggagaaggctttggccaaatccatggctgctgaagggaatggtactgttatagatcctttgtcggctcaagacttgcagaatcccactcctgttgtcaccgatatatttaagcttctccatgttttgcgggttaacaagaaaatttgctctgtcgcattttctccaaacaatccaccaaaaggttgccttgccaccttgtctctatctctgaataataacatgcttgagacatactcagtggataatgagaatgtgtcgaatatgtattccattgagatgcatggacaccgttctgatattaggagtcttgcacttaactcagaggacaacctcctgatgtcaacaagtcacaatgctgttaagatatggaatcctagtactggcgactgtctccggacaattgattctgattatggattgtgcagtgcatttgttcctggaaatcggtatgcccttgtaggcacaaagagtggtactttggagattatagatattaatagtggaagctctattgaggttatagaagctcatgctggttccatacgatcaattgtactcattccaaacgaggatggaactgctggtgcatggggttttgtcactggaagtgctgatcatgatgtcaagttctgggaataccaattgatgcagaaatctgataatgactctaagcagctgagcgtaacaaatgtcaaaactttgaaaatgaatgacgatgtccttgcagtaaccatcagtccaactgggaatcatattgctgttgctctcttggatggcgcagtcaaggtcttcactatggactcactgaagtttgcccttaccctttatggccacaaacttccagttctctgcatggatatatcatccgatggagttctaatagttactggttctgcagacaaaaatttgaaaatttggggtatggattttggtgactgccataagtctatatttgcccacacggacagtgtgatggatgttaagtttgtttctaaaacacattatatgttcagtgttgggaaagaccgcactgtaaagtactgggatgctgataaattcgagttgttgttaacactggaaggacaccatgctgaagtttggtgtcttgccatcagcagtcgtggtgattttattgtaacaggttctcatgaccgctctattcggcgttgggatcgtactgaagaacaactcttcattgaggaagagcaagagaaaaggttggaggaaactttcgaggctgatttagatagtgctatggaccacaagtatgggcaaaaagatggtgctcctgatgagggttctgtaggtgttcctggtaggaaaaccaaagagacagtaactgctgctgatgcaattattgatgcacttgacactgccgaggaagaagtaaaacgccttgatcagcaccaggaaggacaaaataatgggaatggaactacatttcaacccaatgttataatgcaagggcagtcaccatcggattatgttttgaatgtagtttcaaatgttcgtccaaatgacttggaacaggctctcctttcattgccattctcagatgcacttaagatcatgtcttacttaaaggagtggtctatggttcctttgaaggttgagcttgtttgtagggtttgcctagtgctgcttcaaacacaccacagccaattaactacgacaccatctgcaagatcgatacttacagaactgaaaggcattctttacagtagagtaaaggaatgcaaggatgctataggtttcaaccttgctgcaatggatcatataaaagaattgttggccatgagatcagatgctcccttccgagatgcaagagcgaagctgatggagatcaggcaggaacaatcaagacgatcggataggtcagatggggctgaaaaaaggaaaaagaaaaagcgaagaacatccggtgagagctgagctttgtgggcgaggcaaagtagtttttttttttgtcgtagcatacaaacgatatatcggcgtgctcatattgtgtctacatgagcacgacagaattttggcatatcgagtgtaaaatcaaaacgcgcgttgcgccaaatcttttagatgtaatagcagaatgtgcatttgctcaatcctacgtactcc

SEQ ID NO: 555 - DNA, 2684 bp, Oryza sativa
tcgcgatggcttcgtcgcagggcctcaagaagaactaccgctgcgaccgctcgctgcagcagttctacacgggcgggccgttcgccgtcgggagctctcccggaggcggcgaaggcgaagtcgaaggaggcgaggccgaggccgaggcgttcctcgcgtgcgcctgcggcggggaggtgcgcctggtgtccgccgccgacgcgtccgccatcggggagccgatcgagggcgaaaacgaggccgtcacggcgctcgcgctgtcccccgactcccgcctcctcttcaccgcggggcacagtaggcttattcgagtctgggacctcgcgtcccgcacttgcacacgcagctggaaggggcacgatggtcctattagggccatggcctgccatgcttctggtgggttgcttgcaactgctggagcagacaaaaaggtgtgcgtttgggatgttgatggtgggttttgcacacatttctttagaggccacgcaggtgttgtgacgactgttatgttccacaaagatccgaagcgccttctgctattttctggaagtgaagatgccactgtgagagtttggaaccttgaaagcaaaaagtgtgtcgctgtgctgaaagagcatttttcagctgtgacatcattagccttatctgaagatggacaaacattgcttagtgctgggcgggataagattgtgaatgtgtgggatgttcgtaagtacaactcaaagaagacaataccagcatttgaaatgatagaagatgtttccttcattggaccaggaagtaatttattgtcttgtttgggtgaaccggcaaatataaaacgcaaaacagatggttattttcttacggttggtgaacgtggagtagttcgcatctggtgcttggaaagtgctcagtgtatatatgagcagcaatcatccgatgtaaccgttaacacagagaatgaggagtctagaaggggttttacttctgctgttatgttgtcagatgatcaaggactgctatgtgccactgccgatcagcagtttttgttctactgtcccacgagaactgacggaggggacttccagctgaacttatataaacgcctagtaggttataatgatgagattcttgatttgaagtttgttggggaggatgaacaatatcttgctgtagctactaacttggagcaggtccgtgtttatgacgttgcatcgatgtcatgttcttatgtgctgtctggccacactgaaattgttgtttgcatcgacacttgtatttcttcttctgggaagacacttgttgtgactgggagcaaagatagcactgtgagactctgggatatggaaaggagaagctgcattggtattggtaaaggtcatctgggagctattggttccgttgcattctcaaagaaatctaagaatttttttgttagtggaagcagtgatcggaccatcaagatatggagctgggatgatacacttgatgatgttggcagtgaagttcctctcaaagcaaaagctgttgtagctgcacatgacaaagatattaattctctttctgtctcgcctaatgacggtcttgtttgcagtggttctgaggaccgtactgcatgcatatggaaacttccaaacttagtgccctctgttgtccttaaagggcataaaaggggcatttggtcagtcgagttttctcctgtggagcagtgtgtcattacatcatctggtgacagaacagtcaaaatatgggctgttgctgatggttcatgcttgaagacatttgagggccatacatctagtgttttacgagcctcattcctttcacacgggacccaatttgtttcttgtggaagcgatggccttgttaagctatggaccatcaaaacaaatgaatgcattgctactttcgataagcatgatgggaaggtttgggcactggctgttggcaagaaaactgaaatgcttgctactggcggaactgatgctgttcttaacctttggcatgactgtaccatggaagataaacaggaagattttcgtaaaaaggaggaggaactgttgagaggtcaggaattagaaaatgcagtatcagattatgactatgcaaaagcaatacaacttgcatttgagcttagaagaccccacaggcttcttgagttattcacacagctttgcagggagtctgatctggaggacccaatagaaaaagcccttattggtcttccaaaggaagggcttcgcgtacttcttgagtatatccgggaatggaacacaaaacctaagctttgtcatgttgcacagtttgtgctttttcgggtattgaggagcttgcctcccactgatatcctggagataaagggcatcagtgagctccttgagggacttattccatattcacagaggcatttcagcagagttgatagactagtacgaagcacatttttattggattacaccttgacccggatgtctgttgtagatccggacatagatgagggcacaaccagagatgacgcaaatggctcatcagtagagaattgtgaaattgcacaggcgaagcctgatgcattggtagcagaagagaacttgcaaaagtcggtaaagaaaagaaaatcaagcaaatcaagcaaaaaaggcggtaagaaggtgaagattgcgtccacggggggcagtaaggatgttcctattgaggcttaataa

SEQ ID NO: 556 - DNA, 1643 bp, Oryza sativa
gagccatggagatcgggcagcatccggcgagcggctactccaaggagcaccagaagacctaccaggagtggttcgccttcgccgactcagatggcgacgggcgcatcacggggcccgacgccatcaagttcttcgccatgtccaagctcccccgcgccgacctcaagcaggtttgggcaatcgcggactccaagcggcaggggtacttaggtttcagcgaattcgtcacggcaatgcagcttgtctctctggcgcaagcgggggatgagatcactcaagacagccttaagcgcgatgacttgggcagcctgaatcctccaacgatggatggtttggatgctctacttgtgaaatcaaagcatcatgctaagagagttgatccagatatcgatggatttcctcaggctcaatctcctgcaacgagccaatggttcagctcaaagtcctcaaagaagatacccctgaatgctgttacttctgtcattgatgggttaaaaaaactatacatcgaaaaattaaagcctttggaagttacatacaaattcaatgattttgtatctccattactgacaaatagtgattttgatgcaaagccaatggttatgcttttaggtcaatattctacagggaaaacaacttttataaaacatctgctcagaacaagctatccaggtgcccatattggaccagagccaacaactgacagatttgttgttgtcatgtcaggaccagatgaaaggactattcctgggaataccatagctgtgcaagcagacatgcctttcagtggtcttacaacatttggaactgcttttttatccaagttcgaatgctctcagatgccacatccactactagagcatatcacctttgtcgacacacctggtgttctctcaggcgagaagcaacggacgcaacgtagctatgatttcactggtgtcacatcatggtttgcggccaagtgtgatcttattcttcttctgtttgatccacataagcttgatatcagtgatgagttcaaacgtgtcattggatctttacgcggacatgatgacaaaatacgtgtagtgctaaacaaggcagaccaagttgacactcagcagcttatgagagtctatggtgcattgatgtggtctcttgggaaagtattgaatacccctgaggttgcacgtgtttatattggatcatttaatgacaaaccagtaaatgaatcagctgttggtccaattggaaaggaactatttgagagagagcaagatgatctactttctgatctgaaagatataccgaagaaagcttgtgaccgtcgaatcaatgaatttgttaaacgtgcaagagcagccaagattcatgcccatataattggtcatttgaagaaggagatgcctgcgatgatgggcaaagccaaagctcagcagcgacttatagacaatttggagaatgagttcgcaaaggtccaaagggaacaacatcttccagctggagatttcccttatgtggagcatttcagagatgtcctgggtgggtatagcattgacaagtttgagaaaatcaagcccaagatggtgcaggcggtggatgatatgcttggatacgacattccagaactcctcaagaacttcaggaacccatacgagtgatga

SEQ ID NO: 557 - DNA, 869 bp, Glycine max
tcaaaatggacgtttccgagctcgccaagaagctcggtctctccgattccaaactcgttgtacggaaagctgccgagctccgtcgcctctgcgaagtccagttcgattcctccgtcattggagtcggcgaggttgcaaaatctatcatatgcttggaaatcgccgccatgagactcagcattctcttcgaccgatcctctgcggcgaggctgagcggaatgtccgaaagagcttacatcagatcctacaattcactccacaacggccttggcgtcaagatgaagttagatgtgagggaattggcgattcagtttggttgcgttcgcattattactctagttcgcgacggtcttaaattatataaggatcggtttgtttcgtcgttgccggcttctcgtcgtgcaagcgctgatttcacgcgtccagtgttcactgctgtcgctttttatctatgtgctaagaaacacaagcttaaagtggacaaacttaagttaattgagctctgtggtacatctgaatctgagttttctagtgtttctgctactatgaaggatttgtgccatgatgtttttggggttgcgaaggaaaagaaggatcctaagcaagtgcagtcaaatcgagatttgcttgatgttttgccaagtaaaaggaaagctgaggatggtggttattcatccgatgatggtccagagctttcaagttataaaaaagccaagaaaatggaaaaacgtgattttgagaaatggaaatcttctgtgcttgcatccaatgaacaaaacaagaaagcgccttgcaagcgaaccagacagactagtctcaactttctcaacaaagcttccgataatcaagagttggaggcaatgtgatga

SEQ ID NO: 558 - DNA, 4664 bp, Glycine max
aagacatgggttcagcttctcttctaaatccttctcaaccaggcgttaagaagaatgacaagagcaaacagaaatcggtcgtttccaaaactgaagaggaagttatgtttaaagataaacaaaagaaacggagtttgtcggagagcagtgagcagactgctgctatgcgcaaaatgccaaaacgtgctgcggcatgtaaaaatttgaaggagaaatcctttttgatatatgagaagtcctgcctcattgaaacagagaaggatcatattgtagaagaagaaagtctggctgtccgcatgacagctggacaggataatggttgtccaaataggcgcattacagagtttatccttcatgatgaaactggtaaatcccagccacttgaggtgctggaggttgatgatttgtttatcactggacttgtattgccacttgaagccagctctggcaagaaaaaagagaaaggtgttaagtgtgaaggctttggtcgaattgaatcatgggatatatctggttatgaagatggctctccagtgatatggctttctactgaagttgctgattatgattgccagaaacctgctgctagttacaaaaaagtttacgatcttttccttgaaaaggcccgtgcatgtgtagaagtatacaagaaacttgcaaagtcctctggtggtgaccctgatataagtcttgatgagttacttgctggcatggtgcggtctatgagtggtagcaaatgcttttctggagctgcatctataaaggattttgttatttcacagggtgagttcatttataagcaacttgttggtttggatatgacatccaaggcaaatgacaggatgtttgcagatattcctgctcttattgctcttagagatgagagtaagaaacaagtacatgcacaggtaatgccctcaaatgggagtttaaggattgattcaggagttggagatgaagaaaacaagaatcagatggattcagtagcttctgtaaacgaggaagatgaggatgcaaagctggcacggctgttgcaggaagaagagtattggcaatctatgaaccagaagaaaaactccagatcagcctctgcatcgaacaaatactatatcaaaattaatgaagatgagattgccaatgattatcctctacctgtttattataaaacctcccttcaagaaacagatgagtttatagtttttgataatgactatgacatatatgacactcaagatctccctcgaagcatgctgcataattggtctttatacaactcagatgcaagattggtttccttggaacttctgcctatgaaaccttgttcagatatcgatgttgcaatctttggatcaggtataatgacttcagatgatggaagtgggtttcatcttgatactgaggctggcaaatcttcttccgttggttctggagcacaggttgctgatggaatgccaatttatctgagtgccataaaggaatggatgattgaatttggatcatctatgattttcatatccatccgaactgatttggcctggtatagacttggcaaaccagcaaagcagtatgctccttggtatgacacagtattgaaaactgcaaggcttgctataagcattatcaccttgctgaaggagcagagccgagtatcacgactttcctttggagatgtcatcaggaaagtatctgagtttgataagaaagacggttcttacatttcttctgatccattgactgttgagagatatgttgttgtccatggacagataattctgcaactgtttgcagaatttcctgatgataagatcagaaagtctgcatttgtgacgggtcttacaaacaaaatggaagagcgccaccataccaaatggttggtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaggatgcaaaagagggaattgctagtgagttaaaggatgaggatgaagtggaggaacaagaagaaaatgaagatgatgacaatgaggagacaatacttttggagggaaccccaaaggcacattcagcttcaaagcaaaccaaaaaattttctgctgaaacagaaataaggtgggaaggggaacctgaagggaagactagttctggatatcctgtttataaacaggcaattattcgtggggaagttatttctgtaggaagatctgtgttggtggaggttgatgaaacagatgaatttccagacatatattatgttgaatatatgtttgaatcaaagatcggaagaaaaatgttccatggtaggatgatgcagcgtggttgtcagactgttcttggcaatgctgctaatgagagagaggtgtttttgactaatgagtgcagggatttgggactgcatgatgtcaatcagacagttgttgtaaatattcaaaataggccttggggacatcagcatcgaaaggataatatcattgcagatagagttgacagggctcaagcagaagaaaggaagaagaaaggactacctactgaatattactgtaaaagcctgtactggcctgaaagaggtgctttctttagccttccacttgatactttggggctagggtctggtgtttgcccatcttgcaaaatacaggatgctgaaaaggagaaggatgttttcaaagtaaattcctccaagtctggtttcctattgaaaggaactgagtattctcttaatgattatatttatgtaagtcccttcgaatttgaggaaatgatagagcaaggaactcataagagtgggaggaatgtggggttgaaagcttatgttgtgtgccaagtgcttgagattgttgtcaaaaaggaaattaaagaagctgaaataaagtctacacaagtcaaaatcaggaggttcttccgaccagaagatgtatcaaatgagaaggcatactgttctgatatacaagaggtgtattacagtgatgaaacacatataatctctgtagaatccatagaagggaaatgtcaagtcagaaaaaagaatgatattcccgaatgcagtgcccttggcagaatgttccaaaatgtttttttctgcgagctcttgtatgatcctgccactgggtcactgaagaagttgccggctcatgtaaaagtaaaatattcaagtggacaaacatctgatgctgcagctagaaagaggaaaggaaaatgtatagagggagatgatgttttagagtccccaaatgaaggaaaaacattaaatgaaaaacgtttagcaaccttggacatttttgcaggttgtggtggcttatcagaggggttgcagcagtcaggagtttcatcaactaaatgggctattgagtatgaagaacctgctggggatgcatttaaagctaatcatcctgaggcattggtgtttattaacaattgcaatgttattcttagggctgtaatggagaagtgtggggacacagatgattgtatctcaacatccgaagctgcagaattggctgcaaagcttgatgagaaggaaataagtagtttaccaatgcctggacaagttgatttcatcaatggtggtcctccatgtcagggtttctctgggatgaataggtttaaccagagcagttggagtaaagtccagtgtgagatgatattggcattcttatcctttgccgattatttccggccaaggtatttcttgttggagaatgtgaggaactttgtgtctttcaataaagggcagacattccgtttaactttggcttcacttcttgagatgggctatcaggtgaggtttggtatccttgaggctggagcatatggggtttcccagtcaagaaaaagggcattcatatgggcagcctctcctgaggatgtgcttcctgaatggcctgaaccaatgcatgtcttttcggcccctgagttgaagattacattatcagaaaatgtccagtatgctgctgtccgcagtactgcaaatggtgctccattacgttcaataactgttcaagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaatgaattgaacttgattcgatgccagaaaattcccaagagaccaggcgctgattggcgtgaccttccagaagaaaagataaaattgtctactggacaagttgttgatttgataccatggtgcttgccaaacacggctaagcggcacaatcagtggaagggactgtttggcaggttggattggcaagggaatttcccaacttccattactgaccctcagccaatggggaaggttggaatgtgcttccaccctgaccaagataggattcttactgttcgtgaatgtgctcggtctcaaggcttcccagatagctatcaatttgctggcaatatcatacacaagcaccggcagattggtaatgctgtgcctcctcctctggcatctgcattggggagaaagctcaaggaagcagtggacagtaagagctccacttagtag

SEQ ID NO: 559 - DNA, 992 bp, Glycine max
agaaaatgaagccaaataagcttaaatgtataactacattttttatcctatatttgttcaatcaaaatgctcattctgagctgcaggttgggtattacagctattcatgtagcatggctgagttcattgtgaaggatgaagtcagaaaaggtgttactaataatcctggaattgcagctgggctagtaagaatgcattttcatgattgctttattagagggtgtgatgcatcagtgcttcttgattccactcccttaaacactgcagagaaagactctcccgcaaataaaccaagtctccgaggatatgaagtcattgataatgccaaggctaaactagaagcagtatgcccaggaattgtttcatgcgctgacattgttgcatttgcagcaagggacagtgtggagtttgctcgagggcttggttatgatgttccagcaggaagaagagatggcagaatctcactagcttcagatacaagaacagagttacctcctccaactttcaatgtaaaccaactcactcaactctttgcaagaaagggattaacacaagatgaaatggtcaccctttcaggagcacacaccatcggtcgctctcattgctcggctttcagcagcagattatacaacttcagtaccacttcaagccaggatccaagtttagatccctcatatgcagcacttctgaagcggcaatgtccacaaggcagcacaaaccaaaacttggtggttccaatggacccttcaagtcctggaattgctgatgtggggtactatgttgatatattagcaaaccgaggcctcttcacatctgaccaaactctcttaactaatgctgaaacagccagccaggtgaaacaaaatgccagggatccctatttatgggcaagtcaatttgcagatgcaatggtgaagatgggtcaaatcattgtcttaaaaggtaatgctggagagattagaacaaattgcagggtggtcaatagttagtag

SEQ ID NO: 560 - DNA, 2377 bp, Glycine max
gagccaacacaaaccctatcaccgttctgcaaagcaaattcctcccatggcggaaaccctaagccccaatcccgcgatgggtcggaagcagagactccgcatccagtctccgaccagccccttcgtcttgggctccaacaacgaccagctcgaacgcgcccgggcacgagacgcacgcgccgccgccaaccgccgcaagagcctcgccctcaaccagcccctccaggccaattcccatcctggcctcaacaaacagcagatcctcgacttgttccaaaactgcatcaaactcgccagcgaaaacaaaattaatcagaaaaacacgtgggagttgaacctgattgaccatcttactgatatcatcaaggccgaagaagagcatgatgcggagactaattttcaaaaggcaagctgcactcttgaggctggagtcaaaatttattcattaagggtggattcagtgcattctgaggcatataaagttcttggtgggatgaatagagcaggccaagaagctgaggaagacactaccctggatggtgttaatattgaaagtagacaagaagaaagcaggaaagaaacgagcaaaaagttgtcacctttgtcaacattggaatcatcttttgaggcacttaatgtaaagaagtttgatgctgcatttgtcgtggatcctctctatcgccaaacaacagcaaaattcgatgaaggtggagccaagggtcttttaatgaataatcttggtgtatatggtggctgtagggtgctctttgattcacaagaagtgcctgctaagtgtatggcaagccaaaatcaatctgatatttcagatactattgatctttcttttctcaaagattgtattgatcagatggtgttggacatgcgtgtaaaggatgaaatttctccaagtctcaggactatagtaaaccaatttgatgaaagtaacagaaggcccactgatattcaacttcaaggcccgagttcagctgaagatcttgacaatgctgataataatgaaaatggttttgatagagaagaatacgagaactgcacggcctggagtgatgatcatgatgaccaaacagttgttgccgatcttgactataatgatgcagatccaagtttttccagttaccctcaggacaatgctgagcaatttccttccccagaaactgatatggatgacagatttgaaaatgttgaggggtatttatttttgagtctgggttttagttcaaaacaaaacgcatgggcagggcctgatcattggaagtatcgaaaatccaaagtctcagaggttcatcctacttctgaagatgggtcgaccctaaaaagtaggcagccaaagagtaagagacaaacagaagttgatttaaatttcacagattctcttgagaaaaaagtgctagatacgttttctcctcccaagaatcccaaattgttactgcttcccgaaagcagattgccttgcaatacaaagcttcctgaggactgccactatcagccagaggatcttgtcaagttatttcttctgtctaatgtgaagtgtctcgggaggaaggcaaacaggttctcagatggatctagagaacaatccaacgaatatgaatcattcccttcgtgggataatggaagtgtttgtggggatgacgctggtgactacggaggtgatcttcatagtgacatggaggactccaacactctaattactcagcctcgtcaggtcaataaaattgaagtccagtatgacaagacttccaaacaagttgatgttcatgcactgaaaattactctttgggaccatgttcaagaatctgttaaacttcctttagagggtcaaaaagatactttatctttcaagaatatattagccaactttcctagcgaatgcaatgctgctgcaacaattagcgacatctctcctcatttgtgcttcatatgtctattgcatttggcaaatgagaaaggattgagcattcaaaactcctccaacttggatgatcttgccatacggcttccacaagttgctgattctataaggggaacagtttagattcctcttcactcaattattcttcagctcaggaatcaaaaaatgatggggactgtttcactgttgagtaacaagtccaagaaagcattgaagtgagtaacaagtccgtctttgtggttggagtttacaaatatcagtttgcttatggtggtttgaacactcggttaaggaaatgtcagactaatcatgatgtcttgttattctgtacatgaaagtattcaaagcatgcattagtgctataatttcgttttccactccagcccgtttcatgtgtgtctaatgcttaggcttaggcttttacgagaatggctagtgttggtataa

SEQ ID NO: 561 - DNA, 1283 bp, Glycine max
aaagcatggagtttttgaaaatcaagaagttcagaaaatctcagaaagcagatggagaaaaggatttggcagacaaggcagtgcctgagcctgaggaaccaaagctgaacaccgactgtcctgatcagtgtaaatcagaaaacgcagattctgcaggtgaagctgaggatgatgatgattttattactaatgaggttaagaggaggctgaaagaattgagaagaaacagttttatggtgttgattcctgaagaagattcctgcccggaggaaggggaggaggaagaggaagagggagagacgagctcaaatgaatggagggatgtggaggcagaaggtcagcaatggtggcgtggttttgatgctgtgtttgaaaagtactgtgaaagaatgttattctttgatcggatgggcactcaacagcttagtgaagttggcaaaggttcacagtatacttcaactccatctccaagatctgcttcaaagaagctggtttctccccttcgttgtctttccttgaaaaaatttgaagaacctgatgatgagactgaacatcttcaacagcctgagcatgacccctacctggatattgaaacagcatatgtaggtcaaatttgcttgacttgggaggcacttcattgtcagtactctcatatgagtcagaagatatcttggcaacatgataatcctacctgttacaaccacagtgcacaagagtttcaacagttccaggttctattacaaaggtttattgaaaatgaaccttttgagcagggccgtcgagctgaaatttatgctcgcacaaggaacaatttgcctaaactgcttcagattcctaatatacgaggttcagatcatgaattgactgatgattcagagacgagagttcttgctcctgatcttatcaggataattgaaagttctatccttacattccaccttttcatgaaaagggacaagaaaaagtcaagtggtgccaccagtcagaaccagcttgcaactcctctacaacagattcagtcgactcttgaaaagaaagtggcgaagctgaaggaactgcgcagaaagaaaaaaagttggaagaagaattcttggccccaaaagcatgaggacattcatcttttgcttggccttattgacgtgaaaatcctggcaagggttctgaggatgacgaggatgactagagagcaactgttttggtgtgaagaaaagatgaaaaaactggatttatcaaatagtaggttagaaagggatccatgtcccatcctcttcccttgctagtag

SEQ ID NO: 562 - DNA, 2897 bp, Glycine max
ataagatgactgtgaaaacacctggaacaccagcttcgaatatagataggactccagtatcaaccccgggaggggcaagagctaaggaagagaagattgtggtcacagtgaggctaaggcctttgaacagaagggagcaattggctaaagatcaggtggcatgggactgcatcaatgattatactattgtgtataaaccaccggcacatgaacgcgcttctcaaccagcatcatttacttttgataaagtttttggtcctgcttcagtaactgaggcagtgtatgaagaaggagtgaagaaaattgcattatctgcattaaccggcattaatgctacagtttttgcttatggacaaactagcagtggaaagacatacacaatgagaggaataacagagaaggctgtcaatgatatctacgagcatattatgaatagccctgaaagggatttcactataaaaatatctggactagagatatacaacgagaatgtaagggacttgttaaattcagaatctggtcgcagtttgaagcttcttgatgatcccgagaaaggtactgttgttgagaaattagtggaagaaacagcaaaagatgacaggcatttgagacatttaatctctatttgtgaagctcaaaggcaggttggtgaaactgctctaaatgataacagttcgcggtctcaccaaataataagactgacaattcaaagtactcttcgtgaaaattctgattgtgtgaaatcttttgttgcaaccttgaactttgttgatctagctggaagtgagagggctgcacagacacatgcggatggcactaggctgaaagaaggttgccatattaaccttagcttgatgactcttacaactgttatcaggaagctcagtgttggaaaaagaagtggtcatataccttacagagattcaaagctcacacgtatattgcaacattcccttggtgggaatgcacgcactgcaattgtttgtactttgagtccagcactaagccatgtagagcaatcacgaaacactctcctgtttgctacaagggcaaaggaagtaacaaataacgctcatgttaacatggttgtatcagacaagcagcttgttaaacatttacaaaaagaagttgcaaggctggaggcagtgttgcgcactcctgatccatctaaagaaaaggattggaaaattcaacagatggaaatggaaattgaagagctgagacgccagagagatcttgcacaaactcaggtggatgaattacgcagaaagcttcaggatgaccagaaggtctcaaacccagttgaatcaccgcatcagccagtcaagaagtgcctgtcattcactggtgcactatcatcactaaaaccagagctaggatgtgagagagtaagaagctcaatattaagacagtcgatgaggcaatcctctactgctccttttacccttatgcatgaaattcgcaaacttgagcacctccaagagcagctgggcgaagaagccaatagagctttggaagtattacaaaaggaagtggcatgtcatagactaggtaaccaagatgcagctgagacaattgcaaagctgcaagcagaaataagggaaatgcgtgctgttaggtcaataacacccaagaatgttggagttggaagcatggtttctatcaacaagagtgtcagtgctaatctcaaggaagagattacccgacttcattcacaaggaagcaccattgcaaatcttgaacagcagcttgaaaatgttcaaaggtccatagacaagttggtgatgtctctcccgaacaacttccaacactcacccaatgaagcatcccctaagaataaaaaggaacacaaaaggaaaaagttgcttcctttgtcttcaagcaatgctgccaatcgccaaaacttcctaagatctccctgctcaccattatctgctacgcagcaagttttggaatctgatgttgaaaatagagcccctgagaatgatgatattgtttcaactgatactcttcctgagtccgagaaggagactccatcaaagagtgaagaagctggagatgtttcatcaaaggaaaataccccagtttatcgacgctctagttcagttaacatgaagaaaatgcagaaaatgtttcagaatgcagcagaggagaatgtaagaagtataagagcatatgtgacagaattgaaagaacgtgtagccaaactgcagtaccaaaagcagttacttgtttgccaggtgcttgaacttgaagcaaacgaagcaaatggccacaacatagacaatgaagagtactcatgtgaaccggaggagccccagatttcgtggcaaatagcatttaaagagcagcggcagcagattcttgaattatgggatctatgttatgtctccattattcacaggacccagttttatttgttattcaagggagacccagccgatcaaatatacatggaagtagaactaaggcgtttgacatggttgcagcaacacctagcagaacttgggaatgcaagcccagctcctcatgttggagaagaacctactatctcattgtcttcaagcattagagctttgaaacgagaaagggaatttctagccaagagactgacatcacgtttgtcgctggaggagagggaggcgttgtatatgaaatgggatgtccctcttgatgggaagcagaggaagatgcagtttatcagcaagctttggactgatcctcatgaccaaatccatgtacaggagagtgcagagatagttgcaaagcttgtgagtttcaggacaggaggcaacatgtcaaaggagatgtttgagctgaactttgtgcttccatctgacaataggccatggttgatgggctggaatcacttgacaaacttgcttaatttgtaataa

SEQ ID NO: 563 - DNA, 742 bp, Glycine max
cgatcacaatctcaaacacctcaacttcatttctctgctccaaagtctcaatcttttatccaaaaactcaaatgggcatggccacaatcacaatgggaggaaaccacaattcctccatcactccacgccactacaacacccacaaggtgttccttttctgcaactacattctcttgggtgcagcttctagctgcatcttcctcaccctctctctgcgcctcattccctctctctgcggcttcttcttcatccttcttcaggtctttacgattgcgggcgcggtctccgggtgcgccgccgtggggactaacaggtggtactctgcacacatggtggccactgttctaacggctatctttcagggttctgtttcggtgttggtgtttacgaggaccggcgattttctgggtcaattgaagtcttatgttagggaggaggatggtgctgtgattctcaaattggctggtggactcaccattttgatcttttgcttggagtgggtggttttgacacttgcatttttcttgaagtattatgcctgtgttgaggggaatagtggggctgttgtgcctgtgaggagtgggaaggtgcagcaggatgaggacttgaaggattggccttggccttttcaagtttgattcttgtgatgacaagaagaaacacaagaataacaatgacatattccttttgaagttgttgcagctgttttgatgataatctttcaaatatgttgattcgttgg

SEQ ID NO: 564 - DNA, 1292 bp, Glycine max
tagaaatgggctccgaattgattttcagaggccacgaggctcagcccgtggacgactcgtactcgccgaagccccacaagccctggttcaccgtgactcgcccgattcactacatgctccgcgagcagcgactcgtcttcgtcctcgtcggcgtcatcatagcaaccctcttcttcacactcgtcccttcctcatcctcttcaagcgttccgtacgagtctctcccgatctcgtacttcgagcgcgagtcaaagattccggcgtaccaccaccgcgtcgctgcggcggtgcactcggtggggaaggtgccgttgggaattaagaggaaggggctccggatcgtggtgaccggcggcgcggggttcgttgggtcgcacctggtggatcggttgattgcgagaggggacagcgtgatcgtggtggacaatttcttcacgggaagaaaagagaacgtgatgcatcattttggaaaccctagattcgagctcattcgacacgacgtcgttgagcctctccttctcgaggtcgatcagatctaccatctggcttgccctgcttcccctgtccactacaagttcaatcccgtcaagactatcaagaccaatgtggtggggaccttgaacatgcttggtctagctaagcgagtgggagcgaggttcttgttgacgagtaccagtgaggtttatggagatcctctgcagcaccctcagaaggagacttactggggaaacgtcaacccaattggtgtccgaagctgctacgacgagggaaagcgtacggccgagacgttgaccatggactaccaccgaggtgccggcgttgaggttagaattgctagaatctttaacacctacgggcctagaatgtgcttagatgatggccgtgttgttagtaacttcgttgctcaggcactaaggaaggagcctttgaccgtttatggagatgggaaacagacaagaagtttccaatatgtctctgatttggtggagggtctaatccgccttatggaaggagaacacgtgggacctttcaatcttggaaatcccggagaatttaccatgcttgaacttgccaaggtggttcaagaaacaatagaccctgatgctaggatagagtacaggcccaacacagaggatgacccgcacaagagaaagcctgatataagtagggctaaggatcaacttggctgggaacccaaggttgacctgcgcaagggcctcccactaatggtttctgacttccggcaacgcatttttggtgaccagaaggaaaaggcatccgtagcctaataa

SEQ ID NO: 565 - DNA, 1367 bp, Glycine max
gtatcatggatcatgttattggtggaaaattcaagcttgggaggaagattgggagtggatcgtttggagagctttacttaggtgttaatgtgcaaagtggggaggaagtggctgtcaagctggaatctgtgaaaaccaagcacccacagcttcactatgagtctaaactgtatatgcttcttcaagggggaactggtataccccatctaaaatggtttggagttgagggtgactacaatgtcatggttattgacctccttgggccaagtcttgaagacttgtttaactattgcaatagaaaattatccctgaaaacagttctgatgctggcagatcagctaataaacagagttgagtacatgcactctcggggttttctgcatcgtgatataaagcctgacaactttttaatgggcttaggccgcaaggcaaatcaggtatacataattgattatggcctggcaaaaaagtatcgggatcttcaaactcacaagcatattccatacagggaaaacaaaaatctcactggaactgctcggtatgcaagtgttaatactcatctgggagttgaacaaagcagaagagatgatctagaatctctcggatatgtgctcatgtattttttgagaggaagtctcccatggcaaggcttgagagctggcaccaaaaagcaaaaatatgacaagataagtgagaagaagatgcttactccaatagaggtcttatgcaagtcatatccattggaattcacatcatacttccactactgccgatcattgcggtttgaagataagcctgattattcttatcttaagagactctttcgggacctatttatccgagaaggttatcagtttgattatgtatttgattggactatgctgaagtatcctcaaattggatccagttctagagcccgaccaagtgggaaaccagtcataaacccaggacaatcaggggagagaatagaacggccttcaggtgcagttgaggcatttgcaaggaggaatggctctggacttgttctacatagtgagctttctaggcataagtcttcagatgatgtgccatcttccaaagacgtgcaagctaattctgagaggcctcgcagctcttctcgtaatggcagttcttcaaaaaagcctgtcttgtctagcagccggccaagctcttctggtgagcctagtgaaagccgttctagccgactggtcttaagcagtggccgactatcaacaactcagagacttcaacctggttttgaatccaaaacatctttatcacgggcttcagcaacaagaggtggtcgtgatgatacactcaggagctttgaactcctgtcacttggttcaggaaaaaggaaatgatga

SEQ ID NO: 566 - DNA, 2354 bp, Glycine max
gaaatatgccagctggtattatgattccagcaagaaacatgccctcgatgattggaagaaacggaaccgttggtggctttggattatcttcagggctctctcttggccatattgaaaaccataaggcttcggaatctcaaagatctgtagaaatgttccagccaaacctgatggaagctggtcagctccacccactggacatgcctcagaacacttcagagagcgatgtccctagaatccgtgaagatgactttgacagtgccaccaagtcaggtagtgaaaatctagaaggtgcttccggtgaagaccaagaccctcgtcccaacaagaagaaacgctaccaccgccacactcagcaccagatccaggagatggaagcgttctttaaggagtgtccgcaccctgatgacaagcaaaggaaggagctgagtcgagagttagggttagagccattgcaggttaagttttggttccagaacaagcgcactcagatgaagacccaacatgaacgtcatgagaacacacagctgagaactgaaaacgagaagcttcgagcagataacatgaggttcagggaagctctcggcaatgcctcgtgtcctaactgtggtggaccaaccgctataggggaaatgtcattcgatgaacatcacttgaggctcgaaaatgctcgcctgagagaagagattgataggatatctgccattgctgcaaagtatgttgggaagcctgtggtgagctatccacttgtttctccttcatctgttcctcctcgtccactagaacttggggttagtggtggttttggtggccaacctggaggcattggaggggacatgtatggtggagctgcaggagatcttctaaggtcaataagtggacctactgaagctgataagccaatcataatagagcttgctgttgcagccatggaggagctcattggaatggcgcaaatgggtgagcctctttggttgactaccctggatggcaccactgtgctcaacgaggatgagtacatcaggtcttttcctcgagggattggtcctaaacccgttggtttcaagtgtgaagcttcgagggaaactgctgttgttatcatgaaccatgttaaccttgttgagatcctcatggacgtgaatcaatggtccacggtgttctctggcattgtctcaagagcaatgactttggaagtgctatcaacaggggtggcggggaattacaacggtgcattgcaagtgatgacagcagaagtgcaagtaccttcacctctggtgccaactcgagagagctattttgtaaggtattgtaagcagcacggtgacggaacttgggcagtagtggacgtgtccttggataatttgcgtcctagtccttcagccagatgtagaagaaggccctcaggttgcttaattcaagaaatgcccaatggctactctaaggtcatatgggttgagcacgtagaagtggatgacagaggtgtccataatctatacaagcagcttgttagctcggggcatgcatttggtgcaaaacgttggattgcaaacttggatcgacaatgtgaaaggcttgctagtgccatggcaacaaacattcccacagtagatgttggagtaataacaaacccagatgggaggaagagcatgttgaaactggctgagagaatggtcataagcttttgtgctggagtgagtgcatctactgcacacacatggacaacactttctggaactggtgccgatgatgtaagggtcatgacacgtaagagtgtagatgacccaggaaggcctcctggcatcgttctcagtgctgcaacttctttttggcttcctgtgtcaccaaaaagggtttttgaattcctccgcgatgagaactccagaagtgagtgggatattctttccaacggtggagttgttcaagaaatggcacacattgccaatggccgagacactggaaattgtgtctctctacttcgggtgaatagtgcgaattcaagccaaagcaacatgttgatattacaagagagttgcgcggactcaacgggatcttttgtgatatatgctcctgtagatattgtggcaatgaatgtggttctgaatggaggggacccggactacgtggcccttctcccttcaggatttgctatactcccagatgggaccactgcacatggaggtggcattggtgacattggacatggtggttctctcttgactgtggcatttcaaatattggttgattcggttccaacggcaaagctttctcttggatcagttgctactgttaacaatctcattgcctgcactgttgagagaattaaggctgctttatctggtgaagttgcttgatga

SEQ ID NO: 567 - DNA, 768 bp, Glycine max
tctcataccaaacacgcctttccgcattcaaactatggcctcttcttcgtccctctcattggacacagccaaagacctttcgaactcatctggtgaggttcatgtcatcgtcggtcccatgttcgctggcaagaccactgcccttctttgtcgcatcgaatccgaactcaacgctgccaagaatgtggtgttgttaaaatcgagcaaggatacaagatatgcaattgactcggttgtgacgcacgatgggattaaatttccttgcagggcgttaccggatctgttgtcgttcagggaaaaacacggcgatgatgcttatcagaagttggatgtgattggcatagacgaggctcaattttttgaggacctatacgagttttgctgcaaggctgctgatgaagatggcaaaaccgtaattgttgcaggcctggatggtgattacttaaggagaagctttggctctgtgcttcacataattccacttgctgattctgtgaccaaactaacagcacgttgtgaactgtgtggcaaacgtgcttttttcaccttgaggaagacagagcagagagagactgaactaattggtggggctgatttgtatatgccggtttgtcgcctgcactacctgaacagccaagttgctgagaggagtgttctcgaatctcaaaattttaaaaccgattgattcccttcttgaggcagctgaagatgtttaagggttattgggaaattggcttgtatgtagcccaccatgtttaattgttcgac

SEQ ID NO: 568 - DNA, 935 bp, Glycine max
gacacccacttcgcatgaccaacacttccaattctctttctttctccctctctagggtttcgaagatgttctcgggatcccaattcgacgccaccaccgccttctccggaggcggtttcacgtcctcccagccgtctaccctcaacgattcttctcccgcgccgtcaaacagccgcgaaactccgggtttggtgccggtgacagtgaagcagataagcgaggcctctcaatccggtgatgaaaagtcgaatttcgtgatcaacggtgtagatctgaacaatgtaacactggttgggatgatgtttgagaaagttgagagaaatactgatgtcagttttgttttggatgatggaacaggacgaatcaaatgtcgaagatggattaatgaggcttttgacacaaaggaaatggaggcagtgatgaatgatatgtacgttcgtgtttatgggcatttgaaaagctttcaaggtgttaagcaacttgttgccttctctgtcaggcctgtgacaaattttgatgagatcccttttcactttattgattgcatccataaccatcttcgctccaaaataaaggtggaaggaatcacttctgcaaatccttcatctggctcatctttggaaactcctgtcaaaagtgcaccaaatagatctcaggcatcaaatccagtatgtgcacaacatagcgtggatggacttaagggtattgataaattggttatggactacctggagcagcattcagataggtcagatggacgtggaatacatgttgatgaactatcacgggagctcaagcttccaattgaaaagatcaagttgtcgctgaagactcttgcagatgatggtgaaatatactccaccatagatgacgaccattacaaaaaagcctgatattttatgtaatctgaggaatatagctaaggattgagctgg

SEQ ID NO: 569 - DNA, 1004 bp, Glycine max
ataacatgagcaccacagtgcaaagaactccaagatccagtaggcagtctttatttttccaggatttggcttcacctgtttctgcccgtagaggaaaattttcgagtcccagtcaggcagctgcagtatcttcactatggcgtgagaactttggtagttcagaccttcctccgcctcctgttttcaccttggaagacagatcagacttttctcctgaatcaggcatactagattatcaaatatcccctgagactaagtcagacactagaactcccatccaaacttcaaataaggagttttctactccagtgaaaagcaaatctgaggccagcacatcttatgctttgagaggggtacaacaaaaccaacagggctcgccaggtttgagttggtggtcacctacaactgcaaagagtggtggggaacaagatgagaggggaagaagttcgccagttgagggtgtggttcagcctggtgctctgataactcttcctccaccgctggaagtggcaaggcctgaggttcaaagaaattctttgccagcagggaatctcaatgaggaagaatgggtaactgtgtacggattttccccaggtgatactaacatggttttaagggaatttgaaaaatgcggtgaaattttgaaacatgttcctggtcctagagatgctaactggatgcacattttgtatcagaatcgatctgatgcacataaagctctcaacaagaatggaatgcaaatcaatggagtgctaattgttggtgtgaaactgttggatcccatgcaacgtcaagctttaaatgaaaggcttaagaatcagggatttatgcccttacctctaccctctgccagaaactcagaagtgagctcattgaaagctccttctcgcccttattatctgcagaatggcaactcaactgcacggcagactggaggaaccattgcttccccaacaaaatcattggtgtccaagatcatggacttgatgtttggagtctaataa

SEQ ID NO: 570 - DNA, 1541 bp, Glycine max
taacaatgcaggcaacagacattattctgctgggcctgggcttgctcttcgtccgctggtggtggcggcgctggtccaccaccggcggcggcccgaagaacctccctccaggccctcccgggtggcccatcgttggtaacctcttccaagtgatcctgcagcgccgtcacttcatttacgtgatccgcgatttacgtaaaaaatacggcccaatcttcagcatgcagatgggccagcgcacgctgatcatcgtgagcagcgcggagctaatccacgaggcactgatccagcgaggcccattgttcgcgagcaggcccagagactcccccatccggctgatcttcagcatggggaagtgcgccatcaactccgccgagtacggccctctctggcgcaccctgaggaagaacttcgtgaccgagatgatcacccccctgaggataaaacagtgcagctggatacgaaaatgggccatggaggcccacatgaaaaggatccaacaagaggcccgcgagcaagggttcgtccaagtgatgagcaactgcaggctcaccatatgcagcatcctcatctgcatctgcttcggcgccaagatcgaggagaaaagaatcaaaagcatagagagcattctgaaggatgtcatgctcatcacgcttcccaagcttcccgattttttaccggttttcactccgttgttccggcgtcaggtgaaggaagctaaggagttaaggaggaggcaggtggagctgctggcgccgttgataaggagcagaaaggctttcgtggaggggaatttgttggagctgggaaatcattatgacatggcgagtcccgttggtgctgcttacgtggactccctgtttaatttggaggtgcctggacgaggacgcttgggggaggaggagctcgtgacgctcgtgtcggagattatcagcgccggcaccgacaccagcgccaccgcggtagagtgggcgctgcttcatttggtgatggatcaagacattcaagagaggttgtataaggagatagtggagtgtgtggggaaggatggtgtggttacggagagtcacgtggagaagatgccttatttgagcgccgtcgtgaaggagactttccggcgacacccaccgagccactttgtgttgtcgcatgccgccacggaggagacggagctgggtgggtatacggttccgaaggaggcgagcgtggagttttacacggcgtggttgacggagaatccggatatgtgggaggatccgaatgagttcagaccagagaggtttatgagtggggatggggttgaggttgacgtgacggggaccaaaggggtgaggatgatgccatttggtgtagggaggaggatttgtccagcgtggactctggggattttgcatataaatttgttgctggccaagatggtgcaggctttccactggttgcccaatcccaacgctccacccgacccgactgagaccttcgctttcactgttgtcatgaaaaaccctctcaagccacttattgtgcctcgatccatttaataa

SEQ ID NO: 571 - DNA, 482 bp, Glycine max
gggagatggggagcgacagcgaggcagagaagtcggtgcagaaagagaaggagaagaagaagatgttggccctggctcccattgctaaacctcttgctgggaagaagctttgcaagcgaaccctaaaacttgttcgtagagctgccgaacacaaatgcttgaaaagaggagtgaaggaggtcgttaaaagtataaggagaggtcataaaggattgtgtgtgattgctgggaacatatcaccgattgatgtcatcactcatgttcctattctttgtgaagagtctgacattccttatatttatgtcccatctaaagaagatcttgcaggcgcaggagcaacaaagaggcctacttgctgtgttctggtacagacaaagcctgcaaagggtgaaatagagcaaggggaacaagagaaactaaagtcagattatgatcaagttgtagcggaagttactgagcttacaacttcactcttttgatga

SEQ ID NO: 572 - DNA, 1683 bp, Glycine max
caatttctccttctgtctttctgctttggatgtttttcaaccaaaaaattgtgcttttcaaatcttttgctctgatgggtacttcaaatcttctcttgtttttctctctgatgagcctgtgtgctatggcggcttccaaggtggtgcttattgggaataatatcactctctcctttgatgatattgaagctaattttgccccagcagtcaaaggttctggaaaatatggggtcttatatttggcagaaccactggatgcgtgtgcagaattgacaaataaagttgaacaacttcccaatgcgagttcaccttttgctttggtggttagagggggatgtagctttgaggaaaaagtcagaatagcacaaaaggctggcttcaaagctgtaattgtctatgacaatgaagagggtggcatcttggttgcgatggcaggaaattctgctggtataagaatacacgctgtatttgtatctaaagcttcgggtgaaatactaaagaaatatgctgggttgactaatgtggaaatatggctcattccaacttttgaaaactcagcatggtctatcatggcaatttcatttatttccctgctagctatgtctgctgtcctggccacttgtttcttcgtccgcaagcatcgcataagaagagaaaggcctcgagcttctcttgttcgtgaatttcatggtatgagtagtcgcctagtgaaagcaatgccgagtttggtatttacttctgttttggaagataactgtacatcaagaacatgtgctatatgccttgaagactattgtgttggtgagaagctcaggattctgccctgctgtcacaagtttcatgctgcctgtgtggattcgtggcttacttcatggagaaccttttgtccagtttgcaagcgtgatgctagaaccggcttaactgatccaccaccttcagagtccacacccttgctctcatcaaccccagcatctatggcatcctctgtcttatcttctgcaagatcatcactagcttcatcttcagcaatacaaattgcccggacagcatctatggcatcctctgccttaccttctgcgagatcatctctagcttcatcttcagcaatacaaattgcccggacagcatctatggcatcctctgccttacattctgcgagatcatcactagcttcatcttcagcaatacaaatttcccgggcagcttcacagaccccatctgtttcccgtaaccactccatagccagtacaccttatgttcagccatctcttaggtcctcctaccatcaatccccctccctaagcatcagccgaagctccgtagatcttaggaatgcatcccaaagatctctagcttctcacttgaattcaccatgttccatgggatacccatctttgtcatctcttaactcaaggtacatgtctccacacattccaagtccaagcaatgcttcagtaagctatatgggttcatccagtcatcaacaacatcctctccgttatagtgagtcggctgcaagcttctccccatttgcatcgacacactcccttccagaatgttaaattgttcaattgattatatcatatgattgagacgtccacgcagttgaactagtaattgccaagtcttgaactaaaaggtggccatgtgatgaccggtggtctagttgaatagtcctatgtg

SEQ ID NO: 573 - DNA, 1616 bp, Glycine max
acaacatgggtgagattcaagagagcaaggctcttgcaaagagcaagccttccactgaacaggacgttactgatgagctagacctaagaatgaagaagtatctcagaggagaaggtgctaatttggagggtttgaaggataaaaagctgaagggtcaactagctgttaaggaagacttatatggaaaatctgcaaaagctgctgctaaggctgagaagtggcttatgcccagtgaaggaggctatctggaggccgaaggcttggagaagacatggaggatcaaacaggaggcaatagctcgtgaagtagatatctcaagctcaggaaaacaatatgatattattttaccagaacttggtccatacactctggattttacttcaagtggtcggtatatggctgtgagtggtcgtaagggccatctggggattgtggacatgataaatctgagcctaatcagagagtttcaggtaagggaaacagtgcgtgatgtcgcattcttgcataatgagctcttttttgttgctgctcagaaaaagtatccatacatctacaatcgagaaggcacagaacttcactgtctcaaggaacatggtccagtgttaaggcttcagtttctggaaaaccattttctcttggcttcaatcaacaagtttggacaacttcgttatcaggatgttacaatgggttccatggttggtaattttcgaactggcttaggacgtacaaatgtaatgcaagtgaaccccttcaatggggttgtttctttaggtcactcaggtggtactgttaccatgtggaagccaaccagtgcttctcctcttgtcaagatgttatgtcatcatgggcctgtctcagcactggcatttcattcaaatggccacttgatggccactgctgggaaagataaaaaaattaagctttgggacttaaggaaatttgaggttcttcaaaccttaccaggtcatgcaactactctggattttagtcaaaaaggcttgcttgcatgcggtaatggttcattgatccaggttctgcgtgatgtttctggcacacaaaattattctaagtatatgactcattccatggtgaaaggttaccagataggaaaattggtatttcgaccatatgaagatgttctaggcatcgggcattccatgggctggtctagtattcttattccaggagcaggagaacccaactttgactcatgggttgcaaacccatttgaaacttctaaacagaggagagaaaaggaaatacggtctcttcttgataagcttccacctgagactatcatgctggatcccagcaagattggtacggtgaaaccaagaagagagaagccaacaaagcaagagagggaggctgaaatagaagctgacgttgaagcggctaagggcaagaaactgaagaagaagacaaaaggaagaaacaagccaggtaaaagggtacagaaaaagcaagaggcagttgctagagtgaagaggccctacttggagcagaaaattcaagaagaggaaagcatatcaagaaagaagcagaagactagggagggtgttgaactaccaaaatctctacagcggtttgttcgtaaaaaggcttcatcatgatga

SEQ ID NO: 574 - DNA, 944 bp, Solanum lycopersicum
tcaagatgaatgatttgatgacaaaatccttcacaagctacattgatctgaagaaagccgccatgaaagatgttgaagctagtccagatttggaaatgggtatgacccaaatggatcaaaatctcactgctttcttagaagaagcagaaaaagtgaaattggagatgaattcaatcaaggagattcttcgtcggttacaggacactaatgaagaaagcaagtcgctgcacaaacccgaagctttgaaatcgatgcgtgatcgcataaattcagatatcgtagcggtgttgaagaaggctagagctattagatctcagctggaagagatggaccgatccaatgcgattaacaggcggctttctgggtgtaaagaagggacgctggtcgataggactcgatctgctgtgactaatgggctgaggaagaagcttaaggaactgatgatggattttcagggactgaggcagaggatgatgactgagtataaggaaactgttggaagaagatattttactgttactggtgaacacccagatgaagaagttattgataagatcatttctagtggaaatggtcaaggtggtgaagaatttctttctagagcaattcaggagcatggtagggggaaagtgttggaaacagtggtggagatacaggaccgtcatgacgcagcaaaggagatcgaaaagagcttgcttgagcttcaccagatattcttggacatggcagtgatggttgaggcacaaggagagaaaatggatgatattgaacatcatgtagtgaatgcagctcagtatgttaatgatggagctaagaacctcaagactgcaaagaagtatcaaaagagcagcaggagatgtatgtgcattggagctataattctccttattctcatcctggtagtcattatccccattgccaccagtttcaccaaatcttgatga

SEQ ID NO: 575 - DNA, 1461 bp, Solanum lycopersicum
tcctcaaatcaactccctttaagactacatagaaatttcagagtgaactgtgacaaagaaattatagtatggaggcaattaatgctgtaagattgacacctctatctgttcgttctgataggaaaaatgaggccaagaaaatcccatcacaccccatttctttcccattcaagaatctttgttcagttgagaatttatcaagaaatgttcaagggggtttagtacttgtatcatcagttctaaatacaggcttagctaaagcattaacatatgaggagacaattgaacaatccgaaacaatcccaggtgctgagtttgatgcaactgcagttgtggaaactgtgaccacttttgcatcagagaatcctattattatagctggtggatttgctgctttggctttgccaattgttctgtttcaggttcttggaaagcctcccaagtcatggggtgttgagtctgccaaaacagcttatgcaaaattggcagatgatgcaggtgcacagttgcttgatataagagcaactgcagaattgagggaagtagggactcctgatattaggggtttgaagaaaaagccagttactgttgtttataaggctgaagataagactggtttcttaaaaaaactgtctttgaagttcaaggagcctgagaatactacattgttcattctagacaaatttgatgggaactctgaactggttgcggagttagtcacagaaaatggatttaaagctgcttatgcaattaaagatggtgctgaaggaccccggggatggctgaacagcagccttccttggattcttcctaagaaaacattgggtcttgatctgagcaatctgtctgatgctcttgatggtgttcttggggaaggttctgatgctgttactgtaggcttaggtgttgctgcagctactggtctggggattttagccttctcagaggtagaaacaattctccaacttttgggttcagctgcacttgtccaactggttagcaagaaactcctgtttgcagaggacagaaagaaaactctgcaacaagttgatgagttcctcaccactaaggttgctccaaaggagctggtagatgagattaagcaaatagggaaggctcttcttccagactcggtgagtagcaatgctctacctgcaccagtagaggcaagccctgctgcagccaccagcactgttgaggaaactgaatcagttcctaaagaggatattgcaccgcctaaagtagaagcaatttccccacctactccagaagtcagttcagtccctaacgctgaagtcaaagctgatgcactacctgaaagttcaaggccactctcgccttatcctaattatcctgatctcaagcctccaacatcgccgatgccttcacaaccatagaactggacatgcacaggctgccatatagcctaggtaacaacaagcatagctagctatagcctag

SEQ ID NO: 576 - DNA, 515 bp, Solanum lycopersicum
aatcaatggcttctccaaccctaatcaccccatctacatcaacccccaaatccctcatcaccccaatccgatcaaaactcatcacctccgtaaccaccaccaccatcaccctccgccgccgcgaattcctctctctgtccgccggaatcctatctccatcccttctccttcccgccacgtcagcattcgcagctaccgacgaggaatacgtgaaggaagcatcggaagtgatacagaaagtgagatctacgttgaatatggataaaggagatccgaatatagctgattcagttgctgagttaagagaagcgtcgaattactgggttgcaaagtatagaagagagaaagctttgttgggtcgggcttcgtttcgtgatatatattcggcactcaacgctgtttcgggccattatgttagtttcgggccgactactccgattccggcgaagagaaaggtgagaatcttagaagaaatggataccgctgaaaaggctttaaagagaggaagataataa

SEQ ID NO: 577 - DNA, 533 bp, Solanum lycopersicum
actcaatggctgttttttcaagaaatgtgtttgtaatggcaattctgtttttcagtctattaagcttcacagaagcaagagatcatttggttggtggaaaaactaattcttggaaaatcccgtcttctgaatcggattccctcaatcgttgggctgagaaaacacgattcctcgttggagattctcttgtgtggaagtatgatggggcaaaagattcagtgttggaagtgagtaagaaggattatgtgacatgtaacacatcaagtccaattgcaatgcataatgatgggaacacaaagatagtgttggaacattttggggcatattattttataagtggtgtaaaagggagttgtgaacaaggacaaaaattggttgtggttacgttgtctaagaggagatacgcagatgcaccagtaccgtctccggttgaatttgatggtccagctatagcacctactagcaatggttttagtttgaaggctagtttggttgtggcttttggggttttagtagggttttgggtttgatga

SEQ ID NO: 578 - DNA, 1367 bp, Solanum lycopersicum
gataaggagagcagagggagtctaccttctccctcaatcaaatggctatggctttttctccattaacaacaagtgggtgtagtagttattgcaatcttggattaagctggaaatcatcgagcttgtttgtggaattagggtttgtttcaaatgggtcaaaaggggtttctgctaaacccgcaaagctcaatgctagtaaagtttttcgggcatgtgcttcttcttctaactctgatcctcttttggtgaaggctgcaagaagagaacgggtgagtcgcccacccgcttggatgatgcgtcaagcgggaaggtatatggctgtttaccgaaagcttgcggagaaacatccatccttcagagagagatcagagacaactgatctcattgtggaaatttctttgcagccctgggaagcttttcatccagatggtgtaatcatcttttcggacatacttaccccgctacctgcatttggtgtccaatttgacattgaagatgtaagaggcccagtcattcagtctcccattcgttctgaagagggattgaaagcattgcactccattgacttggagaaactacaatttgtgggagactcacttagtattttgaggaaggaggttggagaacaagctgcaattttgggttttgtcggagcgccttggacaattgctacctacatagttgaaggaggtacaactcgtacatatacgaagattaaggacatgtgccataccgctcctcatgttttgagagctttgttatctcatttatcaaaagcaattgctgagtatattgtgtatcaagtggagtctggagctcattgcatccagatatttgattcatggggtggacaactcccacctcatatgtgggactgctggtcaaagccttatattgatgagatagttggtataattaaaagaaagtgcccacaaacacctcttgtgctctacattaacggaaatggtggacttcttgaacggatgaaaacaactggagttgatgtaattggacttgactggacagttgatatggcagatggaaggcggcgactaggaacagatattggtatacaggggaatgtggatcccgctaccttgttttgtcctcttcctgcattgacagatgaaattaaaagggttgtcaagagtgcagggagtagtggtcacatcctcaatcttggccacggtgtgctcgtgggtacgcctgaagaagccgtagctcacttctttgatgttgctaagagtttcgattttgacaaggttgaagatcatgtatctgaggcagataaagttgtagcttgaagacaacaattttgtaatgcaggctggaagcctaggatgcttggtttcaccttaggtccttag

SEQ ID NO: 579 - DNA, 2170 bp, Solanum lycopersicum
cgtcaaacgtgtccaatccttatcttttctttttttcaagaattcaattgggtatttgtaaaacaacccaagattggattttttttcattgtgtaagaattttggttttgatctgagagtaagagagatggagggtgtagattatttggctgatgagaggaagaaagctggatttgatgtggatgagatgaagattgtttgggctggttctcgtcatgattttgaacttacagatcgtatctctaagcttgttgctagtgatcctggcttcagtaaggagggaagaaccatgcttcctaggaaagagctattcaagaacactctaaggaaggcagcatatgcatggaaacggatcattgaacttcgtctatctcaagaggaagccactatgttaaggcgttacgtagatgagcctgcttttactgatcttcattggggaatgtttatacctgccataaaaggacagggcacagataaacagcaggaaaagtggctgccgctggcttacaagatgcaaataattggctgttatgctcaaactgaacttggtcatgggtccaatgtgcaaggccttgagaccactgccacatttgatcctcaaacagatgaatttgtcattcatagtccaacattgacgtcaagcaagtggtggcctggtggattgggtaaagtgtctacccatgctgttgtgtatgctcgtcttataacagatggtaaagactatggggttaatggttttattgtccaactacggagcttggaggaccacaaacctcttccaggtgttactgttggagacattggaatgaaatttgggaacggagcatacaattccatggataatggggtgttaagctttgatcacgtgcgcattccaagagatcaaatgttgatgagggtttctcaagttacaaaggaaggaaaatatgttcagtctgatattcctcgacaactcctttatgggaccatggtatatgtacggcaatcaattgtagcagatgcttcccttgcaatgtctcgggctgtgtgtattgcaaccagatacagtgccgttcgtagacaatttggctctcagaatggtggacaagaaactcaggtgattgactacaaaactcagcaaaacaggctcttccccttgttggcttctgcatatgccttcagatttgttggtgagtggctgaaatggttgtacactgatgttacccaaagacttgcagcaaatgatttctcaacattgcctgaggcacatgcatgtaccgcaggattgaagtctttgaccaccagtgccactgctgatggaattgaagaatgccgaaagttatgcggaggtcatggttatctttgtagcagtgggcttccagaattatttgccgtttatgtccctgcctgtacttacgaaggagataatgtcgtgctacagctacaggttgcaaggtttcttatgaagaccatttcacaactgggcactggaaagaagccagtaggtaccgtatcttatatgggaagaatcgaacacttgatgcagtgtcgttctgatgtgaaacaagccgaggactggctgaaacctagtgcagtattggaagcatttgaagcaaggtctgccaggatgtctgttgcctgcgctaagaatcttagcaagtttgagaatcaagaagaaggctttgcagaactagcagctgatttagttgaagcagcagttgctcattgtcaattaattgttgtgtccaagtatattgagaagttgcaacaaaacattcccggtaaaggggttaagcaacagctggaggtgctttgtggcatctattcactgttcattcttcacaaacatcaaggagattttctcgggactggctacatcacctcaaagcaggggtcgcttgctaacgaccagctcagagccttgtattcccagcttcgtccaaatgctgtatcactggttgatgcatttaactatactgatcactaccttggttcaattcttggacgttatgatggaaacgtgtatccaaaactgtatgaggctgcatggaaggatcctctcaacaaatcagacatagcagatggcttccacgaatatattaggccactactcaagcagcaactacgaactgctaagctgtgaagcgcgagagctgcagcaaactgttgttctgtgctgtgccaataaatt

SEQ ID NO: 580 - DNA, 745 bp, Solanum lycopersicum
gcctttacccgttgttcctttacattatctattactcaatcttcgaaagaagatagatagatagagagtcgaaaatggcgatttccgtggcttctcttgcttcatcttttgcttccctttcattttcttctcagatttctcaaaaaccctatgctgtatcccttgctcattcgaagcaattctctttctctctcgcttccaaaatctctacgcttgtagtgtcagcttctgttgctgaagcaccggagacggaggaattggaaaccagagagaatcttttgaagcttgtgaaaagtagacttcctggaggtttcgctgcacagcctatttttggaactggtagacgtaaaagtgctagtgctcgtgttgttcttcaggaaggttctggaaaaatcatcatcaactatcgtgatgctaaggaatatcttcaaggaaatccattatggattcaatatgtcaaaactccactggccactttaggatatgaggctagttatgacatttttgtcaaggtggaaggcggtggtctttctgggcaggctcaagcaatttcccttggcattgctcgtgcactcctaaaggttagcgagagccatagaaaaccattgagggaggagggtctgttaactagagatgccagagttgttgagcggaagaaagttggtctcaagaaggctcgcaagcgtccacaattttccaagcgttgagtccaggttggtacttactcactgtggcagcattttag

SEQ ID NO: 581 - DNA, 1019 bp, Solanum lycopersicum
tgttctcttgtttctgccactcaaacatggagtcttgcatctaccatcagctcaaatcccagcctgtatggcttcttttgcttctttctttaggtttcttgaaagtcttgtgcttttcagtcatctttctcaaatgggtctatgtcaatttcctcagacctgctaagaatcttaagaaatatgggtcatgggcacttgttactggacctacagatggtattgggaagggctttgcttttgaattagctcgaaaagggcttaatctagttcttgtgggtcgtaaccctgataaacttaaggatgtttctgaatcgattaaagctaaatatggacagacccagatcaaaacagtcgtcgttgatttctctggtgatttggatgaaggggttaagaagattaaggagacaattgaaggattggatattggggttttgattaataatgttggggtttcgtatccttatgctagatttttccatgaagtggatgataagctgttggcagatttgattaaagttaatgtggaagggactacaaaggttactcaagctgttttgcctggtatgattcagaggaaaagaggagcaattgttaatattggttctggtgcggctattgttatcccctctgatcctctgtatgctgtttatgccgcaactaaagcatacattgaccagttctccagatgcctctatgtagagtacaagaagagtgggattgatgtgcaatgccaggtgccgttatatgtggcaacaaaaatggcgtcgatcaaaagatcttcattttttgttccctcgactgatggttatgctcgggctgccctgcgatggattggtcatgagccaaggtgcacaccttactggccccattctcttctgtggggtgttctatgttcattgccagagtcgatggttgatgcttggcgtctgaacttctgcattggaattcgaaggagagggcagctgaaggattccaggaagaaagaatagaaagcatctcctttacctcattccatatag

SEQ ID NO: 582 - DNA, 917 bp, Solanum lycopersicum
ctaccatgaaggcagcagcagcaatggtgaacactgtcactctctctaactcaacattttggcacaaaccaatttcaagaatcaaccagaattttaaaattagagcatcaatttccacctcaggcaacatggttgctcctgctatcatagttggaggtggacgtgtgggaagagctttacaagatttgggtaatggagatgatgttttggttaaaaggggtgaaccagtacctattgattttgtaggtccaatattggtttgcactaggaatgatgatcttgaagctgttcttgaagctacccctaaatctcgttggagcgatttggtatttttccagaatgggatgctagagccttggttccaaagtaaaggccttggtgatgcagaccaagttttggcatattttgctgtatcaaagcttggtgaacccccaactgatgggaaaactgatacaaatccagaaggattgactgcggcttatgggaaatgggcatctgcagtggctgcaagattgcagaatggaggactctcttgcaaggtacttgataaggagccttttcagaagcaaatgctggagaagcttatatggatatgtgctttcatgcttgttggagctcgccatcctggagcaacagtaggagcagttgaaaaagagtaccgctctgaggtgtcaaaactaattgctgagcttgcggctgcagcagctgcagagaaaggtcttgtttttgaggacgccatggaggacaggctctgcgcttactcacgagcagttgcacactttccaacggctgtcaaggagttcaaatggagaaacggatggttctattcactctctgagaaggcaattgcagaagggaaaccagatccatgcccattgcatactgcatggcttaaagaactaaaaatagtctagtag

SEQ ID NO: 583 - DNA, 674 bp, Medicago truncatula
caaaaatgaagattatatacttccttgttagcatcttggctttggcatcctctcttgcctttgcttatgatcccagccctctccaagacttttgtgttgcaatcaaagaccccaaagatggtgtatttgtgaatggaaaattctgtaaagaccccgcacttgttaaagctgaagatttcttcaaacatgttgaagctgggaatgcatctaacgcactaggctctcaagtgactcctgtcactgtagaccaactattcggacttaacacacttgggatatctttggctcgcgttgattttgcgcctaagggtttaaacccacctcacatccaccctagaggaacagagatccttatagtacttgaaggcactctttatgttggatttgtcacatcaaatcaagacaacaatcgtctctttaccaaggtgctcaacaagggtgatgtgtttgtgttcccaattggtcttattcattttcaactgaatgtgggatatggcaacgctgttgctattgctggacttagcagtcaaaatccaggagttatcactgttgcaaatgctttgtttaaatcagatcctcttatttccgacgaagttcttaccaaagcttttcaagtggataagagcataattgattatcttcaaaaacagtcttggtatgacaacaactagtag

SEQ ID NO: 584 - DNA, 1828 bp, Sorghum bicolor
cgatagtcagattgtgctgtgcggctgtgccgctctgtcagtctcggctgtgagcctgcctgacccagacacacacacacacacacacacacacgagggagagggagagggagagggagggccggccagcgacaccacagcatggcggcggccatcctagcgcccaagccgcctccttcgctgcctacaagcgcctttccttcctccttcccctccccctcgcggctctgcctctccccgcggcatcccctgacaagattgctcctccgccccattccgtgcgcctcatcgccgtcctcctccgtcttgatgccggacccggacccggacctcgagcctgagcctgcccacgatagagatagagcccaagacgaggcgccggagtccaggccccgccgcatcgccctcttcgtcgagccttcgcccttcgcctacgtctccggctacaagaaccgcttccagaacttcatcaagtacctccgggagatgggcgacgaggtgattgtggtcaccacgcacgagggcgtgcctcaggaattccacggggccaagctaattggctcatggagcttcccttgcccctggtatcaaaaggttccgctgtcgctggccctcagtcctcgaatcatcggagaagttgctagattcaagcctgacattattcatgcctcttcccctgggataatggtatttggcgcgcttatcatagcaaagttgctctgcgtccctctggtaatgtcataccacacccacgttccaatttatatacccagatatacattcagctggcttgtcaagcccatgtggctaattataaaattcttgcaccgagctgcggacctcacgctggtaccatccgttgctatcggcagggatcttcaagctgcccatgttacagcagccaataaaatacgcctttggaacaagggtgttgactcagaaagcttccatcctcgttttcgcgatatggaaatgcgttcaaggctaacaaatggcgaaccagaaaagccacttatattttatgttgggcgcttaggagttgagaaaagcttggattttcttaagagagtcatggaccgacttccaggagcaaggatcgcatttattggagatggcccattcagggctgagcttgagcagatgttctcaggtatgccggcggtgttcacgggcacgttgcaaggggaagagctatcacaggcctatgccagcggggatgtgtttgtgatgccttccgagtcagagacgctgggttttgtggtgctggaggccatgtcatcgggaattccggtagtgggggctcgcgctggaggaattcctgatatcatacctgaggatcaggaggggaagaccagctttctgtacacaccaggggatgtggatgactgtgttggcaagatcgggcagcttctgtcaagcgaggagctgagggaggccatggggagggctgccaggaaggagatggagaagtttgactggcgagcagcaacgaggaagatccggaacgagcagtacagtgctgcgatctggttctggcgcaagaagagggcacagctgctgcgacccctccagtgggcgctgcggctgctgaggccgacaacgtctggggctgccattgccgatgccatggcgaagcaatcataggaggcggctattatggttgatggtcccttttccttgtataaaatgggcgaagggcgctatgggcagaggggaggaagctcaagcttcagcattccgattcactgaagatgtaatgaacagtttaggattgttagatttgtaaatcgtccgtgtcaatgtaatgcttcttcttggcttgctacac

SEQ ID NO: 585 - DNA, 2885 bp, Helianthus annuus
acccaccaccatcaaacgccaccatggtgtcatctcatttgacacccattttatacctcacattgttacttgttacattttcatgtgtatgttctaagactagtaaaccaccggttgcacccaccaagatcggtaatgggtaccggttggtctcacttcaagagtcaccggatggtgggcttgttggtcatcttcaggttaacaagcaaaacaagatttatgggccggatatccctcatttgcaattgtacatcaagcatgaaaccgacgaccgtttaagggtacacataaccgacgcacaaaaccaacgatgggaagtaccatacaaccttttaccaagaacacaaccaccaacaccatcacaacaacccttcacccggaccttaaaaaacccgataaccgtatccgaatcctccggaaacgaactaatattcagctacatctccaacccgttctcattcgccgtgagaagaaaatccaacggccaaacaatcttcaactcatcatccgacggatccaactcactagtcttcaaagaccaatacattgaaatctcaacaacattacccaaaacggcgtcgttgtatggtcttggtgagaactcacagccacatgggattaaactctacccgaatgacccgtatactttatggactacggatcaatcagctattaatttgaatatggatctttacgggtcgcacccggtttatatggatatgaggaatgtgggtggggacccgtatgcccatggggttttgttgttgaatagtaatgggatggatgttttttataggggtgattctttgacgtataaagttattgggggtgttttggacttttacttctttgcggggcccacgccgttagcggttgtggatcagtatactcagcttattggtcggcctgctgctatgccttactggtctctaggatttcaccaatgtcggtggggttaccacaatctttcagtggtggaagacgtggtggaaaattacaaaaaagccaacatcccattagacgttatttggaacgatgatgatcatatggatggtcacaaagacttcactctaaaccccaatgcttaccctagacccaaactccttgatttcctacaaagaatacacgcccgtggcatgaagtacattgtcattatcgaccccgggatcggtgtcaacacgtcttacgggacctaccaacgaggtctcgctaaagacgtgtttattaaatacgaggggaagccgtatttggctcaagtgtggcctggggcggttaactttccggatttccttaaccccgcgacggttgcgtggtggggagatgaagtccggaggtttcatgagctcgttcctgtcgatgggttgtggatcgacatgaacgaggcttctaatttttgttctgggttgtgcacgcttcctgaaggtaagcagtgtccaaccggaactgggcccggttggatatgttgtttggattgtaagaatataacaaagacaagatgggatgatcctccttataagattaacgcgtccgggacgcatgttcctatcgggtacaagacgattgctacgagtgcggttcattataatggcgttcgagagtatgatgctcatagtatttacgggttttctcatgctattgcgactcacaaggcgcttcaggggcttgaagggaagcgcccatttatcttatcccgatccacatttgttggatcgggtcattacactgctcattggaccggtgacaaccaaggtacttggaatgatattaagtactcgatatataccatgttgaatttcgggatttttggaattcctatggtcggttcggatatttgcgggttttacccgcaaccaaccgaagagctatgtaaccgttggatagagttgggtgctttttacccgttttcaagagaccatgcaaattactattctccaagacaagagctttaccaatgggaaacagttgcaacatccgctcgtaacgctttaggtatgcggtacaagttgcttccttacttgtacactttgacttacgaggcgcacaccactggcgcacccatcgctcgccctctctttttctcattcccaaccatccaagaactgtatggattgagcacacagttcttacttggtgagagtctgatggtctcaccagttcttgaccagggtcgaaccaacgtgtcagctgtgttccctcctggaacatggtacagtctgttcgaccccagtcaagcaatcgtttcaaaagatacccaaactttcaccttggatgctcctttgcacgtgatcaatgtccatttatatcaaaataccattcttccaatgcaaaggggaggaatgatatccaaagaagcaagaatgacaccttttacccttatagtaactttcccagcgggggccacggatgccaaagcgaaaggaaagcttttcctcgacaatgacgagcttcccgagatgcaactcgggaacggtcaatcaacttatgttgagtttagcgcgtccacgtctaaagaaatggtgaaagtgtggtcggatgtgcaagagagtaagtttgcgcttgacaaaggttgggttattgagaagatttgcgtgttgggattaagtggcgtcggaagtgcgtttagcatcgaggtcgagggtaattcggacattttggacgtgtcgaatgtggagttggcgcaaaccgagcataagtttatatacggagcggaggacatgaagagtgtgatggtagaagttggagggttggatctaccagttggtaaaaagtttacaatgtcatggaaaatgggaattagttagttcttaaggggcttgtttgcaaattacatgttcttttgtaccgtttagattgttgtgtacttggtagttggtagggtgcttgag

SEQ ID NO: 586 - DNA, 3938 bp, Hordeum vulgare
gtcggagagcttgaggtggctgcagcacagctcgtccgccgccaaagatgttctcgccggcgatcaggaagccccacctccaccgcagggagaaggaggaggcgaccccttcaccccctcctcctgctcccgtccactccccttcgcccggtggattcgccctctccgaccgccccgccactggcaccccggccccatggacctcctcctccctccttgccaggatttcgacatcaaagcagacagacagggctggcgattctggccagatccaaccagtgcacgtagcagagtttccccaagttgtgaggaatgcacaagccaaccttctgcagaagaattttgcaggcaagagtatgcttgtaggcggcattgacaaagaaacatcccttgcatggatgatatgtggaaatgagctttttgtctggagctacttggctgctgttgcaaaagattgtcttgcacttgagatcccgtcttcgcttgtgggagacaaagacggaaaacccctctctggtaaccagtggacggtttgcatcatgagatggcatagtagtggtccatcaacaaggaacagtggagatatgttgcaccgaagaagttcgactggtgtcatcctgtgcaacggaagaacacaagctattgcatattggcctgatatctatgatgaaagtagtagcaagggtccagttcttagtttatttggccagactggcacgtctgcaagtgatgccatatctggatgttacaggtttaactcgctaattgcagcttccgttccaggagccgctcatgaatgtattgcggttgcttctgagccaacaggtgctttatggttgtttcagtgttcaccactgggtattcaccgaagaaaagtccatcatgatacattagaagataatggtactgatcattctcagaaaaataatggtggaagatccttggtttggctaccaagtaatgaatcatccgaggctgctgaatggaagttctttttgttgaccagccatgggatacaatgttggggcatctcactcttgcatggcatcaatgtaaaaatattagggtctcaggaaattgttggtagtgatggtgagttgggcataaaaaaggacatagctggtcaaaagaacatttggcttttggacatgcagatagatgagcgtgggaaggaatttaatattcttgttgctaccttctgcaaagatcgggtgagtgggtcaaactacactcagtattcacttctgacaatgctgtacaaatcaaaccaaaaatttccatccgaaaacaacgtggttaaatgtgaaaggtttttggagaaaaaagctcctgctcaggtaataatcccgaaagctcgagtggaagatgaagaagttttgttctctatgaggctaaaaactggcggcaagccttctggctcagtgatcatcttatcaggtgatggaaaagcaacggtggccatctattggaggggctctacccgactgtatcaatttgatctgccttgggatgctggaaaggtttttgatgcttccattatcccatcttctgaggacagagatgaaggagcttgggttgttctgacagaaaaggcaggcatctgggcaatacctgaaaaggctgtattagttggtggggttgagcctccagaacgcagcttatcacgaaaaggtagctgtaatgaagcggtcgctgaagagaaaaggagaagtcaggcattcagtgccagtattgttcccagaagagttagctctgaggcttggagtgctggagacaggcaaagaccaacattaactggcgtagctcagcaggctgtggttgatgaagaggccgagatgttacttaatcggctgtttcatgattttattttgtctggtgctgttcatgaggcacttcaaaagcttagagtagcaggggcatttgagaaagagggtgagatgaatgtgtttgttcgagtaagcaaatctatcgtaaacacattatctaagcactggacaacaactagagaagctgaatttcttgcttcaacaattgtttcatcccttgctgagaaacgtcaaaaacatgagaaattccttcaatttcttgtcttgtccaagtgccatgaagaactctcttcaaaacaaagagctgcaatgctaagtgtcatggaacatggagaaaaactctctggaatgatccatctgagagaattacaaaatgcgcttagccagcagagttcaagcacacgtttatcacctcagtctaaaaccccaactgctggtgcactgtggaatctcattcagctggtcggtgagaaagctcgacggaacactgttctattaatggaccgtgacaatgctgaagttttctacagtagagtttctgatatagaggatctattttattgtttgtcgcatcaacttcggtatattataaccggagaagaacacccatctgttcagatgcaacgtgcacttgagttatcaaatgcttgtgtgaccttagttcaggcagcattgcactacagagcagagtacaaggactggtatccttctcctgaaggactgacaacatggaacagtcagcctgtagtgcggtctggaatttggagtctggcatcatctgtgatggagcttttgagagaatcaggatctgcaggcatgccaatgaaatctaatctatggtctcagctggaaggactcacagatatgctactggagggatatattggtctattaactgccaaatttgaacgtggggaggaccatggtgtgctagcccaagaatactgtgaacggagagatgaacttcttggatccctttatgaccttgcaaagcaaattatagaagcaaaatatcaggagtcaagagaaggcaatgacaatcctaatctgaaagaatctatatttagagaggtcacttctcctattttggcaacagctaaacggcatgaagggtaccaaactttgtggcagatttgctatgatatcagtgatacggttctcctccgcaatcttatgcatgatagtgtaggacctcatgggggattcagtttctacgtttttaaacaactaatcaacagccggcattacgcaaagttgttaaggctgggagaagaatttcaggaagagctagctaattttctgaaagaccgcagcgatcttttgtggcttcacgagatatgtttaaatcagttctcagctgcttcagagactcttcatacctgtgctctgctttcaagtccgggagaagatgttgacctaacaagcaccagaaagtcgatgtcctttgttgaaagaagacgtctcctctatctctctaaaattgctgcaaccgcaggtaaggatgttgattatgaagtgaaggttgcacagatagatgctgatatccggattctgaaacttcaggaagagattgttcagcatgatccagaatatgcacagggcaaacatacaagcaagcttcttaggccatcagaactgatcgagatgtgcatgaagagaggccgcgagctctctctcaaagccttcgaagtattcgcctggacaggctcctcgttccgaagctccaacaagggcctcctagaggcatgctggacgaacgcggccgaccaggatgactgggtcgagctctcacaggcatcagtttcagagggctggagcgacgaagtcatccaagaatctctccaaggaatggtcctcttcaatgcttcgaggctgtgctacagcccggacgcggtggtgttcgacggcacgttcgaggaggtgctgcccgtgaggaaagaggacgtgcacgcgagaggcctggaggctaagtgcttctcggtggaggaggtgctgatgcagcacgacacttttccggacgccggtaagctgatgatgacggcggtggtgatgggcaaggagctatcctatgctgccccggcagatgagcctgtggacatggactcgtgatga

SEQ ID NO: 587 - DNA, 758 bp, Hordeum vulgare
gttatgctagtttgtgtctggtcatcttttcaaaatggtgaagctgacaatgatagcccgcatcactgatggccttccattggcggaggggttagacgatggtcgagatctgaaggatgctgacttctacaagcagcaagcaaaactgttgttcaaaaacttatctaaaggccaacacgaatcatcaaggctgtcaattgagactggaccgtactatttccattacatcattgagagccgtgtatgctatttgacaatgtgtgaccgttcttatcccaagaaacttgcattccagtatttagaagatctaaaaagtgagtttgagagggtcaatggcagccaaattgaaactgctgcaaggccatatgctttcatcaaatttgatacattcatacagaaaaccaggaaactgtatttggataccagaacccaaaggaaccttgccaagttgaatgatgagctctacgaggtgcaccagattatgactcgcaatgttcaagaagttcttggtgtgggtgaaaaactagatcaggtgagtcaaatgtctagtaggttgacctctgatacgagaatgtatgcagacaaggcaaaggatctcaatcgccaggccttaattcggaagtatgcccctgtggccattgtgattgggatagtactgatgctcttttgggtcaagaacaagatatggtgaccgagtgaagctcgacatccttcactgtgacgccgagaattctatgtcaacagatgcttctacagct

SEQ ID NO: 588 - DNA, 971 bp, Setaria italica
aggccgaggaacattaatctgggaatggtggctgacacagaaagctcagattcactacctggaagttcaaatgctgctgctgagacgcctgttcatgggtctcttgatcaaagatctcaggaaaagactccaaagaaaactcataaagctgaacgagagaagctcaagcgtgatcagttaaatgaactttttcttgagctcggcagtatgctagatcttgatcgacaaaatacaggaaaagccacggtattaggtgatgctgcgcgagtactgcgagatctggttactcaagtagaatctcttagaaaggaacaatctgctcttctatcggaacaacaatatatcagttcagagaagaacgagctgcaagaggagaatgctacactcaaatcccaaatatcagaactagcaaacgatctctgtgcaaggatggggagtagcagtctcagtctaagcagtcctgggatgtcacatccagtggcgaacgctacaagtcctgatttggcgactcaccccatgccacatcacatgtggggcaacattcctaatttaagctctgtagccatggcgcatcaaacgactacagtatcaccagtgcacagtcagcatcactctgccaatgatgttgaagtttatgcaccgccgcctcaggagctgcagctctttccagggacatcctcatcaccagagcatgaatgttcaggcatcagaagcgcagcaaccaactcttcaagcctgacagattctttgccagggcagctttgcttaagccttacacaatcatcgcaagaagaaagcagcagcggtgtgttgggcagaagaaaagaacggtgaaatgcttagcagattgctgatgctggaatcagtatttggtggtagtgattgccctgtaaatgctgagaatcccctcccttcactgattcagaactaatgctataggtgccctgtactgaactgtgactctgtagcgc

SEQ ID NO: 589 - DNA, 1621 bp, Setaria italica
gacagagacctgtgatggtggccgcggtgcgcgccgccccggcgctcgccgacaagccgccggggctcgcgatgctggaggtggcggcggcggcgggggaggaccggctgtcggacgccgagacggcgtcgtcgacggcggcgcccaactccagcctcagctcggccagcagcgccggaagcctgccgcggtgctccagcctctcccgcctctccttcgactgctccccctccgccgccctggccgctgccgcgtgttcgccgccacccgcgccgacggcgtcgcggccgcaccggtcgggcgacgcggcgtgggcggcgatccgcgcggcgtccacgtcgtccgcggcgccgctcgggccacgggacttcaagctcctgcgccgcgtcggcggcggcgacatcgggaccgtctacctctgccgcctccgctcccccgcggccgcggccggaagggagagcccgtgccacctctacgcgatgaaggtggtggaccgccgcgtggtggcgaggaagaagaagctggagcgcgcggcggcggagaagcggatcctccgggcgctggaccacccgttcctgcccacgctcttcgccgacttcgacgccgcgccccacttctcctgcgtcgtcatggagttctgccccggcggcgacctccactcgctccgccaccgcatgccctcccgccgcttcccgctcccgtccgcccggttctacgcggcggaggtgctgctggcgctggagtacctgcacatgatggggatcgtgtaccgcgacctcaagccggagaacgtgctcattcgcgccgacggccacatcatgctcaccgacttcgacctgtcgctggagtccacctcctccccgtcgctcgagtccgccgccggcaacgacgccgcggccgctggcgacgcatccacctccgcgtcctgcttcccggaccacctgttccggttgaaacgccggcgtcgccgcgccgccgcgcgacagacgacgacgttcgtggcggagccggtggaggcgcggtcgtgctcgttcgtgggcacgcacgagtacgtggcccccgaggtcgcccgcggcggcccccacggcgccgccgtggactggtgggcctacggcgtgttcctctacgagctcctccacgggcgcaccccgttcgccggcgccgacaacgagtccacgctccgcaacatcgcgcgccgcccgctcgcgttcccgcccggatcgggctcctgcggccccgccgacgccgcggccagggaccttatcgcccgcctcctcgacaaggacccggctcaccgcctcggctcccgccgcggcgccgccgacgtgaaggcgcaccccttcttcaaaggcctcaacttcgcgctcctccgggcctcccgcccgcccgtcgtccccggctcgtcgcccctgcaccggtcccagtcctgccacgcggcgccgccgccgacgacgacgacgccgggttctacgctgccccgcaagaagccgatgccgacggcggacgcgcggttcgacctcttctgacccgctgtccggcggcgccattgccggcgggagacacgcccccccggccgcgacgtcacgcattgacctagcgagcatcagtcaccattgtacac

SEQ ID NO: 590 - DNA, 839 bp, Zea mays
cacagatgttgccgtaccctaacaaccctcaccatttcggcgtctcccaagaactcccacacccaaaccctacggccggcttccccatgcctccaccgggcgcgcatctggatcagcgctactacgtggaccatcacttctttcccggccacggtcactgcttcaactccgagactctggaggcggtgctgaggccggcgcgcgctgccccagagtgcgacgaggccctagtagtcacggcgccgcaggcgggtggaagaagaaacggtagtctgcctgccgccgccgccgccggccagggccagggccagggccacgcccgagcgcggaagcgcccgttccggacggaccggcacagcaagatccggacggcgcagggcgtgcgcgaccgccggatgcggctgtccctcgacgtcgcccgcgacttcttcgctctgcaggaccggctcggcttcgataaggccagcaagacggtggactggctgctcacccagtccaagccggccatcgagcggctcgccgccgccaccgagccctcccaccagcggagcgacgacgcagctttctcacccccaacgtcaggggtggctgatgtgtcagctggtaataagagcggaggagttgccgagaagttgggccgctccagaagtgggggatccgcgtccatggagatggagcgcgcctgcgggctggaccgcctcgtgtcggccgcaccagtgcttcgtgagtactactacggcctcagcgagatgatgagcaacgacaacggaggagatggcgacgacgacggtgagtacgaggaagacggtgatttcctggacggtatgcaatattagtag

SEQ ID NO: 591 - DNA, 789 bp, Oryza sativa
gccaagatgacgggatttggatcgccgtgcggcgcgtgcaagtttctgcggcgcaagtgcgtgcgcgggtgcgtgttcgcgccatacttctgccacgagcaaggggcggcgcacttcgccgccatccacaaggtgttcggcgccagcaacgtgtccaagctgctcgcccacctgccgctcgccgaccgccccgaggccgccgtcactatctcctacgaggcgcaggcccgcctccgcgaccccatctatggctgcgtcgcccacatcttcgccctccagcagcaggtgatgacgctgcaggcgcagctggcgtcgctcaaggcggcggcggcgcaagggatacaccaccaggacgtcggcgccaccaccaagggcggctacatgagcgccgccgccaccgccgccgacgaccaattagggtacggcggctacaaccagtggtgcggcagcaatgggggcggcgcgccggcggcgtcgcagccgggcgcgtatagcagcaatggcggcgccggccacggccacgactccatcaccgcgctgctggcggccgggtcggactacatgcagcactcgctgtaccacgcgttcgagcactcggagggcgccggcgccgtggacgacgggcacgcggccgccgcggccttcgaggcggcggcggagtcgtcgtcgtgcggcatggcggcgtcgttcgccgccgacgagagcgtgtggaggtcgtcgtcgtcgggataccaagattgcgaggatctccagagcgtcgcctacgcttaccttaaccgctcgtaatga

SEQ ID NO: 592 - DNA, 1497 bp, Sorghum bicolor
cagcgatccagagagaagctactagcatagccatagccatagcagcatgggggtggccggcggcggggggcggctgcgtgcgagcagcgcgaagaagcagcggcagcggacgctgaacaacatcaagatcacgctgctgtgcggcttcatcacggtgctggtcctccgcggcacggccggcttcaacctcctgatcagcggcggcgacctggacggcgcggcggcggcggcggcggacgccaaggtggtggaggacgtggagcgcatcctggccgagatccgctccgactcggaggcggacgacgtcgtgttcgtggtcgaggacgacggctcatctctgccgtcgtcgccgcggcgcaacgagacggcggcgagcttcggcaacttctcggcgtcggcgacggtggtgaaggtgcgggagtacagcctaggtcccaagctgacggactgggacgcgcagcggcgtgagtggatgtcgcggcacccggagttcccggcgctcgacccgcggcgtggtggccggccgcgcgtcctcctcgtctccggctcccctcctggcccctgcgacaaccccgtcggcgaccactacctcctcaaatcgaccaagaacaagatcgactactgccgtctccatggcatcgacgtggtccacaacatggcgcacctggacccggagctgacggggtactggtccaagctccccttggtgcggcggctcatgctggcgcacccggaggtggagtggatctggtggatggacagcgacgccatcttcacggacatggcgttcgagctcccactgtcccgctacgacggcgccaacctcgtcatccacgggtacccggacctgctgttcgagaagaggtcatggatcgcgctcaacgccggcatcttcctcctccggaactgccagtggtcgctggacctgctggacgcctgggtgcccatgggtccgcgaggaccgtcgcgcgtcgaggcagggaagctgctgacggcgagcttgacgggccggccggcgttcgaggccgacgatcagtcggcgctcatccacctgctgctgatgcagaaggagaggtggatggacaaggtgcacgtggagacggagttctacctccatggattctggacggggctggtggacaggtacgaggagatgatggaggagcaccacccggggctcggcgacgaccggtggccattcatcacccacttcgtcggctgcaagacctgcggcaggtacgaggattacccgctggaccggtgcgtcaggggcatggagcgcgccttcaacttcgccgacaaccaggtgctccggctgtacggattccggcaccgctcgctcaccaccgccaaggtcaggagggtcaccgacccggccaccaacccgctcatggcaaaggaggcggcgctcaagatggacgccaagttctccagcaactagaagacacagagttatacgagttttgaattttgattgagcaagcagttcttttgcgt

SEQ ID NO: 593 - DNA, 1491 bp, Glycine max
aaacattcgcgtgattcctgaaaaatacaaaatttgaggaacatttgtctctcatcaatggctgccacgagaccggtgcagtgtttgttacgaagggtttgcagaggaagtaggactattggggttgccacagaagttaatgcttcttcttcttctcagaaaatcatcgacaaggaatatgaacacagtgctcacaattaccatcctcttccgattgtatttgctcaagcaaagggaacctctgtttgggatccagagggaaacaaatatcttgattttctatcaggttactctgctgttaatcagggacactgccatcctaaaattctgaaagcattgcaagaacaggcagaaaggttgactgtgagctctcgagccttctacaatgatcgcttcccagactttgctgagtatgtgacaaacatgtttggttatgatatggtacttcctatgaataccggtgctgaaggtgtggaaacagcactgaagttagcacgaaagtggggttacgaaaagaaaagaattcccaaagatgaggctattattgtctcatgttgtggctgcttccatggtcgtacactaggtgtcatatctttgagctgtgacaatgaagctacccgtggttttggtcctttattacctggcaatcttaaagttgattttggtgatgcagaagcccttgaacaaatttttaaagaaaaaggagagcacatagctgcatttattttagaacctgtccaaggtgaagctggggtgatatttcctccagatggttatttaaaagctgttagagatctttgctccaaatataatgtcttgatgattgctgatgaaattcaaactgggttagcaagaacggggaagatgctggcttgtgagtgggaagaagttcgcccagatgttctgatactagggaaagcattgggtggaggagttataccagttagtgcagttcttgcagacaaagatgtgatgctttgtatacaacctggacagcatggaagtacctttggtggaaatccaatggccagtgcagttgcaattgcctctctagaagtaataaaaaatgagagactcgttgagagatctgcccaaatgggagaggagcttactggtcagctgcttaagattcagcagcaatacccagactatgtgaaggaggtacggggaagaggattgttcattggagtggagtttaacagcaaaaaattgttcccagtatcaggctatgagctatgcaaaaaattgaagtatagaggagtccttgccaagccaacacatgatgcaattatccgctttactcccccactttgcataagtgtggatgagatccaacaaggttccaaggcactggctgatgttctggaaattgatctaccaaagttgcagaagacaaagccaatagatgctgctccagttgccactagtgcatgcgatcgttgtggtagagtcttgtattaaccataaaaagacacgtatgaattgcatgtg

SEQ ID NO: 594 - DNA, 2543 bp, Glycine max
gaacgggttgtaataatcactgtgaatttgggcattctggatgacaagggttgtccagatgagtgttgatggcgacagcaaagagctgaaagaactgaatcagcgcttacgagatgggaagaagattgctggtggggagcatggtttatgcgaggaagtgaaatgtaatggaattgctgaagaagttaaggttgaacagggggggactgtggagtcctcctctgtccagcagcatataccacagcctcaaggggcaataatttgttgggagaggtttttgcatattagatcccttaaggtcttgcttgtggagattgatgactctacccgtcatgttgtcactgcactgcttcgcaattgtagttatgaagttattgaagcagcaaacggattgcaagcttggaagatattggaggatttaaccaatcatattgatcttgttttaactgaggtggcaatgcctggcttatcaggcattggacttctatacaagattatgggccacaaaacccgcaaaaatattccagtagttatgatgtcatctcatgattctatgggtttagtctttaagtgtttgtcaaagggtgctgttgactttctagttaaacccatacggaagaatgagcttaaaaacctgtggcagcatgtttggagaagatgtcacagttctagtgggagtggcagtgaaagtggcacacaaacccagaagtctataaaatcaaagagtcttgagaagtctgataataattctggaagcaatgacgaagatgataatgaaagtataggcctgaataatgtggatggaagtgacaatggtagtggcactcagagctcatggaccaaacgtgctgtagaagttgatagtcataaaccagtttcccagtgggatcaaatagctgagtgccctgacagtacctgtgctcaagttgttcactccaatgctgaaatgggtgggaacaaggtggttcctctagctgcaaaggattgtgcagaacagaatgaacaacttgtcaaaactgcaggttctcaacatagcaatgcacctgatgtcggcccctctaaattcagtgagcaaattaatagaggacaactggaccttaattgtgaaaatcaatctagcaagctaaggtgcaaaggtttatcactgtctgatgccattactagtacttgtgattctcagatgcatagtggagaatttgaagccctaaataaaaaacccaagtcctcagatattgaaaataaaggtactaataatgatgaagaattgccatctcttgagctcagtttaaagaggcttagaggagttgaagatgctgatattacaattcaggatgaccggaatgttttaagacgttctgatcagtctgctttctcaaggtacaatgcagcctctaacactaagaaatctcccactggatgtgttggaagcaattctccttataataatagcttagaagttacaaagaaagattcatctcgtgatattcaatctcattcttgcggcaatcctcctaaccaaaactcaaatggtgctagcaataacattgatatgggttccactactaataatgcttatgctaaatctgcagttatgagtgagccagcaggggcatcaacaacaaaatgtttgtaccaaacatctgctttccagcctgtaaaaaacagccttgtttgtacctctcaacaagttgtcttaaataatactgaagatatgtcggcaacaattctggcaccacctaaactagacagacataaagattctgcagctctggacttccatctccattgtgaaaaccataactgtattgctgacaacatgaagcatcagctgccacctgatcatgatgctgaatctataaagaaaatggctactgctgctccacattgtggatcatcaaacgtggaagaagtgctagttgaaggtaatgttggaaaccacagtatcaatagaagtgtttcaggcagcaacaatggaagcaatggacaaaatgggagcagcacagcagttaatgctggagggacaaacacggaaagcaacaatggactcactgggaatagtggcagtggtgatgctagtggaagtggaagtgccaacagagtagatcaaaacaagacttctcaaagggaagtggccttaactaaatttcgccaaaagagaaaagagagaagggagaggtgctttcataaaaaggttcgatatcagagcagaaagagattagctgaacaacgacctcgatttcgtggacaatttgtgcgacagacctctaacgaaaatgcaagtgaggcaacaacagatagctgattcagagcattggccacaatggcataatgatggggatatgcgaaaaaaggttgaggagtcttcatgtagaatttgggaattattctgtgtgttgtgttaatgtataaagaccctggttattccaacttgttcatttggaacctgaatcaatttatgtggaaagagattgttatgccgattgatgctcggataacttactgtaatttaagttactttttcctcgatcttgtgcttgaatcaa

SEQ ID NO: 595 - DNA, 865 bp, Glycine max
attggaaatggagaaggcaagcctgtgccacaggaacactcctctcccacttcttaatcgcccttccaattttcttcaattcaagcaccaaaactccttcctcaagttcccgaacccaaacctccatcgactgcgcaggctcaattgctcagtatcagacggcaccgtttcgtcttcgcttggtgccacggactcgtctcttgcggtgaagaagaaagcagcagaggtgtcttctgagctcaaagggacctccatatttctggttggtttgaagagctctcttaaaactagtttggggaagctgctggctgatgcattgcggtattattatttcgacagtgatagtttggtggaagaagctgtaggtggtgcactggctgcaaaatcattcagagagagtgacgaaaaaggcttctatgagtctgagactgaagtactgaagcaattatcgtccatgggtcgactagtggtttgtgcaggaaatggcactgttacaagctccactaatctggcccttctgagacatgggatttcattatggattgatgtgcctctagattttgtggccagagatgtaattgaagataagagtcaatttgctccatctgaaatatctatttcaggatcatacccagaggtacaggatgaactaggtgctctgtacgataaatacagagttggatatgctacagctgatgctattatttcagttcaaaaagtagtttctcggctgggttgtgataacttagatgaaattacaagagaagacatggctttggaggctcttagggaaattgagaagttgaccagagtaaagaagatgcaggaagaggctgcaagaccattttaaccagcttggacatga

SEQ ID NO: 596 - DNA, 792 bp, Sorghum bicolor
acagtgtagtagttgcacctaggcgtccgcgcgtcgtcgtcctagctatggatccatatcactaccagactatgtatgacccacgcggcttccccatcatccacccgcagccgccgtacctccaccacccggtggcggtggccggcgccctcagcgacagcagggtgcgcggcggcggcggaggcggtggcgtgcggcggcgtcctggtgccaagctctccacggacccgcagagcgtggcggcgcgcgagcggcggcaccgcatcagcgaccgcttccgcgtgctgcgcagcctcgtccccggcggcagcaagatggacacggtgtccatgctcgagcaggccatccattacgtcaagtttctgaaggcgcagatcagcctgcaccaggccgcgctgatgcagcacgaggaagggtgccatgctgagctagccgccgcctactccgcggcggcggcggcggtggctggtgacgacgaggtgacgctcgcgtcccacggtcgtaccggcgcatgcgatgaggtgatgcagctccagcttcaggtgccgggggaggaagctttgagttatggtgttgttgctgcccatcagccgtacgggctcgatcccaggcatcagctgagtggtgggcacgagctgcctccgttgcctgcttcttgcatcttcgtcgaggagcctgcagacgcatgctactctgtgtgtgacctcgacgacggggagactggtctgcccgccggctcttactagtatagtagtagtggtagtttcttaaggtagcactagcatcccgtgt

SEQ ID NO: 597 - DNA, 1443 bp, Hordeum vulgare
tatcttttccctccctcctctgtttctctgtcccggcgcctgcgcaggggagaggcgaggcagccaatggagattttttactaccttgtgttcgggggcctgtcggcggtggtggcggggctggagctgggcaagagcggaaaggaccgcgtcgccaccaccaccgcattcaacgctttcaagaacaactacgtcctagtatactccctaatgatgtccggcgactggcttcagggcccctacgtctactacctctacagccagtacgggttcgacaagggcgacatcggccgcctcttcatcgccggcttcggctcatccatgctattcggaaccatagtaggctcactagcagacaggcagggccgcaagcgcgcgtgcatcacctactgcgtcacctacatcctcagctgcatcaccaagcactccccgcagtacagggtcctcctcctcggccgcatcctcggcggcgtcgcaacatccctcctcttctccgcattcgaatcatggctcgtagccgagcacaacaagagaggctatgacccgcagtggctgtccatcacattctcaaaggctatattcctcggaaatggtctcatcgccattatagctgggctgtttgctaacctgctcgctgacaacttgggcttcggtcccgtggctccctttgatgccgctgcgtgcttcctggcgataggcatggccatcatcatgtcttcatggagtgaaaactatggagatcaatctgaaggcaaggacttgatgtcccagttcaaggttgccgctaaggcgattgcttcagatgagaaaatcgcattgctgggagccattcagtcgctgttcgagggctcaatgtacacctttgtcttcctctggactccagcattgagcccaaacgacgaagacattccccatggctttatattcgctaccttcatgctgtcatctatgttgggtagctccattgcctcacgcctactggcccggaaaatgaaggttgaaggttatatgcagatcgtgtttgcagtatcagccttcacccttttcctcccagttgccaccagccttctggtgccggcgtcttcagtgaaaggaagcggcatatcgttcggtggctccctgcagctgcttggtttctgtacctttgagtcatgcgtcggcattttctggccatctatcatgaagatgagatctcagtatatccctgaggaggcaaggagcaccatcatgaacttcttccgcataccactgaacctgtttgtgtgtgtggtgctctacaatgtgaatgctttccctatcaccgtcatgtttggcatgtgttcaatcttcctcttcatggcggcaatcttgcagagacggctgatggttgtggctgacctacacaagctctcgacaaaatcacaagagatgaccggggaagacgagccgctaaatccttaataa

SEQ ID NO: 598 - DNA, 2410 bp, Phaseolus vulgaris
tcacttctactacagccactcacctaagtggctgcctttggttttggttttggttgaacctttaagcttaacttaagacatggcatcatcatcctctctgcatctgtctcaggcccttttggctcgtgctgtgtaccttcatggctcttcttctgatcgtgtatcactctccttcccatcattctctggcctcaagtcacattctccatgcaaagcagccaccttttctgcaggttcacgcagaaggggtgcttctaccagtgttgttcgagccactgctgttgagacactggaccagaccactgaggtttctctggtggagaaatcagtcaacaccattcggtttctgtccattgatgcagttgagaaggccaactctggccaccctggtctccccatggggtgtgctccaatgggccacattctctacgatgaaatcatgaggtacaatcctaagaaccccacttggttcaaccgtgaccgtttcattttgtctgctggacatggctgcatgctccaatatgccctccttcaccttgcaggctatgacagtgttcaggaagaagatctgaagaatttccgacaatgggaaagcagaactccaggacatcctgagaactttgagacacttggagttgaagtgaccacaggtcctctgggtcagggaattgccaatgctgttggattagcactagctgagaaacacttggcagcacgatttaacaagcctgacaatgagattgttgaccattacacatatgttatattgggtgatggttgtcaaatggagggaatttcgaatgaagcaagctcacttgcaggtcactggggtctaggaaagcttattgcattttatgatgacaaccacatttccattgatggtgacactgaaattgcattcactgagaatgttgatcaacgttttgaagcacttggatggcatgtgatttgggtgaagaatggaaatactgggtatgatgaaattcgggcagccattaaggaagcaaaggctgtcaaagacaaacctactttgatcaaggtaaccactaccattggatatggctctccaaacaaagctaactcctacagtgttcatggaagtgcattaggttctaaagaagtggatgctacaaggaagaaccttggatggccatatgagcctttccatgtgccagaagatgttaaaaagcattggagtcgccatgtccctgaaggttccaaacttgaagctgagtggaatgcaaagtttgctgaatatgagaagaaatacagtgaggaagctgcagagctgaaggctatttttactggtgaattaccagctggttgggagaaagcacttcctacatacactccagaaagcccggctgatgctacaagaaatctgtctcagcaaaatctaaatgcccttgtgaaggttcttcctggtctgcttggtggcagtgcggatctggcctcttccaacatgaccctgttgaaatcttatggagacttccaaaagggaactcctgaagagcgcaatgttagatttggtgttagagaacatggaatgggagcaatctgcaatggcattgctcttcatagccctggattcattccatactgtgcaactttctttgtcttcactgactacatgagagctgccataaggatttctgcactgagtgaatcaggagtcatttatgtgatgactcatgattccattggactgggagaagatggaccaactcatcagccaatagagcacttggcaagcttcagggcaatgccaaatattctgatgcttcgtccagctgatggtaatgaaactgctggatcatacaaagttgcagtgcttaacaggaagagaccctcaattcttgcactttctaggcaaaagttggcacagcttcctggaacttctattgagggagttgaaaagggtggctacaccatttcagacaactcatcaggtaacaagcctgatgttatcttgattggaactggttctgagttggaaattgctgctgctgctgctgatgatctaaggaaggaaggaaaagctgtgagagttgtttcttttgttagctgggaactttttgatgagcagtcagatgaatacaaggagagtgttctccctgcttctgtaacagctagagttagcattgaagcaggatcaacatttggttggggaaagattgttggaagcaaaggaaaggccataggcattgatcgatttggagcaagtgctccagcaggaaaaatatacaaggagtttggtctcaccaaggaagctattattgctgctgccaaagaactttcgtagatctatttgttgagtttcttttatctcatctaaaacttgtggttttcactggtggctttgggttgattttacattgtttgttttttgagatgccactttagccacaat

SEQ ID NO: 599 - DNA, 1286 bp, Setaria italica
ccaccatggccaacgctctccttctgctcctcttcctgtttctctcgcgcgcctcagcggcggagtacggggaggagctgctgcggcgcgcgggggaggagcgggagtggatggtgggcgtgcggcgccgcatccacgcgcacccggagctcgcgttccgggagcaccgcaccagcgccctcgtccgcgaggagctcgagcgcctcgggatcagcagccgcgccgtcgccgggacgggcgtcgtcgctgatgttggctcgggtgcgctccccatcgtcgcgctccgcgccgacatggacgcgctcccgctccaggaattagtggagtgggagcataagagcaaagtggacggggtgatgcacgcctgtgggcatgatgtgcacacggcgatgctgctgggggcagcaaagttgcttagtcagcgtaaggatcagctcaaggggacagtgagactcctttttcagcctgctgaagaaggtggtgctggtgcatctcatatgataaaagaaggtgctcttgatggtgtcgaagccatttttgccatgcatgttgactatcggataccaactggtgtaatagcagctcatccaggacccacgcaagctgctgtatgtttctatgaagcaaaaatagaaggtaaaactgggatggctgaaaccccacacttaaacgtggatcctattgttgctgcatcatttgccatcctgtcgctacagcagctcatttcaagagaagatgatcctcttcacagccaagtggtctcggttacatatgtcaaagctggaaaagcccttgatgccacccctgcaattgttgaatttgggggtactttgagaagcatcactactgaaggcctttaccgtctacagaaaagggttaaagaggtagtagaagggcaggctgtggtgcatagatgcaaaggaactgtcgacatgaagggtgaagagtacccaatgtaccctgctgttgtgaacgattggaagctgcatcaccatgtagaggatgtcggcaggcgcttgcttggcccggacaaggtgaatcccggagagaagatcatggcgggggaagacttcgctttctaccagcagctagctcctggcgttatgtttggcatcggaattagaaacgagaaagtcggctccgttcactcagctcacaaccctcatttcttcgttgatgaggatgtcattccaattggggcagctttgcatactgccatagcagaactgtatctctctgaggcatatgctctgaacggaggaggggacttgcggtctcattgatga

SEQ ID NO: 600 - DNA, 1904 bp, Setaria italica
caccgatgggaccattggagccgcgctaccgcccctccggcgcccctgaggacgcaactaagagaaggacctccaaaagcaaaagcttcaaagatgtcgaaagttttgaagttctggtccttgaaaagaactgtggttgcaagttcaaatctttgaaaatcttgataatagctatcatttctgcaacagttcttaccctcataaccccaaccttatatgagcaccaattgcagtcagcctcccggtatgtggatgtaggctggatgtgggacaaaacaaattctgacccacgatatgcgtcatctgttgatgttcagtgggaggatgtatatagagcattgagaaatctaaaaagtgggaatcaagatctcaaagttggactcttgaattttaatagcaccgagtatgggtcttggacacagttgttcccggacagccatgtttccactataagacttgagcatgccaaggacagcattacttggcggacactgtatcctgaatggatcgatgaggaggaagaaactgagataccctcttgtccatctcttcctgagcctaatgttcgaagaggtgtacgctttgatgtcattgccgtgaagcttccttgtacccgtgttgccggttggtcaagagatgttgcacggctccatttgcagctctcagcagcaaaattggctgtggcctcttcgaagcgcaaccacaaggttcatgtgctttttgtaagcgactgcttcccaattccgaatctcttcccttgcaagaaccttgtgagacatgaaggcaatgcttggttatatagtcctgactcgaaagcattaagggaaaagctcaggcttccagttggatcctgtgagcttgctgttccgctcaaagcaaaatcgagacttttctcagtagatcggcgaagagaagcatatgcaacaatactgcattcagcaagtgaatatgtctgtggcgctatctcagcagctcaaagcattcgccaagcaggatcaactagggatctagttatccttgttgatgagaccataagtgatcaccaccggagaggcttggaagctgccgggtggaaggtcagaataatccaaagaatccggaacccaaaagctacgcgtgatgcttacaacgagtggaactacagcaagttcaggctgtggcagctgactgactacgacaagatcatcttcatcgatgctgaccttctcattcttaggaatgttgacttcctgttcgcaatgccagagatcactgcaactggcaacaacgcaacgctcttcaactccggtgtcatggtcatagagccttccaactgcacgttccagctgctgatggaccacatcaacgagatcacgtcgtacaacggtggagatcaaggttacctgaatgagattttcacatggtggcaccgcatccccaagcacatgaacttcctgaagcacttctgggagggcgacgatgaggaaatgaaggcgaagaagacccagctgtttggcgcagaccccccgatgctctatgtcctccactacctaggcctgaagccgtggctgtgcttcagggactatgactgcaactggaacaacgccgcaatgcgtgaattcgctagcgatgtcgcgcacgcacggtggtggaaggtgcatgacaagatgccacggaagctccagtcctactgcctcctgaggacacggcagaaggcgggcctggagtgggaccggaggcaggctgagaaggccaactctgaagacggccattggcgccgcaacatcaccgaccccaggctgaagacctgctttgagaagttctgcttctgggagagcatgctctggcattggggcgagagcaataacaggacgaagagcagccctgcgacggtgacgacgccgagcttggcaagctcatgatga

SEQ ID NO: 601 - DNA, 2474 bp, Oryza sativa
cggccatggcggcgggcaccgcatcgccaccgccggacgcggagcctcccgagtgcccggtgtgcctctcccccttcgacgccgcctccgccgcgccgcgggtcctcccgtgcggccactccctctgcggcccctgcatcgcctccctcccgccggcctccgcctccgcctccgcctccgccgcctcgctccgctgccctctctgctcccagtgcgtccctttctcccgcgctctcgggccctcctccctccccaaaaacctcgccctcatctccctcctcccctcgcccccaaacccctctcgttctcgcaccgccgccgcggcgccgccgcctcctcatgtcccgctccacgcggaccactcgcgtctcctctcccgcttccgccacgccgtcctcccggagtccgcttcgccgctccactcgcccgctcccgccgcgggcctcgccatcgggtccttcgcttccgacctcggcgccccgtggttctgcccgcgtggccaccccgtaagcctcctcccgatcgaaacccccgccgccgccgccaagcaggagtccccgttgtactaccggcccagccacgcggcgcgggtggccgccgcgatcgatgcgctgagcgccgcggcgagggatgaagtgatcgatttggtggccgtctcgtcgcggttggcgcggcgggtttgcagggtttacggcttctggatgggccccgaggcggctccgctgtggctgctctccgagcggcattcccgcggagtctcctgcttgttggaggagaggagccgacgagaggagacggtggctctgatcagaaatgtcggaatggaggtctgtgaagcgttcatgggattgcacggagaggggctggtactggggtgcatagggctaggatgcttctgcctcgatcgctttggacactgcctgctcgacctgaatcaggttttggccttgtgccacggggttcgggtaggggtttgctcatccaagtctaaggccttcatggctcctgaggtggcagaggtggtgcatgacaagttgcagataaaggatcatgatttcagtggcttgttagggcctagttcagatgcttggttgcttggttgtttattggtggcacttgtaactggggatgagcagcttgcagcaggatggagtactgaggggtcatacgatgattggaagaatgaagtgcttacgaaggttgatgcttcattggttggcacacatatggaaccatggtctgcaaccatagtgtcatgtttgaactatgatccagaaggccgtccagaaattgctgatgtctggaaatgtattaacggctcattgatgaattccgacattgaagctttgattcctaatgttgatcttgcagctcgaaagagttttatgtgtttgctccttggggagttgtcctcaatgtgctctaaccttggtgctgttgagtcagatgatacaatgcatctttctcaggatttggatgacaaacattcaactccagatgatgcaagcagtggtggtattataaacaacgaagaagttggtgcagctggaatggatgggccaaaatgtggactgtacaattcttcaactctgcttgctcaccgtgactgtattacgggattagccattggaggaggctttttgtttagctcttcttacgacaagacaatcaatgtatggtcactgcaggacttctctcataaacaaagtttgaagggccatgaacacaaaatcacagcaattgttgttgttgacaatgataatcagtcactttgtataagtggagacagtggtagtggaatatttgtctggtgtgttgatccttcactcagtaatgaaccattgaataagtggtatgaaagtaatgattggatttatcgaggtgttcactgtttggctgtttctggaactggttatctttacactggtagtagagacaaatctattaaggcttggtctctagaggattattcactacgctgcacaatgacaggtcacaaatcaactgtttcttgccttgcggttgcctgtggtattctttacagtggaagttgggatggttctattagatcatggtggctcactgatcacagcccgctgtctgtactggaagatggtacaccaggaagcattactcctgtgctgtcaatttcaacagaactcgattttgttgttgcatcatatgaaaatggctgtttgaagatctggaaggatgatgtcctagtaaagtcagagaaacttcaaaacggtgctatatatgctgctaaattgaatgacaagtggctctatgctggtggatgggataaagttgtaaatattcaggagttattggaagatgattcagaggtggaaatcagagatgttgctacctttacttgtgattcaattataacttcaatactgtactgggatggaaggctgatagttggactttctaacagggagattaaggttttctacaaggcatcttaatag

SEQ ID NO: 602 - DNA, 842 bp, Glycine max
tcactatggccaatggtccagcaccgttttctgagattggaaaaagggcaaaagatcttttgtacaaggattacaactttgatcacaagtttagcctgtcaattccaaactccactggattggggcttatagcaaccggattgaagaaggatcaaatttttgttggtgacataagtacactctacaagagtggaaatactacagtggatgtgaaagttgatacatattctaatatatctacaaaagtgactgtgaatgatatcttgcatggtacaaaagccgctttgagcttcaacatacctgatcacaagtcaggaaagctggatgtgcaataccttcatcctcatgcagccgttgattctagtattggtttgaatccatcccctctattggagctttcagctgcaattggcagcaaagatgtttgtctgggtgctgaagttggatttaatacaacttctgcttcattcacaaaatataatgctggagttgccttcaataaaccagatttctctgcggcacttttgctggctgataaaggacagaccctgaaggcatcatacataaattatgttgatcgccccgatggatttacggttgctgctgaaatctcccacagtttttccacctttgagaacagatttactattgggagctcacagtcaatagattcaaagacagttgtaaagacacggttcagtgacgatggcaaagctgccttccaatgccaacgagcatggaggccaaattcacttataaccctgtctgctgaatatgactccacaaagatctttggttcatccaccaagttcggtcttgctcttgctctcaagccttaataa

SEQ ID NO: 603 - DNA, 797 bp, Hordeum vulgare
tgaagatggcgcagcctgctgagctttcccgtgaggagaatgtgtacatggctaagcttgcagagcaggctgagaggtacgaggagatggttgagttcatggagaaggtggccaagacggttgactccgaggagctcaccgtcgaagagcgcaaccttctatcagttgcttacaagaatgttattggtgcccgccgtgcctcgtggcgcatcatttcctccatcgagcagaaggaagagagccgtggcaacgaggaccgtgtcacactcatcaaggactaccgtggaaagattgaagttgagctcactaagatttgtgatggtatcctcaagcttcttgattcccaccttgtcccctcatctaccgctccagagtccaaggtcttctacctgaagatgaagggtgattactacaggtaccttgcagagttcaagagtggaactgagaggaaggatgctgctgagaacaccatggtggcatacaaagctgctcaggagattgcactggcagagctgcccccgactcatcctattaggcttgggctggcactcaacttctcggtgttctactatgagatcctcaactctcctgaccgtgcttgcgacctcgccaagcaggcttttgacgaggccatctcggaattggactcactgagcgaggagtcctacaaggacagcactttgatcatgcagcttctccgtgataacctgacgctgtggacttccgacatctcggaggacgccgctgaagaaatgaaggatgctcccaagggtgaatctggagatggacagtaataa

SEQ ID NO: 604 - DNA, 1494 bp, Populus trichocarpa
ggaaaggagaggatgggattaggtagtgaagaaggtaaagtgaagtcttcttgggatgtgtgcaaatcaaaggagaggaggaagaagaagaaagatggtacagaggcagggtgttgggtcaagttgaggtttataggaagctgcatttcttcaagatccaaagttgatagctctgttagtgggactagtacccattttgaaagtaaatccacgaatgatacaagcatagaccaaccagctgctcctgttgtttcaacctcaaccacaagtaatacagaaagtaactcatccacttccaaacttgaagaggagcttaaagttgcttcccgactacggaagttcacatttaatgatctcaagtttgcgacaagaaattttagacctgagagtcttcttggtgaaggtggctttggttgtgttttcaagggatggattgaagaaaatggaactgctccagtgaaacctggtactggcctcactgttgctgttaaaacccttaatcatgatgggctccaaggtcataaagagtggctggctgaagtgaatttccttggcgatcttgttcatcctaacctggttaaactgattggctactgcattgaagatgatcaaaggctgctagtgtacgagttcatgcctcgaggaagcttggagaaccacctgtttcgaaggtccctgcctcttccatggtccataagaatgaaaattgctttaggtgctgccaaaggtcttgcctttcttcatgaagaaactgaaaggccggtgatttatcgtgattttaagacctccaatatcttattagatgcggattataatgccaagctttctgattttggacttgccaaagatggtcctgagggagataagacccatgtatcaacccgtgtgatgggaacttatggttatgcggccccagagtatgtaatgactggacatcttacttcaaggagtgacgtctacagttttggtgtggtcttgcttgaaatgataactggcagaagatccatggataagaaccgacctaatggagagcataaccttgttgagtgggcgagaccacatctaggggagagaagaagattctaccggttgatagaccctcggcttgaaggtcacttttcaataaaaggtgcccagaaagctgcacagctagctgctcattgccttagtagggatcctaaagccaggcctctaatgagtgaagtggtcaatgcattgaagcctctgcccaacctcaaggacatggcaagcacatcatattatttccagaccatgcaagctgaacgggttggatccagcccaaatgcgagaaatggtgtccattcacaggctggattgttatctaggaacgggcaccaacaaaggagtctttcaataccacatggttcccatgcttccccttatcactatcaatacctccataaatctccaaaacccaatggtaaaccatagcagcacaggatcattgaagtatgtgcttcttttagccacctc

SEQ ID NO: 605 - DNA, 1928 bp, Gossypium raimondii
aatttttggatatatagtgctcttcattgtgtataaataagtagacacagagatccaatatattttcactttcacagcaaccttcttctccactcctccatctatatatatagttagaggcagaagggaggaagtgacattggcaatatggctttgctgcattcttacttcttaagcgctggtgagtatgtttcagggtccacggtcttggcagtggcaatgtccattgcttcctattttctgatccctatggtgtttggtggtcgacataaaaactggaagaatgcaccaccaggccctgttggttggcctatccttggcagccttccacacctctccaatcgtctccatgaagatttctttgacatggccaagatctacggtccccttttcagtctaaacttgggaataaagccggccatagtggtgtcatcaccggaaatggcagcccaagttttgaaggaaaaggaagggatgttctccagtcggaccataaccgagaccattcgagtcatctcttatgatgcccattccatcattttctcgccctatggtcccaggtggaaggttcttcgaaggatcttgatcaccgaactactttctcctaaggcctttgaacaatttgagccacttcgtacctcacaggttcatggtttgctcaagtatttgtacttggtctcaaagtccaacactcaagtgaacatagcagaatatgcttttacagcactggccaacctagtgagtaatttcgtctgctccaaagaccttttcgacaactcaatgcctgaaggaagaaaaatgaaagagaggttctgggagttgataaaggtgattgggaccccgaatttttctgatctcatcccaattgttaaaccatttgatccacaaggcttgaagagaaaaatcaacaagatcttcggtcagttggatgctttctatgagaagttaattgaggagaggttggctgagaagggaaaagctcaacttgatgggacgataccctacaaacggaaaatggatatgttagatgttctgttgagttatgagagtaatgataaagaaaatggtttggaccgtttaccaaaatctatcgtcaaaggaatgctttctgaaatgtttattgcaggaactgagacaacctcaagcactgtggagtggggcatggcagaaatcctaaggaaacccagtgtactcaagaaactgctactggaactagatcaagttgtagggaaggacagatttgtggtggaaagcgatatcccgaagttggcataccttcaggcagttgtgaaagaagttttcagactgcaccctggcgttccactcatcatccctcgtcgcaccaacgaggcatgcgaggtagctggctaccatatccccaagcactgcatcgtttacgtgaacgtttggggaatggcaagggatcctaatgtgtgggaagatccactggagttcaagccggagaggttcatagggtcaagcgtggatgtgaagggccaagactttaacctcttaccgtttgggacggggagaaggtcgtgcgtgggatggccactggctcatcgcatggtgcactattacttggcagctctgctccatgctttccagtgggagtcacctccagatgtcctgaatgatctgggggagagagtggggcttactattcagaaaggtaagagcttgcttagcactcccaagcctcgactgccagcctctgtttatgagcgttagaacggcaccatccaagtataagttagagtgtgcctgtaatgttcctatgttatgttcttatgtttaatacataatgcgaagggtgctcaaatgaaagtttggtggcaatcttgtctaccaacatttatgtatcgcggcattataataaaaataatatgttacccttagtttttctttttattgaatatagagtaaaa

SEQ ID NO: 606 - DNA, 2036 bp, Gossypium hirsutum
cccatttatccaaattgtaacgctcgagtatccaagttcatcaatatcatcgctgaatcatatgttcaatgtatcgaaatgtaaatttaaatttttggatatatagtgctcttcattgtgtataaataagtagacacagagatccaatatattttcactttcacagcaaccttcttctccactcctccatctatatatatagttagaggcggaagggaggaagtgacattggcaatatggctttgctgcattcttacttcttaagcgctggtgagtgtgtttcagggtccatggtcttggcagtggcaatgtccattgcttcctattttctgatccctatggtgtttggtggtcgacataaaaactggaagaatgcaccaccaggccctgttggttggcctatccttggcagccttccacacctctccaatcgtctccatgaagatttctttcacatggccaagatctacggtccccttttcagtctaaacttgggaataaagccggccatagtggtgtcatcaccggaaatggcagcccaagttttgaaggaaaaggaagggatgttctccagtcggaccataaccgagaccattcgagtcatctcttatgatgcccattccatcattttctcgccctatggtcccaggtggaaggttcttcgaaggatcttgatcaccgaactactttctcctaaggcctttgaacaatttgagccacttcgtacctcacaggttcatggtttgctcaagtatttgtacttggtctcaaagtccaacactcaagtgaacatagcagaatatgcttttacagcactggccaacctagtgagtaatttcgtctgctccaaagaccttttcgacaactcaatgcctgaaggaagaaaaatgaaagagaggttctgggagttgataaaggtgattgggaccccgaatttttctgatctcatcccaattgttaaaccatttgatccacaaggcttgaagagaaaaatcaacaagatcttcggtcagttggatgctttctatgagaagttaattgaggagaggttgactgagaagggaaaagctcaacttgatgggacgataccctacaaacggaaaatggatatgttagatgtcctgttgagttatgagagtaatgataaagaaaatggtttggaccgtttaccaaaatctatcgtcaaaggaatgctttctgaaatgtttattgcaggaactgagacaacctcaagcactgtggagtggggcatggcagaaatcctaaggaaacccagtgtactcaagaaactgctactggaactggatcaagttgtagggaaggacagatttgtggtggaaagcgatatcccgaagttggcataccttcaggcagttgtgaaagaagttttcagactgcaccccggcgttccgctcatcatccctcgtcgcaccaacgaggcatgcgaggtagctggctaccatatccccaagcactgcatcgtttacgtgaacgtttggggaatggcaagggatcctaatgtgtgggaagatccactggagttcaagccggagaggttcatagggtcaagcgtggatgtgaagggccaagactttaacctcttgccgtttgggacggggagaaggtcgtgcgtgggatggccactggctcatcgcatggtgcactattacttggctgctctgctccatgctttccagtgggagtcacctccagatgtcctgaatgatctgggggagagagtggggcttactattcagaaaggtaagagcttgcttagcactcccaagcctcgactgccagcctctgtttatgagcgttagaagggcaccatccaagtataagttaaagtagagtgtgcctgtaatgttcctatgttatgttcttatgtttaatatataatgcgaagggtgctcaaatgaaagtttggtggcaatcttgcctaccaacatttatgtatcgcggcattataataaaactaatgtgttacccttagtttttctttttattgaatatagaggaaaacataattaaatcag

SEQ ID NO: 607 - DNA, 1980 bp, Theobroma cacao
ctcctccataaatagttagaggcgaaggggaagaaagaagctgccattatggatttgttgcattcttccatcttaagcgtgattgcccatttttcttcccttgtttctggctccatgatgatcctagcagtaacaatgtcgattgcttcctattttcttatccctatcctcctaggcggtcgctctaaaaattggaagaatgcaccaccaggccctgttggttggcccatcctcggaagccttccgcacctcagccatcgtctccatgaagatttctttcaccttgccaaaatccatggcccactattctgtctgaagatgggcatcaagccagccatagtgatttcctcgccagaaatggcatccgaaatcctcaaggaaaaggaaggcatgttctctagtcgtaccataaccgaagccattcgagtcgtctcttacgatgctcattccatcattttctcgccctacggaccgaggtggaaggctcttcgaagaatcttgatcactgaactactttctccaaaagccttcgagcaattcgagccggttcgcaccacacaggtccatggtttgctcaagtatctatacatactctcaaagtcgagcactcaagtgaatatagcagaatcagcttttacggcattggccaaccttgtgagtaatattttatgctccaaaagccttttcgacaactcaaagcctgaaggaagaaaaatgaaagagatgttctgggagatgataaaggtcctaggaactccgaacttttctgatctcattccaattgttaaaccatttgacctacaaggcttgaagagaaaaatttctgggatctttgaccaattggatgctttctacgaaaagctaattgaggagaggttggcagagaaaggaacagctgagcttcagagaggtaacaatgagacgatggatatgttggatgttcttttgagttataagagtaatgacaaagaaaatggtttggaccgattctcaagagctatcatcaaaggaatgctttctgaaatgtttattgcaggaacagagacaacctcaagcactgtagaatggggcatgacagaaatactaaggaaaccttctgttcacaagaaactactactcgaactggaccaagtagttggaaagaacagatttgtggtggagagtgatatcccaaacctgccataccttcaagcaactgttaaagaagttttcagactgcatcctggagttccgctcatcatccctcgtcgtaccaatgaggcatgtgaagtagctggctatcatattccgaagcattgcatcgtctatgtgaatatctggggaatagcaagggatcccaaagtgtgggaagatcctttagaattcaagcctgagaggttcattgggtcgagtgtagatgtgaaaggtcaagactttaatctcctgcctttcgggacagggagaaggtcttgtgtcggatggcctcttgctcatcggatggtgcattattacttggctgcgttgctccatgcttttgaatgggactctcctcctgagattttaagggatatgaacgagagggttggccttactcttcagaaagacaagagcttgcttggcactcccaaacctcgactgcaagcttctgtttatgagcattagacctcatcctggtatcagctgtgcgaatgataaaagtagtagttttaagcaattttcaaacttgtttctgcaggctcatttattttcttgtttagaatgaagcacaatatatgcgggggcgctcaaaatgaaggtgtggtagcaaatacatcaagtttccctgcaataataatattacaataaatcaaggacttgtttctcctggttgttctttcctctatccttaaatctcttgaacttctagtatgtgccgatcataattttctggttttctttttcttattttcattttatttgggtttaatgagcttattagaaaattaaatggatcaatgccca

SEQ ID NO: 608 - DNA, 2632 bp, Brachypodium distachyon
ctccagcaaacaaacacccagccgaccgccccgcacctcgtcactccagtgctccactccaccgcacactctccatggctccagtactccactgaaatccaccaccttcccttcccaacccccccaaacccccaaaaatgccggcgctcctccgccccctcgtccccctcctcctcctgctgctcgccgccgttaccaccactgcagcaccagccacatcgcattcgcagcccacgctacccaggcccggcgcgggcgcgtcgcactcggagcccgcgccggcccaaaccctgcctccgcccgccgccacgctggcctcgaccccgccgccggccgcgacccaggcatccctcctcgccgccttcctcgccaaggccgacccgtcctcccacctccgcccgcccctcacctcatccccttgcacccgcccgggcgtcacctgcgccggcgccggcgggtccaaccagatcacccacctcgtgctcgagtccgccggcctcaacggcaccttcccgccgggcacgctctcggcgctcgccgagctccgcgtgctcagcctcaagtccaacgcgctccacgggcccatcccggacctctccgcgctctccaacctcaaggcgctcttcctcgcggggaaccgcttctcgggccccttcccgtcatccctcgcctcgctgcgccgcctccgctccatcgacctctccgggaaccgcctctcgggcgagctcccgccaggcattgaggcggccttcccgcatctcacggccctccggctggatgccaaccgcttcgatggctccgtcccggcctggaaccagtcgtcgctcaagctgctgaatgtctcctacaacaacttctcagggcccgtgccggtcaccgccgccatggcgctcatgggcgccgccgcgttcgcgggaaacccgggcctctgcggcgaggtcgtccgccgcgagtgccgtggctcccacctcctcttcttccacggcggcggcaacaacggctccgccgccgatcccccggtgcagagctccgatgccaccccgcaaggggagggcatcagcttgccggactcgcccgctgggcctcgcacgcttagagttaaaaggaggaccgcaatggctgtcgcggttggtttgtcggctttcctggctgtgcttcttgtctgcgccgtgattgcagcgaggaggggcaagaagcggaggcggccgagctcggcggcgtacccgagccccaagaagagcgctgccgcgtcgcaggtgagcagggagctggataacgctgacgtcggctatgttgagtgtgtgccggatgaggagactgcagcgatgatgatgccggaggagaaggcacgccggcttgggaggagcggttgcctgacgttctgtgccggtgaagccaccagctacactcttgagcagctgatgcgcgcctctgcggaggtgctcggccgcgggagcgtggggacgacatataaggcggtcctcgacggccggcttgtggtcattgtcaagaggctggatgcggccaagatcggcccggcggcttcggaagcggaggcctttgagcagaacatggatgtggttgggcgactacggcatccgaacctcgtgccgctacgggcattcttccaggctaaggaggagcggctgctggtttacgactaccagcccaatggcagcctgcactctctaatccacggttcaaggtcatcgcaggcaaaaccactccactggacttcatgccttaagatagctgaagatgtcgcgcagggccttgcttacattcatcaagcatctcgactcgttcatgggaacatcaagtcctccaatgtcctgcttggttcagactttgaggcttgccttaccgacaattgcttgtcattccttttggaatcatcagaaatcaaagacgatgctgcttacagatcaccagaaaacatgaactccaacagaaggctgaccccaaaatcagacgtctatgctttcggcgtccttctcctcgagctcctaagtgggaaggcaccacttgagcactcagtcttggtggcaaccaatctccagacctatgctctgtcagcgagggaagatgaaggtatggacagcgagcgcctctcgatgattgttgacatagcatctgcctgtgtccggtcctcgcccgagagtcggccaactgcctggcaagtcctcaagatgattcaggaagtgaaggaagcggatacaactggtggcaacgatgacagtcatgacagtgatcttactagcaactcctaggcattctacggatcaactcgatcatcgtccactggatgcattatcccaagtgaccagtcgaagaagagtgttagcataggagaatggatgtggggtcatggtctctctgactggtatctcttcgagctccaaattctgcgatatatcttaggatctcttctccctagtgtatggattttgtggcctgttgctattgtattttcagcaccgatctgttatgtggagatttatttggaaaagaccagagtgctgtagtgcggtaagtattagtagtactgatctaaattattgctactgaatactggtgataccatttcagttttctggacagctctgggaagcaagtagtctactggagtatg

SEQ ID NO: 609 - DNA, 2739 bp, Brachypodium distachyon
gcccaagcagcgaacgctaaaccctacacgtcgtttccccgcccccgccgtcgccgccgtttgccgtcgtcctccggcgccagggcttgcgatggggggcggtccgcggacgttcccgggagggttgtccaagtggcagtacaagcggatgcacgagaagctggcccggcagaagcagcgggggctcctccgccacgagaagcagctctatctcgcccgcctccgctccgagatccgcgcctcccatctccccggcgccgccgatgctgccgcggcttcccccgacctcggcggagggcccacctcctcgcgcgcccacatccgcgcccttgccgaccgcttcctcaggcccggcgccgaggacctctggaacgaggatgacgggccgctccgccgcgccaagacgctgccgcggacgcagccggcgaggagcctgccgtcaggtgcccgaatcgtcgactggaagcagatggactccgggaagaagccatctcagggtggatcaggggattggaaggactgggaggagctgcatgtggagcaaccaagggttcggaggggaactggagtgggcggaagtgagccgcgtttggcggcgttcaatacgaggagagagtacggcacggtggctccctggtggtggcaatggagttcgggctctggcaccccttcgcaaaggaaggaggcatctttcggcttctttggtctgaagagatgttactcggtgatgcatccatgctcgccacatcgggaatcgagtcctacgctgatgccattgggtgctagtcagtctaccggggctcggaatggcaaggagacatcattggctatgtttaatcaggagaggttgtactcggttgctgcacggcgatttggccagaaatggaggccagattcatcggacgaggatgatgatggtatatctacggcaaagagggatctgaggtttggaaaatttggagctccgagggaagaggaatcggaagatgatgaaccgcgggaggcaagcaccatcaggaggaaatggagcactgctgctctgaggaactgcgatatgaagaaggataggagagcgctcaagtcctatgaggaggaaagcaatgatctcactggtaggatccaagagttgcgagaggagataagaaatagggaggtgctgggtgctgagaggaggcgttatgagtcgaggggtgaatctttgtttaccagtaaaagattcgatgaatgtggtatctccccacttactgtcaaagcactcactgatgcaggatatgtacagacaactgttgtgcaagaagcagctcttccgatttgtcttgaaggtaaagatgttcttgtcaaggccaaaacaggaactggcaaaagtgcagcttttctgcttccggcaattgaatcagtcttgaatgctatgaagagccacacaaatcatcgagtgtctccaatatttgctcttgttctttgccctacaagagagcttgccgtccaggttacagctgaggcaaatgttttgttgaagaaccatcaaggagttggtgttcagtcgcttattggtggcactagattcaagcttgatcaaagacgtttagagtctgatccatgtcagattttagtcgcaacacctggtaggctgctggatcatattgagaacaggtcttcattctctgttcgtttgatgggattgaaattacttgtgttggatgaagctgatcatttactagatttgggttttcgcaaagacatagagaagattgctgatagcctgcctcgccaaagacaaacattattattttcagctactgttccgaaagaggtccgaagggtttcgcagctcgttttaaatagggatcatgtttttgttgatacagtgggcttgggagctgttgaaactcctattaaggtgcagcagcaatatcttgtggtaccacatgaactgcactttcatatggttcatcgccttcttcgagagcacattgatcaggaagtgaactataaggtgattgttttctgctcaactgccatggtgactgaatttatgtatataatgcttcgagatttgaagctaaatgtcagagaaatacattcaagaaaacctcagctctatagaacacgtatttctgaagagttccgagattccagccgcctgattctggtaacgtcagatgtttccgcacgtggattaaattatccagatgtcactctagtgatccaggttggtgttcctcctggtagggagcattacatccatcgtcttggaagaactggaagagaaggcaaatccgggaaaggaattctgttaattgcgccatgggaagagtatttcttgaacgagataaccgaccttccaatagagaaggctcaggtgccacacattgatcaggagacgaaacaaaaggttgatgattcgattaagattgttgacatgagcatcaaggaagctgcatatcatgcatggcttgggtattataattcgatagcagatgtaggccgagacaaatccatgcttgctgacctagcgagtagattctgtgtttccattggtgtggagaagcctccagcgctgtatagaaaaactgccttgaagatgggcctcaaggatgtacctgggattcgaataaggaaataaataaccaaactacatattattccctgttttgcaatgtgtcgtgtccctcattttcgctgcatttagccagaaaatggttcccagttattatgtctcaaagagaagacagagttcat

SEQ ID NO: 610 - DNA, 2431 bp, Secale cereale
tcgctacgccgcgcacggctccccccgcatcagcatgagcagcccgcgaggagcctgccgtccggcgcccggatggtcgactggaagcaggtggagtcaggggagaagccaaagccgccccggggaggaggggactggaaggactgggaggagctggattctggggatccgacggcaggaaggggagccggaaatgagctgcgattgctcgccgcgttcaaccagaggagtgggtacgggacggccgctccctggtggtggcaatggagcccgggctccggctcgccttcgcagaggaaggaggcgtccttcagcttcttcggtccgaagagacgctactcggtgatgcctccatgctcgccgtgccgggaatcggtgctgcgctgatgccgttggttgctagacagctcgccgaggctggagatggcaggaaggggccaccgttggctctgttttatactcaggaaaggttgtattcggcggcagccatgcggcagtttggccagaaatggaggccggattcatcagacgaggatgaagaggttatgccggctgctagggatctgaggttggcaaaattcgtggcttcgagggaagatgagtcagaagatgatgaaccgggggagacgagcgccatcaggaggaaatggagcactgctgctctgaggaactgtgatatgaagagagacaggagaccgctcaagtcctacgaggaggaaagcgatgatgatatcactggtagaatccaagagctgcgagaggagataagaaacagggaggtgctgggtgctgagaggaggcggtacgagtcaaggggtgaatctgtgtttaccaataaaagattcgacgagtgtggcatctccccacttactgtcaaagcactcactgatgctggatatatacagacaactgttgtccaggaagcagctcttccagtttgtcttgaaggtaaagatgttcttgtcaaggccaaaactggaaccggcaaaagtgtagcttttctgcttcctgcaattgaatcagtcttgaatgccatgaagagccatacaaatcatcgagtgtctccaatatttgcccttgttctatgccctacaagagagcttgccgtccaggttacagctgaggcgaatgttttggtgaagtaccatcatggagtgggtgttcagtctcttattggtggcactagattcaagcttgatcaaagacggttagagtccgatccatgccagattttggtggcaacacctggtaggctgctggatcatattgaaaacagatcttcattctctgtccgcttgatgggattgaaattgcttgtgttggatgaagctgaccacttgctagatttgggttttcgcaaagacatagagaagattgctgatagcttgccacgccaaagacagacactactattttcagccactgttccaaaagaggttcgaagggtttcacagatggttttaaacaaggatcatgtttttgttgatacagtgggcttgggggctgttgaaactcctactaaggtacaacagcaatatctcgtggtaccacatgaactgcactttcatatggttcatcgccttcttcgagagcatattgatcaggaagtggactataaggtcatagttttctgcacaactgccatggtgactgaatttatgtatataatgcttcgagatctgaagctaaacgtcagagagatacattcaagaaagccccagctttatagaacacgtatttctgaagagttccgggattccaatcgcctgattctggtaacatcagatgtttcaacacgtggagtgaattatccagatgttaccctagtgattcaggctggtgttcctcctggtagagagcattatattcatcgtcttggaaggactggaagggaaggtaaatccgggaaaggaattctgttgattgcgccatgggaagagtatttcttgaaggagatacatgatcttccaatacagaaggctcctgtgccacagattgaccaggagatgaaacaaaaggttgatgattcgatcaagattgttgacatgagcatcaaggaagccgcataccatgcatggcttggttactataactcgatagctgatattagcagagacaaagtcatgcttgctgacctggctagtaggttcggcgtctctatcggcatggaaaagcctccgacgctgtttaggaaaaccgccttgaagatggggttaaagggtgtaccaggaattcggataagaaaatgaataaccaagctgcattttatctcccattctgtaattcgtcttatttctaattttcaatgcatcaagtctgaaactgatcgatgtcttgttgactggctcaaacgaagaacgactctcacatttttcttacggccttgcgctcatctgaatgagctttggtcgactgtgacagatgtatttac

SEQ ID NO: 611 - DNA, 2577 bp, Triticum aestivum
cggatggtcgactggaagcaggtggagtccggggagaagctgaagccgccccggggaggaggggactggaaggactgggaggagctggattctggggagccgacggcgggaaggggagccggaaatgagcagcgattgcctgccgcgttcaaccagaggagagggtacgggacggccgctccctggtggtggcaatggagcccgggctccggcacgccttcgcagaggaaggaggcgtccttcggcttcttcggtccgaagagatgctactcggtgatgcctccatgctcgccgtgccgggaatcgggtgctgcgctgatgccgttggttgctagacagctcgccgaggctggagatggcaggaatgcgacaccgttggctctgttttatactcaggagaggttgtactctgtagcagccccacggcggtttggccagaaatggaggccggattcatcggacgaggatgaggaggttatgccggctgctagggatctgaggttggcaaaattcgtggcttcgagggaagatgagtcggaagatgatgaaccgggggagacgagcgccatcaggaggaaatggagcactgctgctctgaggaactgtgatatgaagagagataggagaccgctcaagtcctacgaggaggaaagcgatgatgatatcactggtagaatccaagagctgcgagaggagataagaaacagggaggtgctgggtgctgagaggaggcggtacgagtcaaggggtgaatctgtgtttaccaataaaagattcgatgagtgtggcatctccccacttactgtcaaagcactcactgatgctggatatatacagacaactgttgtccaggaagcagctcttccagtttgtctcgaaggtaaagatgttcttgtcaaggccaaaactggaaccggcaaaagtgtagcttttctgcttcctgcaattgaatcagtcttgaatgccatgaagagccatacaaatcatcgagtgtctccaatatttgcccttgttctatgccctacaagagagcttgccgtccaggttacagctgaggcgaatgttttggtgaagtaccatcatggagtgggtgttcagtctcttattggtggcactagattcaagcttgatcaaagacggttagagtccgatccatgccagattttagtggcaacacctggtaggctgctggatcatattgaaaacagatcttcattctctgtccgcttgatgggattgaaattgcttgtgttggatgaagctgaccacttgctagatttgggttttcgcaaagacatagagaagattgctgatagcttgccacgccaaagacagacactactattttcagctactgttccaaaagaggttcgaagggtttcacagatggttttaaacaaggatcatgtttttgttgatacagtgggcttgggggccgttgaaactcctactaaggtacaacagcaatatctcgtggtaccacatgaactgcactttcatatggttcatcgccttcttcgagagcatattgatcaggaagtggactataaggtgatagttttctgcacaactgccatggtgactgaatttatgtatataatgcttcgagatctgaagctaaacgtcagagagatacattcaagaaagccccagctttatagaacacgtatttctgaagagttccgggattccaatcgcctgattctggtaacatcagatgtttcaacacgtggagtgaattatccagatgttaccctagtgattcaggctggtgttcctcctggtagagagcattatattcatcgtcttggaaggactggaagggaaggtaaatccgggaaaggaattctgttgattgcgccatgggaagagtatttcttgaaggagatacatgatcttccaatacagaaggctcctgtgccacagattgaccaggagatgaaacaaaaggttgatgattcgatcaagattgttgacatgagcatcaaggaagccgcataccatgcatggcttggttactataactcgatagctgatattagcagagacaaagtcatgcttgctgacctggctagtaggttcggcgtctctatcggcatggaaaagcctccgatgctgtttaggaaaaccgccttgaagatggggttaaagggtgtaccaggaattcggataagaaaatgaataaccaagctacattttatctcccattctgtaattcgtcttatttctaattttcactacatcaagtctgaaactgatcgatgtcttgttgactggctcaaacgaagaacgactctcacatttttcttacggccttacactcatctgaatgagctttggtcgactgtgacagatgtatttacccttggcattattgccttattgtccagcctcttactcttgggggtgtacttgcttgcagccaaagtgcctcttttagggtttacataggtaatatcatgcttgtctctcatgtaagatggacactgtaaatcaatgtctcttcaggagttagcttgacgaaagctaaataggttatttctctgtttatggcaagcctatctgtgagagcttaag

SEQ ID NO: 612 - DNA, 1304 bp, Hordeum vulgare
agcgacgcctcgccggcgcacgcctaaaccctagccagccctcgcccccgccgccgccgcacgcacgaccaacccgacacccccgcaaggcgagcgagcagccaaccgtcccccggcgccggcggctagcgaggatgggtcgtgagaagtcccggaggctctccggcagccgagacttccggcagcggctggtgctggcgacgctcacctccacccccatcgtcatcaaggacatccgcgccggcgagggcggcctccgcccgcacgagatgtccctcctccacctcctcgacaaggtctccgaccagcacgccatcgacgtcaacgacacaggcaagggcgcgcccaccccccctccgaggacgaaggttgggtacaagcccggggtgatcgtcggcgggaaggacctggagcacgactgcggggtgcaccgcgggatcggctacttcatcgagccgctcgttctgctcggcctcttcgccaggtcgcccttgtccattcggctcaaaggaatcacaaatgatgcaaaggacccttctgtggatactttccggatggttacgttgcatatgctcaagcattttggtgttcctcttgaggggctggagctcaaaattgaatgccggggaactcctccctgtggtggtggtgaagtgcttcttcgagtccccaatataaacagtacattaaaggcagtcaattgggttgatgaaggcatggtaaagaggataagaggtgtgacattcgccaccaaagtatctccacagattggaacccgtatcgtctatgctgcacgtggactcttcaataagttcattccagatgttcatatcttcaccgatcatagagttggtttatctggtggattgtcaacaggctatggcttatctgtagttgccgaaaccacaacaggctgtctgatttctgcagattcttccgtgagttatcccaatgttgataaaatgagtgaacaatccaagaagcctgagctaatgtctccagaggatcttggtgagcaagttgcatcgatgctgctagaagaggtggctcaaggaggagttgttgactcaacacatcagggccttctgttcatgttgtgcgctctctgcccgcccgatgtgtcaaaggtacgcgtgggacagctgacaccgcacgctatagaatcacttcgaaacatcaaggagttccttgatgtcaagttcatcatcaagcctgacccaaactcaaacacggttattctaaaatgtgttggtgccggagtgaagaatcttgctcggaagatttcataaacctcatctaggatg

SEQ ID NO: 613 - DNA, 1440 bp, Triticum aestivum
cgccgcacgaccaaccccaccatcccccgcgcggcgagcgaacagccaaccgtccccagcgccggcgaccggcgaggatgggtcgcgagaagtcccggaggctctcgggcagccgagacttccggcagcggctggtgctggcgacgctgacctccacccccatcatcatcaaggacatccgcgccggcgaggggggcctccgcccgcacgagatgtccctcctccacctcctcgacaaggtctcggaccagcacgtcatcgacgtcaacgacacagggacgaaggtcgggtacaagcccggggtggtcctcggcgggaaggacctggagcacgactgcggggtgcaccgcgggatcggctacttcatcgagccgctcattctgctcgggctcttcgccaggtcgcccttgtccattcggctcaaaggaatcacgaatgatacaaaggatccttctgtggatactttccggatggttacgttgcatatgctcaagcattttggcgttcctcttgagggactggagctcaaaattgaaaaccggggagctcctcctcgtggtggtggtgaagtgcttcttcgagttcccaatataaacagtacattaaaggcagttaattggattgatgaaggaatggtaaagaggataagaggtgtaacattctcaaccaatgtatctccacagattgaaaaccgtatcctctatgctgcacgtggactcttcaataagtttattccggatgttcatatcttcaccgatcatagagctggtttatctggtggattgtcagcaggctatggcgtatcagtagttgctgagaccacaacaggctgtctgatttctgcagatgctactgtgagttatcccaatgttgatgaaatgagtgaacaatctaagaagcctgagctaatgtctccagaggatcttggtgagcaagttgcatcgatgctgctagaagaggtggctcaaggaggagttgttgactcaacacatcagggccttctgttcatgctgtgcgctctatgcccgcctgatgtgtcaaaggttcgcgtgggacagctgacaccgcacgctatagaatcacttcgaaacatcaaggagttccttgatgtcaagttcatcatcaagcccgacccaaactcaaacacggtcactctaaaatgtgttggtgcgggagtgaagaatcttgctcggaagatttcataaacagaactatcatgaacctcatctaggatggaaaacagtgttttggaaccgcaacacaagaattttcaagttttgttgcaagtgtgtcgtagatcttcttccctgtagtagttttgatgtaagctagttgatccagaatggatttgcctgatcgtattatcatgtaccctcctgagaaaacatgggtgtgagctttccatttgagatcacacatttgatgtgcttttacttctta

SEQ ID NO: 614 - DNA, 1413 bp, Secale cereale
tcccggaggctctcgggcagccgagacttccggcagcgactggtgctggcgacgctgacctccacccccatcatcatcaaggacatccgcgccggcgaggggggcctccgcccgcacgagatgtccctcctccacctcctcgacaaggtgtcggaccagcacgtcatcgacgtcaacgacacagggacgaaggtcgggtacaagcccggggtggtcctcggcgggaaggacctggagcacgactgcggggtgcaccgcgggatcggctacttcatcgagccgctcattctgctcgggctcttcgccaggtcgcccttgtccattcggctcaaaggaatcacgaatgatacaaaggatccttctgtggatactttccggatggttacgttgcatatgctaaagcattttggcgttcctcttgagggactggagctcaaaattgaaaaccggggagctcctcctcgtggtggtggtgaagtgcttcttcgagttcccaatataaacagtacattaaaggcagttaattggattgatgaaggaatggtaaagaggataagaggtgtaacattctcaacaaatgtatctccacagattgaaaaccgtatcctctatgctgcacgtggactcttcaataagtttattccggatgttcatatcttcaccgatcatagagctggtttatctggtggattgtcagcaggctatggcgtatcagtagttgctgagaccacaacaggctgtctgatttctgcagatgctactgtgagttatcccaatgttgatgaaatgagtgaacaatctaagaagcctgagctaatgtctccagaggatcttggtgagcaagttgcatcgatgctgctagaagaggtggctcaaggaggagttgttgactcaacacatcagggccttctgttcatgctgtgtcgctctatgcccgcctcgatgtgtcaaaggttcgcgtgggacagctgacaccgcacgctatagaatcacttcgaaacatcaaggagttccttgatgtcaagttcatcatcaagcctgacccaaactcaaacacggtcactctaaaatgtgttggtgcgggagtgaagaatcttgctcggaagatttcataaacagaactatcatgaacctcatctaggatggaaaacagtgttttggaaccgcaacacaagtgtgtcgtagatcttcttccccgtagtagttttgatgtaagctagttgatccaggatggatttgcctggtcatattaccatgtaccctcctgagaaaacgtgggtgtgagctttccatttgagatcacacatttgatgtgcttttgcttcttactagcctggaacatctagcaaactatgaatctagacgcaagaaaatctattgtgaaaggtaatcaaaaagaagataaagctagca

SEQ ID NO: 615 - DNA, 1367 bp, Secale cereale
tgggccgcgacaagccccggaggctctcgggcagccgagacttccggcagcggctggtgctggcgacgctgacctccacgcccatcaccatcaaggacatccgcgccggcgagggcggcctccgcccgcacgagatgtccctcctccgcctcctcgacaaggtctcggaccggcacgtcatcgacgtcaacgacacagggaccaaggtcgggtacaggcccggggtggtcgtcggcgggaagggcctggagcacgactgcggggcgcaccgcgggatcggctacttcatcgagccgctccttctgctcggcctcttcgccaggtcgcccttgtccgttcggctcaaaggaatcacaaatgattcaaaggacccttctgtggatactttccggatggttacgttgcatatgctcaagcattttggtgttcctcttgaggggctggagctcaaaattgaaagccggggagctcctcctcatggtggtggtgaagtgcttcttcgagttcccaatataaacagtacattgaaggcagttaattgggttgatgaaggaatggtaaagaggataagaggtgtaacattctcaacgaatgtatctccacagattgtaacccgtatcttctatgctgcacgtggactcttcaataagttcattccggatgttcatatcttcaccgatcatagagctgtttcatctggtggatgtggattgtcagcaggctatggcttatctgtagttgctgagacgacaacaggctgtctgatttctgcagatgctactgtgagttatcccaatgttgatgaaatgagtgaacaatccgagaagcctgaggtaatgtctccagaggatcttggtgagcaagttgcatcgatgctgctagaagaggtggctcaaggaggagttgttgactcaacacatcagggccttctgttcatgctgtgtgctctatgcccgcccgatgtgtcaaaagttcgcgtgggacagctgacaccgcgcgctattgaatcacttcgaaacatcaaggagttccttgacgtcaagttcatcatcaagcccgatccaaactcaaacacggtcactctaaatgtgttggtgcgggagtgaggaatcttgctcggaagatttcataaacagaactatcatgaacctcatctaggatgaaaaacagtgttttcgaaccgcaacgctagaattttcttgttttgtttgcaaatgtgtcatagatcttcccggtagtagttttgatgtaagctagttgatccagaatggatctgcctgatcatattatagagtaccctcagttgtatatcgtagatctaatagagcaactacttctgtttcctgagaaatcatgggtgtgagctt

SEQ ID NO: 616 - DNA, 1379 bp, Avena sativa
gcccaaaccctagcaagtccctccccgcctccgcctccgcctccgccgcacggccaaccaaaccccaccgcgacgcgaactagcgagtagccaaaccctccatccccggcgccggcggccagaatggggcgggacaaaacacggaggctctccggcagccggcacttccggcagcggctggtgctggcgacgctgacctccaccccggtcaccatcgtggacatccgcgccgacgggacgccgggcctccgcgaccacgaggtctccctcctccgcctcctcgacaagatctctgaccacagcgacgtcgagatcaacgagacagggacgaagctgaggtacaagccaggggtgatcatcggcgggaaggacctggagcacgactgcgggctgcagcgggggatcggctacttcctcgagccgctcatactgctcggccttttcgccaggtcaccaatatcgattcgtctcaaaggaatcacaaatgatacaaaggacccttctgtggacactttccggatggttacactgcatatgctcaagcattttggtgttcctcttgagggactggagctaaaaattgaaagccggggagctcctcctcttggtggcggtgaagtgcttcttcgagttcccaatataaacagcacgttaacggcagttaattgggttgacgaaggcatggtaaagaggataagaggtgtaacattctccacccgagtatctccgcagattgaaaaccgtatcctctatgctgcacgtggactcttcaataagtttattccagatgttcatatattcactgatcatagatctggttcatctggtggaaggtcaccaggctatggtgtatctgtagtcgccgagaccacaacaggctgtctaatttctgcagatgccactgtgagttataccaatgttgatgaaatgagtaaagaatcggagaagcctgagctgatgtctccagaggatcttggtgaacaagttgcatcaatgctgctagaagaggtagctcaaggaggagttgttgactcgacacatcagggccttctgtttttgctgtgcgctctatgccctcctgatgtgtcaaaggtccgtgtgggacaactgacaccatacgctatagaaacactccgaaacatcagggatttccttgatgtcaagttcatcatcaagcccgatccgaattcgaatacagttactctaaaatgtgttggtgcgggagtgaagaaccttgctcggaagatttcataaacagaaggatcttgaatctcatcaaggatggaaggctggagctatgtcttttaactgcaacacaacaattttcctagctgctactgtagaagccatgttgcaagttttgatgtaagctatttgcc

SEQ ID NO: 617 - DNA, 1309 bp, Avena sativa
gcgacgcgaactagcgagtagccaaaccctccatccccggcgccggcggccagaatggggcgggacaaaacacggaggctctccggcagccggcacttccggcagcggctggtgctggcgacgctgacctcaccccggtcaccatcgtggacatccgcgccgacgggacgccgggcctccgcgaccacgaggtctccctcctccgcctcctcgacaagatctccgaccacagcgacgtggagatcaacgagacagggacaaagctgaggtacaagccgggggtgatcatcggcggaaaggacctggagcacgactgcgggctgcagcgggggatcggctacttcctcgagccgctcatactgctcggccttttcgccaggtcaccaatatcgattcgtctcaaaggaatcacaaatgatacaaaggacccttctgtggacactttccggatggttacgctgcatatgctcaagcattttggtgttcctcttgagggactggagctaaaaattgaaagccggggagctcctcctcttggtggcggtgaagtgcttcttcgagttcccaatataaacagcatgttaacagcagttaattgggttgacgaaggcatggtaaagaggataagaggtgtaacattctccaccagagtatctccacagattgaaaaccgtatcctctatgctgcacgtggactcttcaataagtttattccagatgttcatatattcactgatcatagatctggttcaactggtggaaggtcagcaggctatggtgtatctgtagtcgccgagacaacaacagggtgtctaatttctgcagatgctactgtgagttataccaatgttgatgaaatgagtaaagaatcggagaagcctgagctgatgtctccagaggatcttggtgaacaagttgcatcaatgctgctagaagaggtagctcaaggaggagttgttgactcgacacatcagggccttctgtttttgctgtgcgctctatgccctcctgatgtgtcaaaggtccgtgtgggacaactgacaccatacgctatagaaacactccgaaacatcagggatttccttgatgtcaagttcatcatcaagcccgatccgaattcgaatacagttactctaaaatgtgttggtgcgggagtgaagaaccttgctcggaagatttcataaacagaaggatcttgaatctcatcaaggatggaaggctggagctatgtcttttaactgcaacacaacaattttcctagctgctactgtagaagccatgttgcaagttttgatgtaagctatttgcc

SEQ ID NO: 618 - DNA, 1470 bp, Lolium multiflorum
aggcgagcgagcgagcgagcgagaagccaaccgtccatccccggcgccggcggcgagaatggggcgagaaaaaacccggaggctctccggcagccgccacttccggcagcggatggtgctggcgacgctgacctccgccccggtcaccatcgtcgacatccgcgccgacggcacgccgggcctccgggagcacgaggtctccctcctccgcctcatcgacaagatctccgaccacagcgacatcgagatcaacgagacagggaccaagctgaggtacaagccgggggtgatcatcggcgggaaggacctggagcacgactgcggcctgcagcgcgggatcggctacttcctcgagccgctcatactgctcggccttttcggcaggtcgcccctgtccatccggctcaaaggaatcacaaatgacacaaaggacccttctgtggacacttttcggatggtcacattgcatatgctcaagcattttggtgttcctcttgaggggctggagctaaaaattgaaagccggggagcttctcctcttggtggcggtgaagtgcttcttcgagtttccaatataaacagcaccttgacggcagttaattgggttgacgaaggcatggtaaagaggataagaggtgtaacattctccaccagagtatctccacagattgaaaaccgtatcctctatgctgcccgtggactcttcaataagttcattcctgatgttcatatattcactgatcatagatcgggtgcatctggtggaaggtcagcaggctatggtgtatctgttgttgctgagaccacaacaggctgtttaatttctgcagatgctactgtgagtcataccaatgttgacgaattaagtactgaatctgagaagcccgagctaatgtctccagaggatcttggtgaacaagttgcatcaatgctgctagaagaggtggctcaaggaggagttgttgactcaacacatcagggccttctgtttatgctttgcgctctatgcccgcctgatgtgtcaaaggtccgtgtgggacaactgacaccatatgccatagaaacactccgaaacatcagggatttccttgatgtcaagttcatcatcaagcccgaccccaattcaaacacggttacattgaaatgtgttggtgcgggagtaaagaaccttgctcgtaagatttcataaacagaaggatcacaaatctcatcaaggatgggcggatgcagcagtgttttgcaattgcaacacaacaattttcatagccgatgttgtagaagttatgttgcaaggtagttttgatgtaagctatttgttctggaatatatttgcctgatcatagtatttgtacactcaactgtatctgatattctcatctgtccaatagaacaactgctcttcggcttctgtttcctgagaaaacaggtgtgactgttaacttttacatagagatatcagtgttaacattc

SEQ ID NO: 619 - DNA, 1465 bp, Brachypodium distachyon
acgcacgaccaatcgaccaattccccccgtgaggcgagagcgaagcagcagcatcatccccaggcggcggcgagtatgggacgggacaaggcgcggcggctcaccggcagccggcacttccggcagcggatggtgctggcgacgctaacctccacccccatcgccatcgaggacatccgcgccggcgacgcgggcctccgcgcccacgaggtctccctcctccgcctcatcgacaagatctccgaccaccacagcttcgagctcaacgaaacagggaccaagctgaggtataagcctggggtgatcgtcggcgggagggacctggagcacgattgcggtgtgcatcggggcatcggctacttccttgagccgctcatactgcttgggcttttctctaggtcgcccatatcgattaggctcaaaggaattacaaatgacacaaaggacccttctgtggatactttccggatggttaccttgcatatgctcaagcattttggtgttcctcttgagggattggagctaaaaattgaaaaccggggagctcctcctctcggtggtggtgaagtgcatcttcgagttccaaatataaacagcacattaacggcagctaattggattgatgaaggtatggtaaagaggataagaggtgtaacattttccaccagagtatctccacagattgaaaaccgtatcctctatgctgcacgtggaatcttcaacaaatttataccggatgttcatatattcactgatcatagatctggttcatctggtggaaggtcagctggctatggtgtatctgtagttgctgagaccacaacaggctgtctaatctctgcagacgctactgtgagctatcccaatattgatgaaatgagtaaagaatctgagaagcctgagctaatgtctccggaagatcttggtgaacaagttgcaaaaatgctgttagatgaggtggctcaaggaggagttgttgactcaacacatcagggccttctgtttattctctgcgctctatgcccaccagatgtgtcaagggttcgtgtagggcagctgacaccacacgctatcgaaacacttcgaaacatcagggatttccttgatgtcaagttcattatcaagcctgatccaaattcaaacacggttactttaaaatgtgtcggtgcgggagtgaagaatcttgcccggaagatttcataacggaatgatcatgaatctcatcaaagatggaaggatgcagcaaggttttatagctactgctgttgctggaattttgtttaacttgcatgatatatcttcttccctttggtagttttgatctaaactatttgtaccagaatggaattgcgtgatcatagcatcatcatgtacaatcgatcatatctcatttccttgatctaatagtctcatttccttgatctaatagagcaactactttttagcctctgtttgtttcatgccg

SEQ ID NO: 620 - DNA, 1484 bp, Oryza sativa
gaaagcccagaaccctagcccctcccgccgccgacgagcagcggcgcgcgagaagaacggccggcgagatggggcgggacaaagcgcggaggctctccggcagccgccacttccggcagagggtggtgctggcgacgctgacgtcgaccgccatcaccatcgacgacatccgctccggcggcgccgcgccgggcctccgcccccacgaggtctccctcctccacctcctccacaagatctccgaccaccactccctcgacctcaacgagacagggacgaagctgaggtacaagccgggggtgatcgtcggcgggagggacctcgagcacgactgcggggtgcaccgggggatcggctacttccttgagccgcttatactgcttgggctcttcgccagggcgcccatctccattcggctcaaaggaattactaatgatacaaaggacccttctgtggatactttccgaatggttaccttgcatatgctcaaacaattcggtgttcctctggagggattggagttaaagattgaaagccggggagctcctcctcttggtggtggtgaagtgtttcttcgagttcccaacataaagagcacattaaaggcagctaactgggctgatgaaggtatggtcaagaggataagaggtgtatcattttcaactagagtatctccacaaattgaaaaccgcatcatttatgctgcacgtgggatcttcaatcgctttattccggatgttcatatattcactgatcatagatctggttctgctggtggcaggtcagcaggctatggcgtatctgtagttgctgagactaccacaggctgcctgctctctgcagatgctactgtaagttatcctaatgttgatgaaatgaatgaggaatctgagaatttggagctaacatctccagaggatcttggtgttcaagttgcatcgatgttgctagaagaagttgctcaagggggagttgttgactcagcacatcagggccttctgtttattctatgtgctctaagcccacctgatgtgtcaaaggttcgtgttggtcagttgacaccatacgctatcgaaacacttcgcaacatacgggatttccttgatgtcaagttcattatcaagcctgatccaaattcaaatactgttacattgaaatgtgttggtgctggagtgaagaatcttgctcggaagacttcgtgaacaacaggatgatgaatcccatcaaaggatggatgagtgcagcaagaacactgggtctcctgtaagctctgtttgtaactgcaaagcaacaagttgagaggtttcatttgctgcctgggctaaaattttgtcgaagtgcgtggtatatgtcataggtagatttgacccaagcattttatacctgctgggatttgtctgatcataccatcatgtcttgtcacacttttgtatctcctttatctaatacggcgatgccattgagattgggctttaagttaattg

SEQ ID NO: 621 - DNA, 1610 bp, Oryza sativa
ggcggcgcgcgcggggaagaaagcccagaaccctagcccctcccgccgccgacgagcagcggcgcgcgagaagaacggccggcgagatggggcgggacaaagcgcggaggctctccggcagccgccacttccggcagagggtggtgctggcgacgctgacgtcgaccgccatcaccatcgacgacatccgctccggcggcgccgcgccgggcctccgcccccacgaggtctccctcctccacctcctccacaagatctccgaccaccactccctcgacctcaacgagacagggacgaagctgaggtacaagccgggggtgatcgtcggcgggagggacctcgagcacgactgcggggtgcaccgggggatcggctacttccttgagccgcttatactgcttgggctcttcgccagggcgcccatctccattcggctcaaaggaattactaatgatacaaaggacccttctgtggatactttccgaatggttaccttgcatatgctcaaacaattcggtgttcctctggagggattggagttaaagattgaaagccggggagctcctcctcttggtggtggtgaagtgtttcttcgagttcccaacataaagagcacattaaaggcagctaactgggctgatgaaggtatggtcaagaggataagaggtgtatcattttcaactagagtatctccacaaattgaaaaccgcatcatttatgctgcacgtgggatcttcaatcgctttattccggatgttcatatattcactgatcatagatctggttctgctggtggcaggtcagcaggctatggcgtatctgtagttgctgagactaccacaggctgcctgctctctgcagatgctactgtaagttatcctaatgttgatgaaatgaatgaggaatctgagaatttggagctaacatctccagaggatcttggtgttcaagttgcatcgatgttgctagaagaagttgctcaagggggagttgttgactcagcacatcagggccttctgtttattctatgtgctctaagcccacctgatgtgtcaaaggttcgtgttggtcagttgacaccatacgctatcgaaacacttcgcaacatacgggatttccttgatgtcaagttcattatcaagcctgatccaaattcaaatactgttacattgaaatgtgttggtgctggagtgaagaatcttgctcggaagacttcgtgaacaacaggatgatgaatcccatcaaaggatggatgagtgcagcaagaacactgggtctcctgtaagctctgtttgtaactgcaaagcaacaagttgagaggtttcatttgctgcctgggctaaaattttgtcgaagtgcgtggtatatgtcataggtagatttgacccaagcattttatacctgctgggatttgtctgatcataccatcatgtcttgtcacacttttgtatctcctttatctaatacggcgatgccattgagattgggctttaagttaattgaaatactagtataatggagaaatattgctgtttaggcacatcgaaaatgtgttgttagtatgcacattggatgtgcttatgctgcaacatatataaaccgtttatatt

SEQ ID NO: 622 - DNA, 1544 bp, Brachypodium distachyon
cgatcgattccccacaaaaagaaaatatctctcgcccgcgagccgagagcgaagaagaaaaggcagcatcatcgtcatcgtctccggccggcggcgaggatgggacggaacaaagcgaggcggctctccggcagccggcacttccggcagcggctggtgctggcgacgctgacctccagcccgatcgccatcgagggcatccgcgcgggcggcggggggcttcgcccccacgaggtctccctcatccgcctcgtcgacatgatctccgaccaccacagcatcgagctcgaggtcacagggaccaagctgacgtacaaaccaggggtgatcgtcggcgggaggggcctggagcacgactgcggggtcgaccggggcatcggctacttcctcgagccgctcgtgctgcttgggcttttcgctaggtcgcctgtatcgattcggctcaaaggaattacaaatgatacaaaggacccttctgtggatactttccggatggttaccttgcatatgttcaagcattttggtgttcctcttgagggattcgagctaaaaattgaaagccgtggagctcctcctctcggtggtggtgaagtgcatcttcgagttccaaatataagcagcacattaacggcgtctaattggattgatgaaggtaaggtaaagcggataagaggtgtaacattttccaccagagtatctccacagattgaaaaccgaatcctctatgctgcacgtggagtgttcaataagtttatactggatgttcatatattcactgatcatagatctggttcctctggtggaaggtcagctggctatggtgtatatctagttgctgagaccacgacaggctgtctaatctctgcagatgctactgtgtgctatccaaatgttgatgaaatgagtgaagaatctgagaatcccgagctaatgtctccggaagatcttggtgatcaagttgcaaaaatgctgttagatgaggtggctcaaggaggagttgttgactcaacacatcagggccttctgtttattatgtgtgctctatgcccacccgatgtgtcaagggtccgtgtagggcagctgacaccacacgctatcgaaacacatcagaacatcaaggatttccttgatgtcaagttcattatcaagtatgatccaaattcatacactgttactttaaaatgtgttggtgcgggagtgaagaatcttgcctggaagatttcataaacgaaagatcatgaatctcatcaaagatggaaggatgcagcagttttatagctactgttgttgctgaaattttgtttaaaagtgcatgatatatcttctcccctttggtagttttgatctgagttatttgtaccagtaatggaattgcgtaattactgtattatcgtgtacacttgatggtatctcatttccttgatctagtagagcaactactgtttatcctctgcttgtttcatgagaaaacatgagtgttagctgtcgcacggaaattgtttcgtgggtgtgagagtgtcggctgttactatatatatatcaca

SEQ ID NO: 623 - DNA, 767 bp, Secale cereale
tactccttctctcgtctctcgccgcctagcacgtgccgccgtcggccccatcgccttcgagcatcagccatggcggagcagactgagaaggctttcctgaagcagcctaaggtgttcctctgctcaaagaagaccacaaaggggaataacaagcctggcaaggagggtaacaggttctggaagagtgttggccttggtttcaagactcccaaggaagccattgaaggaacctacattgataagaagtgcccattcactggcactgtgtcaattagaggccgcatcattgctggaacatgtcatagtgctaaaatgaacaggaccatcattgttcgtaggaactaccttcactatgtcaaaaaataccagaggtatgagaagaggcactccaatatccctgcccacatttccccttgcttccgtgtaagagaaggagatcatgtgatcattggccagtgcaggccactgtccaagacggtgcggttcaatgtgttgaaggtcgtcccggcagggtcgaagagtggtgcggtgaagaaggcgttcaccggtgcctgagcaattcatggccaaatacgaaaccttttcaccatgaaattttgacgtcacatctatattgttccatctgtgtgcactagggttttttgtctcgaaagttctccaaacttcaagctaagagtgagtggttcagttaagttatgttcagagtgcttcgtgaagattattgatgcggttagctggctactcgttaatatacaccactcgttttt

SEQ ID NO: 624 - DNA, 1180 bp, Triticum aestivum
cctcggctactcctctcgtctctcgccgcctagcgcgtgccgccgtcggccccatcgccttcgagcatcagccatggcagaacagactgagaaggctttcctgaagcagcctaaggtgttcctctgctcaaagaagaccacaaaggggaataataagcctggcaaggagggcagcaggttctggaagagtgttggccttggtttcaagactcccaaggaagccattgagggaacctacattgataagaagtgcccattcactggcactgtgtcagttagaggtcgcatcattgctggaacatgtcatagtgctaaaatgaacaggaccatcattgttcgtaggaactaccttcactatgtcaaaaaataccagaggtatgagaagaggcactccaacatccctgcccacatttccccttgcttccgtgtgagagaaggagatcacgtgatcattggccagtgcaggccgctgtccaagacggtgcggttcaatgtgttgaaggtggtcccagcagggtcaaagagtggtgcggtgaagaaggcgttcaccggtgcgtgagcaagtcatagcagaatccaaaacttttttaccattaaattttgacagttacatctatattgtgccatctgtttgtactagggttttatctcaagagttctccaaacttcaagctaagagtgagtggtttagtgaagttatgttcagagtgcttcgtgaagattattgatgcggttacctggttacccgttaatatacatcactcgttttttgcttcttgcatgtgactcttatctgaatcgagtctgtaatgtctaggaccaacaaagctgcagcacgcaagtgctgatttatcctatctgtcggttgttgatggaagtctgtccctgaatgatagtgggagctcggcaccggacaatacaacaccttgcacggataacattccgtgttgagttgccgccccctcccagcagcagtattgaaactttttcacacggcgtacgtacgcaggcgtggcagagtttcactcgttgcagcggggacagcgagccgttggctccaagaacactgggcgtacgcaagcgtgcgagcccgttggtttccggacccccgcgataatatgggccgttaatggccaattctttcggtgcagagggccggtaggttttttcctccttttac

SEQ ID NO: 625 - DNA, 758 bp, Brachypodium distachyon
gggaacgccttctctcatctcccaccgccgcctatcttgctgccgtcgtctccatctcctctctgcatcaaccatggcggagcagactgagaagtcttttctgaagcagccaaaggtgttcctctgcccgaagaagatcaccaaggggaataataagcctggcaagcagggcaacaggttctggaaaagtgttggccttggtttcaagactcccaaggaagccattgagggaacctacattgataagaaatgcccattcactggcaccgtgtcaattagaggtcgcatcattgctggaacatgccatagtgctaaaatgaacaggaccatcattgttcgcagaaactacctccactttgtcaagaaatatcagaggtatgagaagaggcattccaacatccctgcccacatttccccttgcttccgtgtgagggaaggagatcacgtgatcattggtcagtgcagaccactgtccaaaaccgtgcggttcaatgtgctgaaggttatcccggcaggctcaaagagtggtgcagtgaagaaggcatttaccggtgcctgatcaaagcattacagaatcttactaagtttgatcaggaaatttttgatgccacatctatattgttccatctgtactagggtttttgactcgagagttctccaaacttcaagctaatagtgttaaattcagtgctttgttgtttcggtgaagaatatttatgcagttacctggctacccgtcaatatatatcatatcattt

SEQ ID NO: 626 - DNA, 956 bp, Cenchrus ciliaris
aacgcaggtttttccatgtgtttgtataccatgcctccagtgtggaggcgctgtttaaacacaatagctatacaacttatccggttctgagtttaggttggccttagatttgaggcttgtcatcagctctttgtggagcgtgaatgtttgtaagttaatgattgaatttatgcaggtgtctgtgtaataaacctccagctcccgctgccgccgccgccgcttgaggtcagcgcgttcctctccaccgggcaccggcgcctcctccttcctgcggcgaccatggcggagcagacggagaaggctttcttgaagcagcccaaggtgtttctctgttccaagaaggccgccaaggggaacaagccaggcaagggagggaacaggttctggaagaacattggccttgggttcaagactcccagggaagccattgaaggaacctacattgataagaaatgcccattcactggcactgtgtctatcaggggtcgcatcattgctggaacatgccacagtgctaagatgaacaggaccatcattgttcgtaggaattatcttcactttgtcaagaagtaccagaggtacgagaagaggcactccaatatccctgcacacatttcaccatgcttccgtgtgaaggaaggagatcatgtcatcattggccagtgcaggccactatcaaagaccgtgaggttcaatgtgctcaaagtgatcccggcaggttcaaagagtggagcagtgaagaaggctttcactgccgcctaagatcatgatgagtgtgggtgttcgtcaagggcccagaaagcttctgtcataacattttgatgctgcctagccttttttccccatacctactacatgtactaggaatttgacttgaatcacttccagagctgaaatcttgaaaatttcgggatcctgtgtttatctgattgttcagttcctgactatttcagtca

SEQ ID NO: 627 - DNA, 690 bp, Echinochloa colona
cacgccttctatcctcgcgccgccgccgccatctacgccgtgcgccgcttccccgtcagtctcttcgagcatcaaccatggcggagcagactgagaaggctttcctcaagcagcctaaggtgttcctctgcccgaagaaggtcaccaagggaaacaagcccggcaaggggggcaacaggttctggaagagcattggccttggtttcaagactcccagggaagccattgaaggaacctacattgataagaaatgcccgttcaccggcactgtctcaattagaggtcgcatcattgctggaacatgccacagtgctaaaatgaacaggactatcattgttcgcaggaactaccttcacttcgtcaagaaataccagagatatgagaagaggcactctaacatccctgcccacatttccccctgcttccgtgtgaaggaaggagaccatgtgatcatcggccagtgcaggccactgtccaagaccgtgaggttcaatgtgctgaaggtgatccccgccggttcaaagagtggtgcagtgaagaaggcattcactgctgcctgatacctctgagattctgaaagcatagaccatgagattttgatttacctgtattcttattccatctgtactagggtttttgactaagaatattgtgcgaaattaaagtcaaagagcgctgaattcagcaata

SEQ ID NO: 628 - DNA, 773 bp, Echinochloa colona
cacgccttctatcctcgcgccgccgccgccatctacgccgtgcgccgcttccccgtcagtctcttcgagcatcaaccatggcggagcagactgagaaagctttcctcaagcaacctaaggtgttcctctgcccgaagaaggtcaccaagggaaacaagcccggcaaggggggcaacaggttctggaagagcattggccttggtttcaagactcccagggaagccattgaaggaacctacattgataagaaatgcccattcactggcactgtgtctatcaggggtcgcatcatcgctggaacatgccacagcgcaaagatgaacaggaccatcattgtgcgtaggaattatcttcactttgtcaagaagtaccagaggtatgagaagaggcactccaacatccctgcgcacatttctccgtgcttccgtgtgaaggaaggagaccatgtgatcattggccagtgcaggccactatcaaagaccgtgaggttcaacgtgctcaaagtcattccagcaggttcaaagagtggagctgtgaagaaggctttcactgccgcctaagatcatgatgagtaaactgtcagaggccctgggaaagcttttgttataacattagcctttttgtcatatgtactgtgtactaggaatttgacttgaatcacttccagagcttgaaatcgtgaaaatttcggaaccctggttttatctgatgcttagtacccttttgtttcagtcatatgtggtcctcagaatgctttctaggtgtcataattg

SEQ ID NO: 629 - DNA, 868 bp, Echinochloa colona
aagcagagaagaggctagggttttaagcctcgggcatttcttcgtctccgcagctcctgccgccgccgccgcttggggtcaccgcgttcctctccaccgggcaccggtgccacctcttttgcagccggcgaccatggcggagcagacggagaaggctttcttgaagcagcccaaggtgtttctctgtcccaagaaggctgccaagggaaacaagcctggcaagggagggaacaggttctggaagagcatcggccttggtttcaagactcccagggaagccattgaaggaacctacattgataagaaatgcccattcactggcactgtgtctatcaggggtcgcatcattgctggaacatgccacagcgcaaagatgaacaggaccatcattgtgcgtaggaattatcttcactttgtcaagaagtaccagaggtatgagaagaggcactccaacatccctgcgcacatttctccgtgcttccgtgtgaaggaaggagaccatgtgatcattggccagtgcaggccactatcaaagaccgtgaggttcaacgtgctcaaagtcattccagcaggttcaaagagtggagctgtgaagaaggctttcactgccgcctaagatcatgatgagtaaactgtcagaggccctgggaaagcttttgttataacattagcctttttgtcatatgtactgtgtactaggaatttgacttgaatcacttccagagcttgaaatcgtgaaaatttcggaaccctggttttatctgatgcttagtacccttttgtttcagtcatatgtggtcctcaggatgctttctaggtgtcataattgcttgaggtgtctgcataattgcatccatagtggacctta

SEQ ID NO: 630 - DNA, 666 bp, Setaria italica
cgccgccatctacgccgagcgccgcttccccgtcagtctcttggagcatcaaccatggcggagcagactgagaaggcttttcttaagcagccgaaggtgttcctctgcccgaagaaggccgccaaggggaacaagcccggcaaggggggcaacaggttctggaagagcattggccttggtttcaagactcccagggaggccattgaaggaacatacattgataagaaatgcccgttcactggcactgtgtcaattagaggtcgcatcattgctggaacatgccatagtgctaaaatgaacaggactatcattgttcgcaggaactaccttcactttgtcaagaaataccagaggtatgagaagaggcactctaacatccctgcccacatctccccctgcttccgtgtgaaggaaggagaccacgtgatcattggccagtgcaggccactgtccaagaccgtgaggttcaatgtgctgaaggtgatccctgccgggtcaaagagtggtgctgtgaagaaggcattcactgctgcctgaggaatacatcaaagattctgaaagctatgagattttgatgtcccattctgtattgcaattccatctgtcctaggatttttactgagaaaatatcgtctgaagttaaagtcaaagagcgctgaagttaag

SEQ ID NO: 631 - DNA, 709 bp, Setaria italica
ctcgggcatttcttcgtctccacagctcccgccgccgccgccgccgccgcttgaggtcagcgcgttcctctacaccgggcatcggcgcctcctccttcgcgcggcgaccatggcggagcagacggagaaggctttcttgaagcagcccaaggtgtttctctgttccaagaaggccgccaaggggaacaagcctggcaagggagggaacagattctggaagaacatcggccttgggttcaagactcccagggaagccattgaaggaacctacattgataagaaatgcccattcactggcactgtgtctatcaggggtcgcatcattgctggaacatgccatagtgctaagatgaacaggaccatcattgttcgtaggaattatcttcactttgtcaagaagtaccagaggtatgagaagagacactccaacatccctgcgcacatttcaccatgcttccgtgtgaaggaaggggatcatgtcatcattggccagtgcaggccactatcaaagaccgtgaggttcaatgtgctcaaagtgatcccggcaggttcaaagagtggagcagtgaagaaggctttcactgccgcttaagacatgatgagtaaaccgtcgagggcccggaaaagcttgtcataacattttgatgctgcctagccttttttttttctccatatcaattgtgtactaggaatttgacttgaatcactt

SEQ ID NO: 632 - DNA, 719 bp, Sorghum bicolor
catttcttcgtctccactgctcccgccgccgccgtcgccgtcgccgcttcggactagtgcgtcgctccaccgggtttcggcgtctctccttagcgcgcgacaatggcggagcagacggagaaggctttcttgaagcagcccaaggtgttcctctgttccaagaaggccgccaaggggaacaagcctggcaagggaggaaacaggttctggaagaacattggccttggtttcaagacgcccagggaagccattgaaggaacctacattgataagaaatgcccattcactggcactgtgtctatcaggggtcgcatcatcgccggaacatgccacagtgctaagatgaataggaccatcattgttcgtaggaattatcttcacttcgtcaagaagtaccagaggtatgagaagaggcactccaacatccctgcgcacatttcaccatgcttccgtgtcaaggaaggtgatcatgtgatcattggccagtgcaggccactgtcaaagactgtaagattcaatgtgctcaaagtcattcccgcaggttcaaagagtggagcagtcaagaaggctttcactgccgcctaagatcgatgagtgcatcgtcagtgcctgaaaaagctttgttataacgttttgatgctgcctagcctttttgtttcgtgtctactgtatgtgtacttggaattctaattgaattacatccagagcatggaatcgtg

SEQ ID NO: 633 - DNA, 730 bp, Sorghum bicolor
cttctatcctcgcgccgccgccgctgtcgccgtctacgccgtgcgccgctgcccgttagtcctctcgaacatcaaccatggcggagcagacagagaaggctttcctcaagcagcctaaggttttcctctgctcgaagaaggccgccaaggggaataagcctggcaagggtggcaacaggttctggaagaacattggccttggtttcaagactcccagggaagccatcgaaggaacctacattgataagaaatgcccattcactggcactgtgtcaattagaggccgcatcattgctggaacatgccatagcgccaaaatgaacaggaccatcattgttcgtaggaactaccttcactttgtcaagaaatatcagaggtatgagaagaggcactctaacatccccgcccacatttccccttgctttcgtgtgaaggaaggagaccatgtgattattggccagtgcaggccactgtccaagacggtgaggtttaatgtgctgaaggttatccctgccgggtcaaagagtggtgcagtgaagaaggcattcactgctgcctgaggaagaggaatacatcaaagattctgaaagatatagatcatgagaagattctgaaagttatagatcatgagaagattgcgaaagttataagatcacgagattttgatgtcagtttctatatgccatttgtactaggatttttgactcagagaaatatgtgcgaagttaaa

SEQ ID NO: 634 - DNA, 722 bp, Saccharum officinarum
ccgccgccgccgccaccgcctacgccgtgcgccgctgcccgttagtcctctcgaacatcaaccatggcggagcagacagagaaggctttcctcaagcagcctaaggttttcctctgctcgaagaaggccgccaaggggaataagcccgggaaggggggcaacaggttctggaagaacattggccttggtttcaagactcccagggaagccattgaaggaacctacattgataagaaatgcccgttcactggcactgtgtcaattagaggccgcatcattgctggaacatgtcatagcgctaaaatgaacaggactatcattgttcgtcggaactaccttcactttgtcaagaaatatcaaaggtatgagaagaggcactctaacatccccgcccacatttctccttgctttcgtgtgaaggaaggagaccatgtgatcattggccagtgcaggccactgtccaagacggtgaggtttaatgtgctgaaggtgatccctgccgggtcaaagagtggtgcagtgaagaaggcattcactgctgcctgaggaagaggaataatacatcaaagattctgaaagctatagatcatgagaagattctgaaagttatagatcatgagattttgatatcaagttctatatgccatttgtactaggatttttgactcagagaattatgtgcgaagttaaaagtcaaatgtgctgaattcagcaatattgtc

SEQ ID NO: 635 - DNA, 1436 bp, Panicum virgatum
gagtagggttttgtcttcgggcacgccttctatccttgcgccgccgccgccatctacgcccgagccgcttccccgtcagtctcttcgagcatcaaccatggccgagcagactgagaaggctttcctcaagcagcctaaggtgttcctctgcccgaagaaggccaccaaggggaacaagcctggcaagggcggcaacaggttctggaagaacattggccttggtttcaagactcccagagaagccattgaaggaacctacattgataagaaatgcccgttcaccggcactgtgtcaattagaggtcgcatcattgcgggaacatgccatagtgctaaaatgaacaggactatcattgttcgtaggaactaccttcacttcgtcaagaaataccagaggtatgagaagaggcactctaacatccctgcccacatttccccctgcttccgtgtgaaggaaggagaccacgtgatcattggccagtgcagaccactgtccaagaccgtgaggttcaatgtgctgaaggtgatccctgctgggtccaagagtggtgcagtaaagaaggcattcactgctgcctgagattctgaaaaccacagatcatcagattttgatgtcccattctgtattgctatttgatctgtactaggatttttgactgaaaatatcgtgagaaattaaagtcaaagagcggctgaattcagcaatattgtcaagacaaaaaaggttctgtaatactatgttgtgaatgctttgtttcagttagaagatcatttttgttgctggttgcaataatgcgggctttcagttgttctgtctagtgccgcatcgtctcagacgagcggtctaggcatgaatcgctaagatccacgccggatttgctgtcaggtggagctatgagtgtcatttgcagtagagtaaatgctcatgtatctgtgccagtatcgaccgtatctttgctgcccgtatctgtttagaatgcattaacagcgtagcttttgtggtgacaccagttgctgccaattcatcttcggatcatcatcaattcagcatgaccgggagcatctccagcagattggttatctctcatattttatatattttcttttaattttttttgtagtaagtgctatggtagattatctttcaaaaaatgtgctatggtagattaagcaaaagatagggcgaagggaggaactctctacatttgagcaagagggtgtgttttgaagattgctaaaacttttttgatattagtgatggattgatagtctgctggagcatcttctatcaccaaaaagataagttttttattgaggagagaaataggtaatatgctgaaaatgctctggtttcatgtggcgccctcctggccttctcgcgatgctagcacgctggcgtgcagcgtgatgcgccatcccgattcccgacggcctga

SEQ ID NO: 636 - DNA, 972 bp, Pennisetum glaucum
ttcttcgtctccacagctcccgccgcagccgccgccgcttgaggtcagcgcgctcctcctcaccgggcaccggctcctcctctcgttcgcgcggcgaccatggcggagcagacggagaaggctttcttgaagcagcccaaggtgtttctctgtcccaagaaggccgccaaggggaacaagcctggcaagggagggaacaggttctggaagaacattggccttgggttcaagactcccagggaagccattgaaggaacctacattgataagaaatgcccattcactggcactgtgtctatcaggggtcgcatcattgctggaacatgccacagtgctaagatgaacaggaccatcattgttcgtaggaattatcttcactttgtcaagaagtaccagaggtacgagaagaggcactccaatatccctgcacacatttcaccatgcttccgtgtgaaggaaggagatcatgtcatcattggccagtgcaggccactatcaaagaccgtgaggttcaatgtgctcaaagtgatcccggcaggttcaaagagtggagcagtgaagaaggctttcactgccgcctaagatcatgatgagtgtgggtgttcgtcaacggcccagaaagcttctgtcataacattttgatgctgcctagcctttttttcatacctactatgtgtactaggaatttcacttggatcacttccagagctgaaatcttgaaaaattcaggaccctgtgtttatctgattgttcagttcctgactatttcagtcatggtcacagactcctgagaatgcttcctaggtgtcatttgtttggcaaaaattagatctataccttgtttgaaatgccgcatccatcgtggcctgtacaggcttcagactgcctgcatccatcatgtggttgcaacaaaatcctgtttatgagggatcacttattgtgttgttgaagtatgaatctgagtggttttgc

SEQ ID NO: 637 - DNA, 708 bp, Saccharum officinarum
gtctccactgctcccgccgccgccgccgcttcggactagtgcgtcgctccaccgggttccggcgtctctccttagcgcggcgaccatggcggagcagacggaaagggctttcttgaagcagcccaaggtgtttctctgttccaagaaggccgccaaggggaacaagcctggcaagggaggaaacaggttctggaagaacattggccttggtttcaagacacccagggaagccattgaaggaacctacattgataagaaatgcccattcactggcactgtgtctatcaggggtcgcatcatcgccggaacatgccacagtgctaagatgaataggaccatcattgttcgtaggaattatcttcacttcgtcaagaagtaccagaggtatgagaagaggcactccaacatccctgcgcacatttcaccatgcttccgtgtcaaggaaggagatcatgtgatcattggccagtgcaggccactgtcaaagactgtaaggttcaatgtgcttaaggtcatacccgcaggttcaaagagtggagcagtgaagaaggctttcactgccgcttaagatcatgatgagtgcatcggccagggcctgaaaaagctttgtttaactttttgatgctgcctagcctttttttttcgtatctactatatgtgtactcggaattctacttgaattacatccagagcttgaatcgtgaaaat

SEQ ID NO: 638 - DNA, 1174 bp, Panicum virgatum
accgcacgtccgcacctggggcggcaaaagcggattccaacttcgctttgaatcctgtcgggctccgcgggctccgccatggccagattcggtcaccaactctgggtcaccaatgatgatgaggttgacccccaccgtggaggcctaagcacagcccaaccagctaacgatatcggcctcttctcaggatacaagtccattacagcccatccacggttatcactgcggctgaactcagaaaagcccactaggcccagtccgcctccggctccgccattcatttaagcagacaagaggctagggttttaagcctcaggcatttcttcgtctccacagctcccgccgcagccgccgccgcttggggtcagtgcgttcctcgccaccgggcaccggcgcctcctcgttcgcgcggcgaccatggcagagcagacggagaaggctttcttgaagcagcccaaggtgtttctctgtcccaagaaggctgccaaggggaacaagcctggcaagggtgggaacaggttctggaagaacatcggccttgggttcaagacccccagggaagccattgaaggaacctacattgataagaaatgcccattcactggcactgtgtctatcaggggtcgcatcattgctggaacatgccacagtgccaagatgaacaggaccatcattgttcgtaggaattaccttcactttgtcaagaagtaccagaggtatgagaagaggcactccaacatccccgcacacatttcaccatgcttccgcgtgaaggaaggagaccatgtgatcattggccagtgcagaccactatcaaagactgtgaggttcaatgtgctcaaagtcattccggcaggttcaaagagtggagcagtgaagaaagctttcacggctgcttaagatgatgatgagtaacccatctgagggcctgaaaagcctttgttataccattttgatgctgtctagcctttttcttttcatatctactgtgtactaggaacttgaatcacttccagtgcttgaaatcgtggaaatttcagaaccctgtgttgctcagtaccatccgattttagtcgtatttgtatgaaatgtttgcatctatagtggtctgtatcagcttcattggggccatactgcctgcaccaagtgattgcaacaaagttctattgccctc

SEQ ID NO: 639 - DNA, 859 bp, Panicum virgatum
ggccggggagggttttggcttcgggcacaccttctatccttgcgccgccaccgccatctacgccgagcgcctcttccccgtcagtctcttcgagcatcaaccatggccgagcagactgagaaggctttcctcaagcagcctaaggtgttcctctgcccgaagaaggccgccaaggggaacaagcctggcaaggggggcaacaggttctggaagaacattggccttggtttcaagactccccgagaagccattgaaggaacctacattgataagaaatgcccgttcactggcactgtgtcaattagaggtcgcatcattgcaggaacatgccatagtgctaaaatgaacaggactatcattgttcgtaggaactaccttcacttcgtcaagaaataccagaggtatgagaagaggcactccaacatccctgcccacatttccccctgcttccgtgtgaaggaaggagaccacgtgatcattggccagtgcagaccactgtccaagacggtgagattcaatgtgctgaaggtgatccctgccgggtccaagagtggtgccgtgaagaaggcattcactgccgcatgagattttgaaagccacagatcatcagattttgatgtcattgtgtattgctatttgatctgcactaggatttttgattgaaaataccgtgagaaattaaagtcaaagagcagctgaattcagcaatattgtcaagacaaaaaaaggttctgtaatactatgttgtgaatgctttgtttcagttagaagatcatttttgttgctggttgtgattatgcgggttgtcagttctgtccagtaccggagcgtctcagactagcggtctaggcatgaatca

SEQ ID NO: 640 - DNA, 727 bp, Pennisetum glaucum
cgccgccgccgccgccgagcgccggttccccgacactctcttcgagcatcaaccatggcggagcagactgagaaggctttcctcaagcagcctaaggtgttcctctgcccgaagaaggccgccaaggggaacaagcccggcaaggggggcaacaggttttggaagaacattggcctcggtttcaagactcccagggaggccattgaaggaacctacattgataagaaatgcccgttcactggcactgtgtcaattagaggtcgcatcattgctggtacatgccatagtgccaaaatgaacaggacgatcattgttcgcaggaactaccttcactttgtcaagaaataccagaggtatgagaagaggcactctaacatcccagcccacatctccccctgcttccgtgtcaaggaaggagaccatgtgatcattggccagtgcaggccactgtccaagaccgtgaggttcaatgtgctgaaggtgatccctgccgggtcaaagagtggtggtgctgtgaagaaggcattcactgctgcctgaggaatacatcaaagatcctgaaagccatagattttgagattttgatgtcccttgcaattccatctgtactaatatttttgactgagaatatcttgcaaaattaaagtcaaagagtgctgaattcagcaatattgttaagacaaaaggttcactgatgcttcgttgtgaatgctttgttttagtcaaa

SEQ ID NO: 641 - DNA, 1247 bp, Panicum virgatum
cgggctactaggctggggtcaccactcaccaaagactaaaagcagaagcccatcgatatcggcctcttctcaggatacgagcccattacggcccatccacgtctatcactgcggctgaactcagaaaagcccactaggcccagcccacctccggctccgccattcatttaagcagacaagaggctagggttttgagcctcgggcatttcttcgtctccgcagctcccgccgccgccgcttggggtcaagcgcgttcctcgccaccgggcacaggcgcctcctcgttcgcgcggcgaccatggcggagcagacggagaaggctttcttgaagcagcccaaggtgtttctatgtcccaagaaggccgccaaggggaacaagcctggcaagggtgggaacaggttctggaagaacatcggccttgggttcaagacccccagggaagccattgaaggaacctacattgataagaaatgcccgttcactggcactgtgtctatcaggggtcgcatcattgctggaacatgccacagtgctaagatgaacaggaccatcattgttcgtaggaattatcttcactttgtcaagaagtaccagaggtatgagaagaggcactccaacatccccgcccacatttcaccgtgcttccgcgtgaaggaaggagaccatgtgatcattggccagtgcggccactatcaaagactgtgaggttcaatgtgctcaaagtcattccggcaggttcaaagagtggagcagtgaagaaggctttcacggctgcttaagatgatgatgagcaacccatctgagggccggaaaagcttttgttataccattttgatgctgcctagcctttttttcatatctactgtgtactaggaatttgacttgagtcacttccagagcttgaaatagtgaaaatttcagaaccctgtgttgctcagtatcatccgattttagtcgtatttgtctgaaatgtttgcatctatagtggtctgttatcagcttcattggggctagactgcatgcaccatgtgattgcaagttctattccccataatgtttcgtgggatggagctggagaggccgggcggtggtgcttgaacacatgagaatagcagcctgaaagttacctggggcgtgatgccgcctcacaaacgtgaccacgctggaggggtttatgttccgtttgcaaaaccaatcatctaggaataaaatttagatcagattaaagtttaggtggctaagaatt

SEQ ID NO: 642 - DNA, 2694 bp, Zea mays
acagacaaactccaaaatggatgtgagacagcacttggggctgcgtaaacagatataagtgtcctgtcaccgtttaccgtccccgtgcgcagacgccgtctggcgttgtctctgtcgcttctcctccgtcgcggaattggagtgcagagtgctcttggggtggcttgcgtctccgtctcctcttgcggctccttcttcgacgcggcgctggagctgtcgccgcggatggaggccgccctggagctgcgggcgcgcgcgttcctcgcgctgcgtcgctacagcgaggtcgcggagatgctccgcgattacatccccagccgcggcaagtcgtgctctggcgaggacacctcctcgtcctcgtcggcgtccctcttgtccactggctccggtgatctcggcacgatctcccgcgccaaactcttctcgcccgaccgccaccgctccgacgacgcggaacctgacgctcgccccgtccgctccttccgctgcttcgacatctccgagcttaagcgccgcgtccttgccggcctctccaagaacccgagcacggatacccagtggaggtacttggtcctcggccaagcttgcttccacctcggcctcatcgaggacgctatggtgctgctgcagaccggccgccgcctcgcttcggtggcgttccgccgcgagagcgtgtgctggtcggacgacagtttctcgtcgtcgtcgtcctccgcgaccgccgcgactccctgcgtcccgtccggcaagacatccagctccggttcggcgttcataatcccaacgacggagtcggaggccgtgtcccagctcctggcgcacgtgaagctcctgctccggcgccgagcggctgccatggccgcgctggacgctggcctctcggccgaggccgtgcgccatgcggcgcacctcgagtccctgtccatcgacccgggccgccacttgctgtactcctactccgccgccgcgcacggattcgtggcggcgctgctaccggtccccgaggtgctccaggttgtgccggacgagatgttccagctccacaccacgcgcttcccagagttcttgggccttctcacgccggcctaccggcctgccatgggcaatctggaagcggccacgcacgacgtggtcataggggttcttgacaccggcgtatggccagagtcgccgagcttcgcgggcggcaacctgccgccatcgccggctcgctggaagggggtgtgcgaggctggcgtggatttcccgtcgagcttgtgcgggaggaagctggtgggcgcgtgcagcttctcgcgcggcctccgtgcggcaaacggcggcgcaataggtgtggggaagaggacgttcagaggagagtctagtagggtcctcggccgtttcttcgtctccacagctcccgccgccgcggaccagcgcgtcactctaccgggttccggcgtctccccgtagcgcggcatccatggcggagcagacggaaagggctttcttgaagcagcccaaggtgtttctctgttccaagaaggccaccaaggggaacaaacctggcaagggaggaaacaggttctggaagaacattggccttggtttcaagacacccagggaagccattgaaggaacctacattgataagaaatgtccattcaccggcactgtgtctatcaggggtcgcatcatcgccggaacatgccacagtgctaagatgaataggaccatcattgttcgtaggaattatcttcacttcgtcaagaagtaccagaggtatgagaagagacactccaacatccctgcgcacatttcaccatgcttccgtgtcaaggaaggagatcatgtgatcattggccagtgcaggccagtgtcgaagactgtaaggttcaatgtggtcaaagttattcctgcaggttcgaagagtggagcagtgaagaaagctttcactgccgcttaagatcatgacgagttcatcatccatggcccggaaaagctctgttataacgttttgatgctgcctattagcctttttccccgtaactactatatgtgtacttggaattggacttgaattacatccagaacttgaaatcctgaaaaaaaaatcataaccctttgtctgattgcttagcaccttttagtttcagtaaaagcatatgaccctcaaaatgttttctaggtcagtagtgatacgtttgaaaccttttggcatccatcttggcttgaaaaaattgctattttgacattctcaattgtggctctgtgctattatgccatattgtatctataaattataggaccatttgtgtatatgatttgcgggcctgatagcaaattagcggaatccagaaatgataacgacaaaattgcaaatggcctgactgcatcatgccgcaataagtttccctccgacaaaatccatactccatggtacctggtcgtacggacctggagattaataggctgtttggtttgaggattgagctagttcatcatcttctcactccttacttttttgtttggtttgtggaatggaatgagtcaatccatcattacctcattacttatagttagttagttagtactaatatgaggaatgaggtcatcccaccaaatttgaggaatggacacatgatgtactaccatattttggataaagtgattcctcaaaccaaacaccctctaaatcgtgcatgaactctgctgttc

SEQ ID NO: 643 - DNA, 717 bp, Oryza sativa
cgctgctgctcctcccgtgccgccgccgtctcgcgccagtgcgtctcttcctcgcgcggcgatcatggcggagcagactgagagggcattcttgaagcagcctaaggtttttctctgtcctaagaaaaccaccaaggggaagaagcctggcaagggcgggaataggttctggaagaacattggccttgggttcaagacacccagggaagccatcgaaggaacctacattgacaagaaatgcccattcactggtactgtatcaattaggggtcgtatcatagctggaacatgtcatagtgctaagatgaacaggaccattattgttcggaggaattatctgcactttgtcaagaagtaccagaggtacgagaagaggcactccaatattcctgctcacatttcaccgtgcttccgtgttaaggaaggagatcacgtgatcattggccagtgcaggccactgtcaaagaccgtgaggttcaatgtgctgaaggtcattccggcagggtcaaagagtggtgcagggaagaaggttttcacagccgcttaagatgtatatgaggagatattcagggttctgaaagctttgatcatgagattttgatgccacctagatgtctttctcgtgtctaccatcttgactagacaagagtttacctttctgtactaggaatttgacttgactttacttgtcaagcttaaaatcttaagaagtttctg

SEQ ID NO: 644 - DNA, 599 bp, Gerbera hybrid cultivar
gtctctgaaaagctcggatctctgcaacaatggctgaacagacggagaaggcatttttgaagcaaccgaaagtgtttctatgctcgaagaagagtgggaaagggaagaggcctgggaagggtggaaacagattctggaagagtgttggtcttggctttaagacacctcgagaagctattgaaggaacttacattgacaagaagtgccctttcactggtgatgtgtccattagaggccgtattcttgctggtacttgccacagtgccaagatggtcaggaccattattgtccgcaggaactacctccattatgtcaagaaatatcaaagatatgagaagaggcattcaaacattcccgcccacatctccccatgtttccgtgtgaaagaaggtgatcacgtcatcattggacaatgcagaccattgtctaagacggtgaggttcaacgtgctgaaggtgataccggctggatcttctggtggtggaaagaaggcgtttacaggcatataagaagcttatcttcttttagcttgaaattatattgttttgttgattttgaagtgggttaaatgttttgtagacgaatttgtgcacctctag

SEQ ID NO: 645 - DNA, 843 bp, Oryza sativa
ctcgggaatttcttcttctccgctgctgctcctcccgcgccgccgccgtctcgcgccagtgcgtctcttcctcgcgcggcgatcatggcggagcagactgagagggcattcttgaagcagcctaaggtttttctctgtcctaagaaaaccaccaaggggaagaagcctggcaagggcgggaataggttctggaagaacattggccttgggttcaagacacccagggaagccatcgaaggaacctacattgacaagaaatgcccattcactggtactgtatcaattaggggtcgtatcatagctggaacatgccatagtgctaagatgaacaggaccattattgttcggaggaattatctgcactttgtcaagaagtaccagaggtacgagaagaggcactccaatattcctgctcacatttcaccgtgcttccgtgttaaggaaggagatcacgtgatcattggccagtgcaggccactgtcaaagaccgtgaggttcaatgtgctgaaggtcattccggcagggtcaaagagtggtgcagggaagaaggttttcacagccgcttaagatgtatatgaggagatattcagggttctgaaagctttgatcatgagattttgatgccacctagatgtctttctcgtgtctaccatcttgactagacaagagtttacctttctgtactaggaatttgacttgactttacttgtcaagcttaaaatcttaagaagtttctgcgcccatgtctgtctgtgtactgatcgttttcccattcaatcaacatatagtttgtagaatgcttgacgatgtgaagatctatcaaaaaaaaaaaaagctcgtctc

SEQ ID NO: 646 - DNA, 552 bp, Bupleurum chinense
cgcgggggcacataagataacagagcttccgcctccagagtctctcagtatcgtatcctcagatcaaatcaatcagatatggccgaacaaactgagaaagcttttctcaagcagcctaaggtcttcctttgctcgaagaagtccgggaagggaaagaggccaggaaaaggagggaatcgattctacaagagcgtcggcctagggtttaagactcctagagaggctatcgaagggacatacattgacaaaaaatgcccgttcaccggagatgtatctattaggggccgtattcttgctggtacttgccacagtgctaaaatgatgaggactatcattgttcggcgcaactacctgcactacgtcaagaaataccagaggtacgagaagaggcattcaaacattccagctcacatatccccttgcttccgtgttaaagagggggatcatgtaattattggccagtgcaggccattgtcaaagacggtgagatttaatgttctgaaagtgattccagctgggtcttctggtggtggaaagaaagctttcactgga

SEQ ID NO: 647 - DNA, 688 bp, Cannabis sativa
gttttctcacttggtatcctcgtctcctacctctccacactccgcagccatggcagagcagaccgagaaggcttttcttaagcaaccaaaggtttttctaagctccaagaaatcttccaaggggaagagacctggaaagggagggaatcgtttctggaagagcgttggattgggtttcaagacccccagggaagcaattgaaggaacttacattgacaagaagtgcccatttaccggaactgtctctgtcagggggcgtattttagctggaacttgccacagtgctaagatggttaggaccatcattgttcggcggaattatcttcattttgtgaagaagtaccaaaggtatgagaagaggcactcaaatatcccagctcacatctcaccctgcttccgtgtgaaagaaggtgatcatgtgatcattggccagtgcaggccattgtcaaagactgtaaggttcaatgttctgaaggtggttcctgctggttcgtcaggtggcgggaagaaggcttttactggattgtgagctttatttctgatgttagttttgtgtttttttccggtttcccccactactttccaagtataattatgttatcaggggaagttttgaagttggattcttttagaggattgttatctaattttatttcatgatttgatatagaaatcttactttctctac

SEQ ID NO: 648 - DNA, 1058 bp, Cannabis sativa
ttactatataaacttctcattctctctccgtccgctgaattaggtttaggtttaggtttacttcttctgcttgagaccgaatagcaatggcggaacagactgagaaagccttcttgaagcagcctaaggtgtttctttgctcgaagaagtcatctaaaggaaagagacctggaaagggaggcaacagattctttaagagcgttggtttgggtttcaagactcccagagaggccattgaaggtacttatattgataagaaatgccctttcactggtaccgtctctgttaggggtcgaattctcgctggtacttgccatagtgccaagatggtgaggacaatcattgttaggcgaaactacctacattttgttaagaagtatcaaagatacgagaagaggcattcgaacattccagcgcatatttctccttgtttccgtgttaaggagggagaccatgtcatcattggacaatgcaggccattgtcgaagacagtgaggtttaatgtgttaaaggttgttccagctgggtcttcgggtggtggcaagaaggctttcacaggaatttaattcaattgttttctactttttgtttacattttatatttgagttgagtgaactaaattaggtatggctgtctactctactctttgagaaaaacttaaaacttattttcttcgatgtatgatgaattggtttccgattaaaccgcttgagtattgcaaattttgaactatgctgaataccctaaggctgataagctctgttttgttttgttgagtgaataccattgttttatgtctattcttagatggttgccgatcattcggattaggaaactagggttaaattttagagatgtatgactttttgtgaaagaaagtttgattaagctaaatcagaatgggctaaattatatgtttcggtgcaagacagcacgggcgggcaagatttaggtaatgcacgagcgttttactgttgagcgaagttgattcgttcaatcctttcgtacttgttggagtgaggtttgagagtggaaggattgaatgaactaaaactcg

SEQ ID NO: 649 - DNA, 975 bp, Daucus carota
ctgtttaaccctcacacactctcattcgttgccgccgctcactagttgctgcaactctctcattaatcatggcggaacagaccgagaaggcgtttctgaagcagcccaaggtgtttctctgctcgaagaagtcaggaaagggaaagaggcctggaaagggaggaaaccgtttctacaagagcgttggtttgggattcaagactccccgagaggctatcgaaggtacctacatagacaagaaatgtcccttcactggagatgtctctatcaggggcagaattcttgctggcacttgtcacagtgcaaagatgatgagaactatcattgttcgccgtaactaccttcattatgtcaagaaatatcagaggtatgagaaaaggcattcaaatattccagctcatatatctccttgcttccgtgtcaaagaaggagaccatgtcatcattggacagtgcaggcctttgtccaagactgtgagattcaatgtcttgaaagtgatcccagcagggtcttctggaggtggcaagaaggcttttactggaatttgagctgtgttgggtcttttatttagttttatagtatttggagagaatggctgttagagactctgtttaggtggaatcctccccctaagggccgagttactctttgaaagttgaaatttttgtatgtgaccaattaatgaatttcctgtcaagcatgttacaagatctgttttgaattatctttgagtattttaatggtctgttcccttttagataatcttggccggatgtagctaattgtaggggatacctgttaagtttgtgttaccggtatcttgcgtttatatactgtaagtttagtgtaggcatttcggataaaggttgtttaagatgagctgaacccagacataagatcccaaaatgtctcttagttcagtttctacagttgcagagttggccagatcttagttcagtttctacagttgcagag

SEQ ID NO: 650 - DNA, 670 bp, Daucus carota
acactctcattcgtcgccgccgctcagtcgttgctggaactgtctcactaatcatggcggaacagaccgagaaggcgtttctgaagcagcccaaggtgtttctctgctcgaagaagtcaggaaagggaaagaggcctggaaagggaggaaaccgtttctacaagagcgttggtttgggattcaagactccccgagaggctatcgaagggacatacattgacaagaaatgcccgttcaccggagatgtatcaattagaggccgtattcttgccggtacttgtcacagtgctaaaatgatgaggaccatcattgttcgacgcaactacctgcattatgttaagaaataccagaggtatgagaagagacactcaaacattccagctcacatctctccatgctttcgtgttaaggagggtgaccatgttattattggccagtgcaggccattgtcaaagactgtgagatttaatgtgctgaaagtgattccagctggatcttcaggcggtgggaaaaaagcttttaccgggatttaagtttttaatcatgcttttttggttagtcctatattgtggcttgtggtgttggagataatgtggtgttatattatttgttacttttaactagatggattttcttgtttattcatcaatgtatgccagattgtttacat

SEQ ID NO: 651 - DNA, 762 bp, Daucus carota
gccattcgatcttgaagccgacccttcgctggatttataaacacattaagcttccgcctcctctctctcaattccttcaattcagatcagccatggcagaacaaactgaaaaggcgtttcttaagcagcccaaggtcttcctctgctcgaagaagtctggcaagggaaagaggcccgggaagggagggaatcgattctacaagagtgtcggtctcggcttcaagactccccgagaggctatcgaagggacatacattgacaagaaatgcccgttcaccggagatgtatcaattagaggccgtattcttgccggtacttgtcacagtgctaaaatgatgaggaccatcattgttcgacgcaactacctgcattatgttaagaaataccagaggtatgagaagagacactcaaacattccagctcacatctctccatgctttcgtgtgaaggagggtgaccatgttattattggccagtgcaggccattgtcaaagactgtgagatttaatgtgctgaaagtgattccagctggatcttcaggcggtggaaaaaaagcttttaccgggatttaagtttttaatcatgcttttttggttagtcctatattgaggcttgtggtgttggagataatgtggtgttatattatttgttacttttaactagaaggattttcttgtttattcatcaatgtatgccagattgtttacattgatcaatttagtgttttaaatactgcttcagcttcttgtttacagttctgcc

SEQ ID NO: 652 - DNA, 879 bp, Citrus clementina
ctccgcgcttgatttagggttttctgcattgtgttagccacctccgcccagtgcgttcatcatcctcaacaactcagccccgaaatccagccatggcggagcagaccgagaaggcgtttttgaagcagcccaaggtgtttctcagctcgaagaaggcaggaaaaggaaagaggccaggaaagggagggaatcgattctggaagagcataggcttgggattcaagactcccagagaggcaattgaagggacttacattgataagaagtgtccgttcaccggcactgtttccatcaggggtcgtatccttgctggtacttgccacagtgctaagatgaacagaaccatcatcgttaggcgtaactaccttcactttgtgaagaaatatcagaggtatgagaagaggcactctaacattccagcacacatctcaccttgtttccgtgtgaaagagggagaccatgttatcattggccagtgcaggcctttgtcaaagacggtcaggtttaatgtcttgaaagtgatacctgctgggtcttctggtggtgcaaagaaggcattcacggcgatgtgagttggagtcggctgtttccaacattaaatttttgctacttttgttccatgggactttgttatttggatttttgcattgggaattaaatcctgttatgtcctaatatatattttctagagaagttaatttttccttttgcttgttagtattttctttggtttggttatgacattgttttattccatatttgttcaatgggatgaatgcgtagtgactctgttattgcttaggaaaataagtgtcgattcctatacctttttattttcactttaaatttttgttatggaaaggatgaatttgcatgtgc

SEQ ID NO: 653 - DNA, 856 bp, Linum usitatissimum
ctctactgaagcttcagcttggattagggtttctggtacttatctccgccgtcgctgcgtctttgctccctcgcctcagttagtcagttgtcactcctcagtcctcacaatctcgcaaccatggccgagcagacggagaaggcttttctgaagcagcccaaggtgttccttagttctaagaagtcttcgaaagggaagaggcctggaaaaggaggcaaccgtttctggaagagcgtcggcttgggtttcaagactcctagagaagcaattgaagggacatacattgataagaaatgtccgtttactggaactgtttctatcagaggccgtatcattgccggtacttgtcacagtgccaagatgatgagaaccattgttgtgaggcgcaattaccttcattacataaagaaataccaaaggtatgagaagaggcattccaacatcccagcacatgtatctccatgcttccgtgtgaaggagggtgaccatgtcatcattgggcaatgcaggcctctatcgaagactgtaaggttcaacgtgctgaaagtggttcctgctggttcttccggcggagggaagaaagcattcaccggcatgtgagaaggctgaaattgaagagtatccaggggtttgtagaatagggcctgttagaagaggaatccatccaatttgagggtcaactttggttcatgtttttgtgcgcggatattgttacttgttagttgttgatgaagtcattcagaacttgtttttgttgagaagagatctgtttcgagctcgagttattataatccctaaagtattaccttctcctatgtcatctgaatcgtgtgtttggtaattgatctttgagttt

SEQ ID NO: 654 - DNA, 879 bp, Citrus sinensis
ctccgcgcttgatttagggttttctgcattgtgttagccacctccgcccagtgcgttcatcatcctcaacaactcagccccgaaatccagccatggcggagcagaccgagaaggcgtttttgaagcagcccaaggtgtttctcagctcgaagaaggcaggaaaaggaaagaggccaggaaagggagggaatcgattctggaagagcataggcttgggattcaagactcccagagaggcaattgaagggacttacatcgataagaagtgtccgttcaccggcactgtttccatcaggggtcgtatccttgctggtacttgccacagtgctaagatgaacagaaccatcatcgttaggcgtaactaccttcactttgtgaagaaatatcagaggtatgagaagaggcactctaacattccagcacacatctcaccttgtttccgtgtgaaagagggagaccatgttatcattggccagtgcaggcctttgtcaaagacggtcaggtttaatgtcttgaaagtgatacctgctgggtcttctggtggtgcaaagaaggcattcacggcgatgtgagttggagtccgctgtttccaacattaaatttttgctacttttgttccatgggactttgttatttggatttttgcattgggaattaaatccttttatgtcctaatatatattttctagagaagttaatttttccttttgcttgttagtattttctttggtttggttatgacattgttttattccatatttgttcaatgggatgaatgcatagtgactctgttattgcttaggaaaataagtgtcgattcctatacctttttattttcactttaaatttttgttatggaaaggatgaatttgcatgtgc

SEQ ID NO: 655 - DNA, 1996 bp, Petroselinum crispum
tgttaatctagggtttttagtcccctttggattttcattttacagaaaaagcagcctccgcctccaggaattcaattcaatcatggcagaacaaactgagaaagcatttcttaagcagcccaaggtcttcctctgctcgaagaagtcgggaaagggaaagaggccaggaaaaggaggaaatcgattctacaagagtgtcggtcttggcttcaagactccccgagaggctatcgaagggacatacattgacaagaaatgcccatttactggagatgtatcaattagaggccgtatccttgccggtacttgtcacagtgccaaaatggtgaggactatcatcgttcggcgcaactacttgcattatgttaagaaataccagaggtatgagaagaggcattcaaacattccagctcacatctctccctgcttccgtgtgaaggagggtgaccatgtaattattggccagtgcaggccattgtcaaagactgtgagatttaatgtgctgaaagtgattccagctggatcttcaggtggtggaaagaaagcttttactgggatttaagtttttaattatgcttctttgttagtgttaaatcgtggctcgtgagtgatggagatgatgtggtgttatttttgttacttttaaatagatgggattttctttgattctcaatgcatgccagattgtttacatgacctatttaatatttcaaatattgctttagttactcgttaagagttgtgtattggactaatttatttatttccggtacccagtcattgttattattttttcccgggttgaaaagaacagatgaccacagaaattagttgcttgtagtaccctctgttatttaaattttaagaatgaactccctttaatttttctcatgctaagtttaagaaagtgttgcacattgttgcttttgagctcaagagccttgaatgatgagtgtgtttaagatgaacctgggttctgcatactttagtttgagggcaggatccattagatgaatttcagaaaactagtttatagttttcagaacaagacagatttgagatgtataatgttgagaaagactagtgatctattttaaattccatcagtcccgtgtgtcttattttagcctatcttgttcattaggacggtaatttcaattgtatcagttacctggacccggtaccctgtctgaaatatggagttaatctcagagccttataacataaaatgttgaaggtaatgagtgtgtatatatttgaaagagcattattccactcttgttccttcctcctacatttgctaaaggtcttaacttgcgaagtagtaatactctgatactcgtgaacttgcaaagtaatactcttaatcgcttatacttgtgattttgtatttaggccccttaagttattggaacgttaataaatattaaaatatgtttaaatgacctccttaacccttatttgcttttcttttcccttgtggaaatttttgcattcacgtaatgggtacaaaaaacatttttagatgaaatgcatatacgctgtttatactcttgtgatattttcagcagtattatggtatcactaacttatatgactgtcacattttaatgttctaccaatgttgaactaatagaaggacattcttaatactaaaattgcttgagatattcccaactgtattattgtatcattaacttttgtgatgtttcgatgctttattaaaatgtttgagtaacgagcgagtggatattctaaatacagaattgtaaggactagggtatttaatgtaagaagcaaagggtggtgacacgatcggcaaacctcaattgcacagaggtaacctttgaacatggaaattacacaaaacaaagtaaacccagagtaacggaacatctatcatatgtaagaagagctgagaattatcaaagcctcacggccacacggtaggttgcaggagcaactgtggcagcaaatgacccattaaaaaacaaaa

SEQ ID NO: 656 - DNA, 1086 bp, Petroselinum crispum
atctatctctatagccctctaatactcgtcgccgccgctgagtctccagagcttacttgttcttcaaacccatctttaaccatggcggaacagaccgagaaagcgtttttgaagcagcccaaggtgtttctctgctcgaagaagtcaggaaagggaaagaggcctggaaagggaggaaaccgtttttacaagagcgttggattgggcttcaagactccccgtgaggctattgaaggtacctacatagataagaaatgtccctttaccggagatgtctctatcaggggcaggattcttgctggcacttgccacagtgcaaagatggtgagaactatcattgttcgccgtaactaccttcattatgtcaagaaatatcagaggtatgagaaaaggcattcaaatattccagctcatatatctccttgcttccgtgtcaaagaaggagaccatgttatcattggccagtgcaggcccttgtcaaagactgtgagattcaatgtcttgaaagtgatcccagcagggtcttccggaggtggcaagaaggcttttactggaatttgagctctgtattatgtcttttatttagttttgtagcatttggagagaatggctgttagagttatcactctgtttaggtgggatcttcctcctaagggctgagttactctttaaagttcaaatttttgtatgcgaccattttaatgattttcaatcaaagcatgttttaagatttttattttaaatcatgttaaagtgattttcattgttagttggtattttataatcccgcgttcagtaccgtgttggtattcatatatatgtcaattggtaaaatataagaaatgattctaggaaatccttgaatacatggttgctccagttcaggttcacatggcatctaaatcaatctgtcattgcaattttatagtttttagcttggctgagttttgttttattccctagtggccatttgaatcaccgggccaaaggaaaacttgcctgggaggttgcttgatattcttgacttgctggaaaatagactgtgagagcatatcaagtagaggcacccattaaatatacaacaga

SEQ ID NO: 657 - DNA, 3102 bp, Ananas comosus
cacacaaaccggaccaacccatacatgctacatcgggtctaaacccgcatataaatttgtatacggatcccctatctttcgttctccactcccaagtatataaaccgaggctagggtttcagatacgccgttgcttccgccgcgcttgtatcgtctccacctccctcctagggtttctgcgctctctccctctgatcgaccatggcggagcagactgagaaggcgttcctgaagcagcctaaggtgtttttatgctcaaagaaatctggaaagggaaagaggcctggcaagggtggaaacagattttggaagagcattggacttgggttcaagactcccagggaagctattgaaggaacctatattgataagaaatgcccatttaccggaactgtgtcgatcaggggtcgcatcttagcgggcacatgccacagtgctaagatgaacagaaccatcattgtccgtcggaattaccttcactatgttaaaaagtatcagagatacgagaagaggcattcgaacatacctgcgcacatatcgccctgcttccgtgtgaaggaaggagatcatgttattatcggccaatgcaggcctctgtctaagaccgtgaggttcaacgtgttgaaagtcattccggctggatcgacgggcggtggtaagaaggcttttaccgcagcctaaggtagccagctagcttcctgaggaaaaagattttaagagtgctggatctggaagaaaatttacgctgctgagccagctattgtagggtttatttgttttatgcttttgagatattttgttggctgaaattatctgagcttttgaacagagaatgatatagattacgccgtgctgttatccgaactgtttgattttgggaactggcgagtctgagattttgggtctgaaattttaagcagttgcagttcttcgtcattgtggtgtctcttttctctcgttaagtttcctgcagtagtcatgcttgttttgtcttagctgaccattaattttaaatccaatgcaaggattgccggtgccggttgcagtgcgtgcttacatataaaactaaaataggattgccaagatggtgtactgccatccactagctagtaattttgttcaagacgcgtgctgatatttgtcgaaatcatttcttttggaggatgatgcaatagatggtctgattttgcagagcttttacttctatttttctcctttctttttccagagtttgaaagtaaatctttttctgttctattcttcaaatcgagattgattcgttctccgctgcaggaaagtttacacattatatatagtccattacgaacgacgggaaaactatgaacttctttctccaaacaataacaagggcagaaaataacaacactgagtgtttttacgtgagaatattcatccaatgactcgggatactctctataatatggtgctttatacatcccataaacacacaataaaacacaaataaaacacagtcaagcttaacaacacatcacaaacccactcaaactctaatgcaagcaaatgcttgcttggattaaaccacaaatcctctcacaaactaatctttgattcatctaatattaggcattcaaccgactgtaacactcagagcggactcacttcctgacatatagttggggatgctcgacgcccacttgatcttttcttcaagtttgaagaaaactgcgaacgataacattccttctcttcctcaccttggcaggcatatatatgtttagatacattttatttcttcttaacagttgcacatgagctgagaaaagtgtatagaccttcaatctattgtctccaacattatcaattgccgagtctgtacctgcacattagttgttctattgctaatgtttccatacgatgccatcgaccctttgacatgtgaaggcatgggggatctgacagtttaagaatgtaaaatcaactgaagaaaactacaacatttctgagacataatgtgcgacatagatcaaaggacgccatacaaaaagagtaaggtacactggtactgcttttcgtctatcagaacacttttattttcatgaagaaatgaacatatagattaaaaataagacctggaattaaacattatggcctttaatgtctatctttctttcattttcccaatatgccagaagcatacaaggtttcagatcaggaaaacagagaggtcaccggttctttatagcagggcccaatatgataaataaaataaaggacaactataattgtatacctcatgatgtaaggtgaaaaactcttcgacatgcacgatgtgcgagttaactcaatttgcctgatatcatattgttcagccattataacacttcaccgcactaaggtaagagctcttgttgcccgctagcactgcagacgttatttcatgccattaattcttagtttccgctcgtataagacgcctcgatcactccatcctctccaacttgatatgccctctgctcttctgccacagaatttctctgaaagctcaattcttcaaatatatcaggaaaaccctgtatccgccagccagcaaacaaaacttcagaatgactggtcaagaagggccgccgttacataaaggatgcacaaggcaaactaacttctccctcagtttcccgaagttacgacctataaatgtttatgttagcctcattcggcatcccgatctattcttccgccacagagtgcggagatcagacgataatcctcactcacacccacacccctcaaaagactccacttagcacattgtcttcatccgaccttttagaccccagctcttttcgcggcttgggcgagagccccttcgcgagcatctcctcgtcgtacttcctcgccatctccaccatccccctctgcagcagggcgtcgatcagcgcgttgtacgcgaaggcatcagggctacacccgtgctcctccatcttcttccaaacgacaaacaccggccgcagaaacccccaccgcccgaaccgcttgatcagcatcacgtacgtgtccgtcctcggccggcaccccctctcgagcatccgctcgaacagcgccagaacctcctgcggccggttc

SEQ ID NO: 658 - DNA, 785 bp, Eragrostis curvula
ctctgccgccgccgcttcgccgctcgacgcccacagcgcaaccatggcggagcagactgagaaggctttcctcaagcagccgaatgttttcctaagctcaaagaaatctggcaagggtaagaagccaggaaagggcggcaaccgtttctggaagagcattggccttggattcaagacccccagggaggcaattgaagggacctacattgacaagaagtgcccattcactggaacagtttctatcagaggcaggattattgctggaacatgccacagtgctaagatgaacaggactatcattgttcgcaggaactacctccatttcgttaagaaataccagaggtatgagaagaggcactccaacattccagcccacatctcgccatgcttccgtgtcaaggaaggcgaccatgtcatcattggccagtgcaggcccctgtcaaagaccgtgaggttcaacgtcctgaaagtcgtcccagctggatccaccggtggcagcggcgggaagaaggccttcactgcagcttagactatgttccatgagtagtctatagaatgatgatgttttgttgcttaaatttcctgttaggctggtgttttcgactatgaattggagatgtatcctgtcaaacgaagtctcgtcatctgaacatgttgctgtttatggaaatcttgtcgtgcaaaagttttgctaaaaaaaaacaaaaaaaaaaaaaaaaaaaagtacccgccgctcacaccaccgcttaaccaccaccgaattcccggccccctgcaggcccacc

SEQ ID NO: 659 - DNA, 492 bp, Bupleurum chinense
tggcggaacagaccgagaaggcatttttgaagcaacccaaggtgtttctctgctcgaagaaatctggaaaaggaaagagacctggaaagggagggaatcgtttttacaagagtgtcggcttagggttcaagactcctagagaggctattgaaggtacttacatagacaagaaatgtccgtttactggagatgtttctatcaggggccgtattcttgctgcacttgccacagtgccaagatgatgaggaccatcattgttcgaccgtaactacctgcattatgtacaaaaaatatcagaggtatgagaaaaggcattcaaatattccagctcacatatctccgtgcttccgtgtcaaagaaggagaccatgttatcattgggcaatgcaggcctttgtcaaagactgtgaggttcaatgtcttaaaagtgatcccagcggggtcttctggaggtggcaagaaggcgtttactggagtttgagctctgtatgaa

SEQ ID NO: 660 - DNA, 774 bp, Acacia harpophylla
gtcttcctctgtaaacctcctcggccggccgttacttcctttggcagatagatccccagcaaccatggctgaacaaactgagaaggcttttctgaagcaacccaaagtgtttttgtgctccaacaaatctgggaagggaaagaggcctggtaaaggtgggaatcgcttctggaaatccattggtcttggattcaagacccccagggaggccattgaaggaacctatattgataagaagtgcccctttgctggtactgtttctatccgaggtcgcattatagctggcacttgtcatagtgctaagatgacaaggaccattattgttaggcggaattatcttcattttgtcaaaaagtatcagagatatgagaagaggcattcaaatattgctgctcatatatccccttgctttcgtgtgaaggaaggggatcatgttattattggtcaatgcaggccactctcaaagacagtaagattcaatgtgttgaaggttatccctgcgggatcttctggtggtgtgaagaaggcattcactggagcttgaagttgattgtcagttttcaatgtaggttatttcagtaatagattatactatccttcgtgaaagatttcccccctggataatgtgactaaagttttgatcatttgtattgaccttttttcagtgaggttagaatttaccaattaaatgtggttttctagtgattcagcgttgtatattttggcattctgttaatgctcagttttaattgaagtgtgtttacaaccaaaaaa

SEQ ID NO: 661 - DNA, 547 bp, Theobroma cacao
ctctcatttttacttctctttgcccgcagcagccgcgcctcactccctccagagagctcatcaaccatggcagaacagaccgagaaggcatttttgaagcaacccaaagtgtttttaagctcgaagaaatctgggaaagggaagagaccaggaaagggagggaaccgcttctggaagagcattggtttgggcttcaagactcctcgtgaagctattgaaggaacctacattgataagaaatgcccattcactggcactgtttccatcaggggtcgtatcttagctggtacttgtcatagtgccaagatgatgaggacaatcattgttcgacggaattaccttcattatatcaagaaataccaaaggtatgagaagaggcattcaaacattcctgcacatatttctccatgcttccgtgtgaaggaaggggatcatgtcattatcgggcaatgcaggccattgtcaaagactgtgaggttcaacgttttgaaagtgattcctgctggatcttctggtggtgggaagaaagctttcactggaatataag

SEQ ID NO: 662 - DNA, 752 bp, Centaurea maculosa
ttcaccatcattgaaatatagagacaccattttttagggtttagtgctgctttctcttcttcttctctcattcctctttgtgccgaatagctccatcggatttggatctcttcaacaatggcggaacagacggagaaggcgtttttgaagcaacccaaggtgtttttatgctccaagaaaagtgggaaaggaaagaggcctgggaagggtggaaacagattctggaagagtgttggtcttggatttaagacaccaagagaagctattgaaggaacttacatcgacaagaagtgccctttcaccggtgatgtctccatcagaggtcgtattcttgctggtacttgccacagtgctaagatggtgaggaccatcattgttcgtaggaactatctccattttgtcaagaaataccaaagatatgaaaagaggcattccaacattccagctcacatttctccctgcttccgtgtgagagaaggcgatcacgtcactgttggacagtgcagaccattgtcaaagactgttaggttcaatgtgttgaaggttatcccggctggttcttctggtggtggcaagaaggcgtttaccggcatataagaagcttaccttcatcaatttggttgttttgagtgaaatgtggttcagtttaatgcttctgcagacatagtttttttgatatagttgtcgtttattttttatgtttacggttctgagatgattgcaagtttaacaatcgaagttttgatttgata

SEQ ID NO: 663 - DNA, 679 bp, Centaurea maculosa
tctttgtgccgaatagctccatcggatttggatctcttcaacaatggcggaacagacggagaaggcgtttttgaagcaacccaaggtgtttttatgctccaagaaaagtgggaaaggaaagaggcctgggaagggtggaaacagattctggaagagtgttggtcttggattcaagacaccaagagaagctattgaaggaacttacattgacaagaagtgccctttcaccggtgatgtctccatcagaggtcgtattcttgctggtacttgccacagtgccaagatggtgaggaccatcattgttcgtaggaactatctccattttgtcaagaaataccaaagatatgaaaagaggcattccaacattccagctcacatttctccctgcttccgtgtgagagaaggcgatcacgtcactgttggacagtgcagaccattgtcaaagacggttaggttcaatgtgttgaaggttatcccggctggatcttctggtggtggcaagaaggcgtttaccggcatataagaagcaaccctaccttcatcaatttggttgttttgagtgtaatgtggttcagtctaatgcttctgcagacatagttttttgatatagttgtcgtttattttgtatgtttacggatatgagatgattgcaagtttaacaatcgaagttttgatttga

SEQ ID NO: 664 - DNA, 962 bp, Gossypium hirsutum
ctttatgaaagactgaaagccgagctatttaattagggttagggttttatcagtgcaagcctctctgcggttttcatttccccttcgcaagtagccagccgtttcacacactcaagaagagagagagctcgtaaatcatggcggaacagaccgaaaaagcttttttgaagcaacccaaagtgtttttgagctcgaagaaaggtgggaaagggaagaggccaggaaagggtgggaatcgcttctggaaaagcattggattgggcttcaagactccccgtgaagctattgaaggaacctacatcgataagaaatgccccttcactggcactgtttcaatccggggtcgtatcttagccggtacttgccacagtgccaagatggtcaggacaatcattgttcgacggaactaccttcattatatcaagaaataccaaaggtatgagaagcgccattcaaacatccccgcacatatttcaccatgcttccgtgtgaaggaaggggatcatgtcattattgggcaatgcaggccgttgtcgaagaccgtgaggttcaatgttttgaaagtgattccagcaggatcttccggtggtgggaagaaagctttcaccggaatgtaagcttttctatggtagtccatggttataggaaccaatagagaagataatcaaagaaattaagttcttaaactgcatttagctttgaggatattttactgttagaattgttttctttttttgggttattttcttgttttgattttgtcgaattacgaaatccggaattttgaagatatctttatttaagtttggctttggaatttttgcttcattcctattattttgctttctaagaatgaatttagatttatgggtgaactatgaatgagggcataaattcttcaattcttatgaacttgctttggacatatgggtcaaataagattttggtcctacaattgtact

SEQ ID NO: 665 - DNA, 725 bp, Vigna unguiculata
gggtttctgtgggctacttcatccctgtcgtctgtgccgcacccctctaccatggctgaacaaaccgagaaggcgtttttgaagcaaccaaaagtgttcctctgctcgaagaaatctggaaaggggaagagacctgggaaaggtggaaatcgcttttggaaatccattggactcggatttaagactcccagagatgccatcgaaggaacctacatcgacaagaagtgccccttcaccggcaatgtctctattcgtggccgtatccttgctggaacatgtcatagtgctaagatgaataggactattattgttaggaggaattatctccattttattaagaagtatcagaggtatgagaagaggcactccaatattcctgctcatatatcaccttgcttccgcgtgaaggaaggtgatcatgtcattattggtcaatgcaggccactctccaagacggtgaggttcaatgtgttgaaggtgattcctgcaggatcttccagcggtgcgaagaaggcatttaccggaatgtgagctttgttttccagttttaggattttgttatacgttgtgctagctttgtatttttttttaaacaatgtagactctttactgttttcagtacttttattttagtgttattctgggtttaaagttgggggaattgtttttagactgagatctaaagttttgctctaatcaatttgaaacaaatctttttgctacaa

SEQ ID NO: 666 - DNA, 817 bp, Cucurbita pepo
tcgaactctgctccttcggccgcccgagcgaaccagaacgcttgctctcttcggaagccctaatcatggcggagcagaccgagaaggcgtttttgaagcaacccaaggtttttctctgctctaaaaagggcgggaaggggaagagacctggaaagggcgggaaccgtttctggaagagtattggattaggattcaagacgccaagggaagccgttgaaggaacatatattgataagaaatgcccctttaccggaactgtctctatcaggggacgtattttagctggaacatgtcatagtgctaaaatggtcaggaccattattgtcaggaggaactatctacactatgttaagaagtatcagaggtatgagaaaaggcactccaacattcctgcccacatatctccttgctttcgtgtgaaggagggagatcacgttattatcggccaatgcaggccattgtcgaagacagttaggttcaatgtgttgaaggtcattcctgctggatcctcaagtagtgggaagaaggcttttacggggatttaaataacgtaggcttcctcttttgatacaaaaacagcaactgtttagagttgtatgccatatttaattcaacagagttttgaagacttataatctgaattttgattcgagtatggactgttttattgtgttctatttgttttgatttctggtaaatttaggtgggtaatctcaaggattaatgttagattgttcatgtttcaattgaaacgccccttgattgatgaattattaatttgattaaaaagggttaaagcggcttcttagttcattag

SEQ ID NO: 667 - DNA, 723 bp, Cucurbita pepo
gcttaggcttctatcggatcttcgaaaccctgatcatggcggaacagacggagaaggcttttctgaagcagcccaaggtgtttcttagctcgaagaaatcgggaaaaggaaagagaccaggaaaaggaggaaatcggttctggaagagtattggtttgggattcaaaactccaagagaggcaattgaaggaacatacatcgataagaagtgcccattcactggcactgtttctatcaggggacgtatacttgctgggacctgccacagtgccaagatggtgagaaccatcattgttagacgtaattatctacactacgtgaagaaatatcaaaggtacgaaaagagacactctaacattccagcacacatagctccttgctttagggtaaaagagggagaccatgtcatcattggccagtgcaggccgttgtcaaagaccgtgaggtttaatgtattgaaagtcattcctgctggatcatccacagctggtaagaaggccttcacaggaatttaagcccagaattttcaggtcccgtatttgtttatgttaaagagatgatatgttagcatgagtttttttctcagctagatgatcttttcacttcatttgttgaccgaatatttcattattgtgatactactactgcaattttgatccctaagttttgctcagtaccttcgtgtttaacttcttaattaacagcataaccttcaatgccttc

SEQ ID NO: 668 - DNA, 732 bp, Cucurbita pepo
cgtctattgtagcttcgataccctaatcatggcggaacagacggagaaggcttttctcaagcagcctaaggtgtttcttagctcgaagaaatcggggaaaggaaagaggccaggaaaaggaggaaaccggttttggaagagcattggcttggggtttaaaactccaagagaggctattgaaggaacatatattgataagaagtgtccattcactggcactgtttctattagggggcgtatactggcaggtacctgccacagtgccaagatggtgagaaccatcattgttagacgtaattatcttcactatgtgaagaagtatcaaaggtacgaaaagagacactctaacattccagcacacatagctccttgctttagggtgaaagagggagaccacgtcatcattggccagtgcaggcctttgtcgaagacagtgaggtttaatgtattaaaagtgattcctgctggatcatccacagctggtaagaaggctttcaccggaatttaagtcgagaattttcaggtccagtatttgtttatgtgaaggggatgatatgttagcatgagctttcttcagccaaatgatcttttcactttaattatcaactgagttttccattattgtgatacaactactgcaattttgatttcccaagttttgctttttttcatcagtgccctcgttcttgttttatccaaccatattttcgatgtgctattcccccccccaaa

SEQ ID NO: 669 - DNA, 667 bp, Curcuma longa
cgagtctttcgttgcgtttacgttcctcctcggccctgcgcgcttcgcgtctccatcatggcggaacagacggagaaggctttccttaagcagccgaaggtatttcttagctccaagaaaactgggaaagggaagaaacctggtaagggcggcaacagattttggaaaaacattgggctagggttcaagaccccgagggaagcaattgaagggacttatattgataagaaatgcccattcactggaactgtctcaatcaggggccgaattttagctggtacatgccatagtgccaaaatgaacagaaccatcattgtaaggagaaactatcttcactttgtgaaaaaatatcaaaggtacgaaaagagacactcaaatataccagcacatatttctccctgcttccgcgtgaaagagggtgaccatgttattattgggcagtgcaggcctttgtctaagactgtaaggttcaatgtgttgaaagtcattcctgccggatcaactagtggaggcaagaaggcttttgcagccgtttgagtggactactgtggagacgatgatgctggagggacggctttatatatatatttctgtagtttggacctctgatatgcttaagaacgcatctgagtggttttttaattgatcgtggaaattttctctcaaa

SEQ ID NO: 670 - DNA, 740 bp, Curcuma longa
tgtccgtcgggcatcatggcggagcagactgagaaggccttccttaagcagccgaaagtgttccttagttcgaagaaatccggaaaggggaagaagccaggtaagggtggcaatagattttggaagaacattgggctagggttcaagacaccgagagaagccattgaagggacttatattgataagaaatgcccattcactggaactgtgtcaattagaggccgcattttggctggcacatgccacagtgccaaaatgaacagaaccattattgtcaggagaaactatcttcactatgtgaagaaatatcaaaggtatgagaagagacattccaacatcccagcacatatttctccttgtttccgagttaaggagggtgaccatgtcattatcgggcaatgcaggcccttgtccaagaccgtaaggttcaatgtgctgaaagtcattcctgctggatctactagtggtggcaagaaggcttttgtagctgcttgagatggctatttttggaagtgaacatgctgcggctgaaaagatttatgtttcagagctactagatagtcaagattgtttttgcaagaattttagtgatcattttgatatgtattctccaattaattgaattggtctggcagtttgattctgcattaaacttcgtagccattaggttttttatatttaactagcaactagttgaaccagcatataagtgtagctcatcaaaaacaatattatagctt

SEQ ID NO: 671 - DNA, 704 bp, Flaveria ramosissima
agggtttatttcttctctcgtttgtacctgtatccgccgctgcaaacttcaaagcttctaatttccgatcaacaatggctgaacaaaccgagaaggcgtttttgaagcaaccaaaagtgttcctctgctcgaagaaaagtgggaaaggaaagaggcctggaaagggtggaaataggttttggaagagcattgggcttggatttaagacacctagagaggctattgaaggaacatacattgacaagaaatgcccttttaccggagatgtatcaattagaggccgtattctagctggtacttgccatagtgctaagatggtgaggactattattgtacgaagggactatcttcattatgtgaagaagtaccaaaggtatgaaaagagacactcaaacatccctgctcatatctcaccatgtttccgtgtgaaagaaggtgaccatgttatcatcgggcaatgcagaccgttatcaaagacggtgagattcaatgtgttgaaggttattccagcaggatccgcaagcggtggtaagaaagcatttactggcatatagagtaacattagcgttggaactctttttgcttgatcatgtaaaagtttttgagaacaaatcggagttgtgtcgtttcattgacagttattattctgttgttttcagtttactttgaaacgctagatagttaagttcttttaaggaaatttt

SEQ ID NO: 672 - DNA, 657 bp, Flaveria ramosissima
tgcctccgcccttgaaaagctcggatctattcaacaatggctgaacagactgaaaaggcgtttttgaagcaacccaaggtgttcttatgctcgaagaaaagtggaaaagggaagaggcctgggaagggtggaaacagattctggaagagtattgggcttgggtttaagactccaagagaagccattgaaggaacttacattgacaagaaatgccctttcaccggtgatgtctccattagaggccgtattcttgctggtacgtgccacagtgctaaaatggttaggaccattattgttcgccgggactaccttcactatgtgaagaagtatcagcgttatgagaagcgccattcgaacatcccagcacacatttctccatgtttccgtgttaaggaaggtgatcatgtcaccattggtcagtgcagaccattatccaagacggtgaggttcaatgtgttgaaggtgattccagctggatcttcaagtggcgggaagaaagcatttacaggcgtataagaagctttatcttcttgatcttgttaggctttgcaaaaaaaccgttaaatttgctctaatttttaagtaaaatgtgtttgattatgtaccttgttaaatgttttcctagacaaattatgtgctctaaaatcaagttttgtt

SEQ ID NO: 673 - DNA, 680 bp, Flaveria ramosissima
agggtttttttcttctctcctctgtacctgtatccgccgctgcaaactgcaaagctcctaatttccgatcaacaatggctgaacaaaccgagaaggcgtttttgaagcaaccgaaagtgttcctctgctcgaagaaaagcgggaaagggaagaggcctgggaagggtggaaacaggttttggaagagcattggtctcggattcaagacgcctagagaggctattgaaggaacatacattgacaagaaatgcccttttaccggagatgtatcgattagaggccgtattttagctggtacttgccatagtgctaagatggtgaggaccattattgtacgaagggactatcttcattatgtgaagaagtaccaaaggtatgaaaagagacactcaaacatacctgctcatatctcgccatgtttccgtgtgaaagaaggtgaccatgttatcatcgggcaatgcagaccgttatcaaagacggtgagattcaatgttttgaaggttattccagccggatccgcaagcggtggtaagaaagcatttacaggcatatagagtaacattagctttggagctctttttgcctgatcatgtaaaagtttttgagaacaaatcggagttgtgtcttttcattgacagttattgttctgttgttttcagtttactctgaaacgcttgata

SEQ ID NO: 674 - DNA, 671 bp, Flaveria ramosissima
tgtatccgccgctacaaacttcaaagctcctaatttctgatcaacaatggctgaacaaaccgagaaggcgtttttgaagcaaccgaaagtgttcctctgctcgaagaaaagtgggaaaggaaagaggcctggaaagggtggaaataggttttggaagagcattgggcttggatttaagacacctagagaggctattgaaggaacatacattgacaagaaatgcccttttaccggagatgtatcgattagaggccgtattttagctggtacttgccatagtgctaagatggtgaggaccattattgtacgaagggactatcttcattatgtgaagaagtaccaaaggtatgaaaagagacactcaaacatccctgctcatatctcgccatgtttccgtgtgaaagaaggtgaccatgttatcatcgggcaatgcagaccgttatcaaagacggtgagattcaatgttttgaaggttattccagcaggatccgcaagcggtggtaagaaagcatttacaggcatatagagtaacattagcgttggaactctttttgcttgatcatgtaaaagtttttgagaacaaatcggagttgtgtcgtttcattgacagttattgttctgttgttttcagtttactttgaaacgcttgatagttaagttcttttaaggaa

SEQ ID NO: 675 - DNA, 780 bp, Zingiber officinale
ggcgctctcgctagggtttcgattcgacggcgacgcaggaactccgcatccaattgatctcatcttcttaccgggctgtcttgcaatcctcgtttgcaaagttccttcttctttgatcgaccatggcggaacagacagagagagcattcttgaagcagccaaaggtgtttctgagttcaaaaacatctggcaaggggaagaagcctggaaagggtgggaatagattttggaagaatgttggtcttggcttcaagacaccaagagaagccattgaagggacctacattgataagaaatgcccattcactggaactgtatcaattcgtggtcgcatcatagcaggcacttgccacagcgctaagatgaacagaaccatcatcgtacgccggaactaccttcactatgtgaagaaatatcaaagatatgagaagagacactccaatatccctgcacacatttccccttgttttcgtgtaaaggaaggtgaccatgtcataattggtcagtgcaggccactttccaagactgttcgttttaacgtgctaaaagttattcctgctggatcgacaagcagtcgtggcaagaagggattcactgcggtttgagttctgaatttcctttacgaaattttccatttcaaagtgaacttatttttcgaatcatgttattcttatgagttacaacaagaatgcttgtttactttcccatttgtctgagacaatagtttttggaatagaactccataattcatattataatgatgcattgatttctctattt

SEQ ID NO: 676 - DNA, 922 bp, Panax ginseng
atttgaagttagtgttgatttttttgtttgctttgtgaagcagtggtatcaacgcagagtacatgggggcacaatagagtttctgcccagcctccattttgcaccttcttccccaaatctccagaacctgcaataatggccgaacagaccgaaaaggcgtttttgaagcagcccaaggtgtttctttgctcaaagaaggcaggaaagggaaagaggccaggaaaaggaggcaatcgtttccacaagagcgttggattaggattcaagacacccagagaggctattgaaggtacttacattgacaagaaatgcccatttaccggagatgtttctattaggggccgtattcttgctggtacttgccacagcgccaagatgattagaactatcattgttcgccgtaattacctgcattatgttaagaaataccagaggtatgagaaaagacattcaaatattccagctcacgtatctccttgcttccgtgtgaaagagggagaccatgtgattgttggccagtgcaggccattgtcaaagacagttagattcaatgtgttgaaagtgatcccagctgggtcttctggtggtggaaagaaggctttcaccggtatttgagtttggtgtctggtcagtgttacattatatgggcgggaatgatgttagagtttactattttggctaggtggaaccttttcccattgacttgcccttgaagtgaaggcttaaatttttgtatgggaccaattaatgttttgcgtcaaacctggttttcggatttgtcatttccagtcttattaatcaagtacatggttattagttggatgttttttctcttgctagtgaattttcctgattagtgtagaaatatttggtgttcactttatctattacaacgtttgcatactatagtttacttggaaaa

SEQ ID NO: 677 - DNA, 859 bp, Gossypium raimondii
ggttttatcagtgcaagcctctctcgcggttttcatttcccctccgcaagtagccagccgtttcacacactcaagaagagagagagctagtaaatcatggcggaacagaccgaaaaagcttttttgaagcaacccaaagtgtttttgagctcgaagaaaggtgggaaagggaagagaccaggaaagggtgggaatcgcttctggaaaagcattggattgggcttcaagactccccgtgaagctattgaaggaacctacatcgataagaaatgcccgttcactggcacggtttcaatccggggtcgtatcttagccggtacttgccatagtgccaagatggtcaggacaatcattgttcgacggaactaccttcattatatcaagaaataccaaaggtacgagaagcgccattcaaacatccctgcacatatttcaccatgcttccgtgtgaaggaaggggatcatgtcattattgggcaatgcaggccgttgtcgaagaccgtgaggtttaatgttttgaaagtgattccagcaggatcttccggtggtgggaagaaagctttcaccggaatgtaagcttttctatggtagtccatggttataggaaccaatagagaagataatcaaagaaattaagttcttaaactgcatttagctttgaggatattttactgttagaattgttttcttttttgggttattttcttgttttgattttgtcgaattacgaaatccggaattttgaagatatctttatttaagtttggctttggaatttttgcttcattcctattattttgctttctaagaatgaatttagatttatgggtgaactatgaatgagggcataaattcttca

SEQ ID NO: 678 - DNA, 1010 bp, Humulus lupulus
aaagaagcccacacgcatataaggccccagtcaatatctctgagcttagattagggttttcgtcactttgagctgaagtatccctacaacgcctcctctgcgaatttgctagcgcacaacctctctacactccgcaaccatggccgagcagaccgagaaggcgtttcttaagcaacccaaggtgtttctaagctccaagaaatcttccaaggggaagagacctggaaagggagggaatcgtttctggaaaagcgttggattgggttttaagacccccagggaagccattgatggaacttatatcgacaagaagtgcccatttactggaactgtttctgttaggggacgtattttagctggaacttgccatagtgctaagatggttaggaccatcattgttcggcggaactatcttcattttgtcaagaaataccaaagatatgagaagaggcactcgaatatcccagctcacatctcaccttgcttccgtgtgaaagaaggtgatcatgtgattattgggcaatgcaggccattgtcaaagacagtgaggttcaatgttttgaaggtggttcctgctggttcctcaggtggtgggaaaaaggcttttactggactgtgagacttgaattctctgatagttctttaggctggcattgcaaagaatgtcttggatcaagtgatgtcagtttggtgtttctttatgtttttcgttttcttgtatcccctctacttttgaagtattatttgttattaggggaagttttgaagttggattcccgtggttttaagagcattgttatctaattttatgatttgatatagaaattttgcacttctggataaaaatcgtttcctgctcaactaaacatctcttttggagtaatgatacgtgcatacacaatttacacgaaaacattacacacataagcggagcaagtttgcaagtaggtgtgtggagtttttgtacaaattgtgtgcgcacttatcaatagtatctcattatatcattg

SEQ ID NO: 679 - DNA, 705 bp, Zea mays
gccgcaccccacgacttccgtccgagtctgagctcatctccacgcgccgccgccgccgctcgacgcccaccgcgcagccatggcggaacagactgagaaggctttcctcaagcagcctaaggtgttcctcagctcaaagaaatctggcaagggtaagaagccaggcaagggtggcaatcgattttggaagagcattggccttggtttcaagactcccagggaagcaattgaagggacctacattgacaagaaatgtccattcactggaaccgtttctatcagaggcagaattattgctggaacatgccacagtgctaagatgaacagaaccatcattgttcgcaggaactatctccactttgttaagaaataccagaggtatgaaaagaggcactccaacattccagctcacatctccccatgcttccgtgtgaaggaaggcgaccatgtcatcattggccagtgcaggcccctatcaaaaactgtgaggttcaatgtcgtcaaagtcattccagctggatctgctgctgccggcaagaaggctttcaccgcagcctgagtttaagactatgttccatgagtagtttatatagtgatgtctttttttgttaaaaaaactgccttctaggcttgtgcctttcgactatggtttggagattgttcccatcttaatgaagtccaatcatctgaacatgttactgttta

SEQ ID NO: 680 - DNA, 737 bp, Zea mays
cttcccctccgagcctcagttcgcatccacgcgcgccgccgccgcctcgccgctcgacgctcaccgcgcagccatggcggaacagactgagaaggctttcctcaagcagccaaaggttttcctcagctcaaagaaatccggcaagggtaagaagcctggcaagggcggcaaccgattctggaagagcattggccttggcttcaagactcccagggaagcaattgaagggacctacattgacaagaaatgcccattcactggaactgtttctatcagaggcagaattattgctgggacatgccacagtgctaagatgaacagaactatcattgttcgcaggaactacctccactttgtaaagaaataccagaggtatgagaagaggcactccaacattcctgctcacatctccccatgcttccgtgtgaaggaaggtgaccatgtcatcattggccagtgcaggcccctgtcaaaaactgtgaggttcaatgtcgttaaagtcattccagctggatccgcagctgctggaaagaaggccttcacagcagcctgagtttatagactatgttccatgagtagtctatagaatgtctttttaattcaaaagaaatctctcttctaggctggtgcttttcgactataatttggagattgttccatgtccgtgcaatcatctgaacatgttactacttattgtaccttgtcgtgcaaagttttgctaagatctctattgtttc

SEQ ID NO: 681 - DNA, 658 bp, Medicago truncatula
gagagaaggtaggtcttgagtgcgtgcggctacactctcctctgcaacttcaccaccaccatggctgaacaaactgagaaggcttttctcaagcaacccaaagtgtttctatgttcgaagaaatctggtaaggggaagaggcctggaaaaggtggaaaccgcttctggaaatcagttggtcttggattcaagactcccagagaagccactgaaggtacctacattgacaagaagtgtccattcaccggcaatgtttctatccgaggtcgtatcttagccggaacttgccatagtgctaaaatgaataggactattattgtcaggaggaattatcttcactttattaagaagtatcagaggtatgagaagaggcattcaaacattccagctcatgtatcaccttgcttccgtgtcaaggaaggagaccatgttattatcggacaatgcaggccactctccaagacagtgaggttcaacgtgttgaaagtgatcccagctgggtcatctagtggtgcaggaaagaaggcttttactggaatgtgagatttgaatgactttcgtagtatagagatcttatcatctatgttgaaagtaattctgatttctgtatggtgaaattctgatcaattttggtttgcttttgaagttatgtactgtg

SEQ ID NO: 682 - DNA, 696 bp, Momordica charantia
agggtttttcttcttatcaaagtctgcggctaagcttccattggtttttcgaagccctaatcatggcggaacagacggagaaggcttttctgaagcagcccaaggtgtttcttagctcgaagaaatcagggaaagggaagagaccaggaaaaggaggaaataggttttggaagagcattggtttggggttcaaaactcctagagaggcaattgaaggaacatatattgataagaagtgtccatttactggcactgtttctatcagggggcgtatacttgctggtacctgccacagtgccaagatggtgagaaccatcattgtcagacgtaattatctgcactatgtgaagaaataccaaaggtacgagaagagacactctaacattccagcacacatagctccttgctttagggtgaaagagggagaccatgtcatcattggccagtgcaggccgttgtcgaagacagtgaggtttaatgtattgaaagtgattcctgcgggatcatctacagctggtaaaaaggctttcacaggaatttaagtccagaattttcaggtcccgcatttgtttatgtcaagggataatatgttagcttgagctttcttcagctagatgatcttttcactttatttattaaccgaatatttcattattgtgatactactgcaattttgatttcccaagttttgcttac

SEQ ID NO: 683 - DNA, 681 bp, Elaeis guineensis
cgctgctgctctcgtctccttcgtgatcgaaggccgtccttcgcctatttcttcgatcaaatcatggcggagcagaccgagagggcgttcctgaagcagccaaaggtgtttctctgctcaaaaaaggctggaaaggggaagaggcctggtaagggtgggaacagattttggaagagcattgggcttggattcaaaactcccagagaagccattgaaggaacctatattgataagaaatgcccattcacgggtactgtgtcaattaggggtcgcatcttagcaggcacatgccacagtgccaagatgaacagaaccatcattgtacgtcgcaactaccttcattatgtaaagaaatatcaaaggtatgagaagaggcactcaaatatagcagcacacatatcaccctgtttccgagtcaaggaaggggaccacgtaatcattgggcagtgcaggccattggcaaagactgtgagattcaatgtattgaaagtcattccagccggctcaaagagtggaggcggcaagaaggctttttctgcaatctgaggtggtctgagagaccgagttttgtccagttaaaagctttcattatgagactgatgttgttagagcagaaaagttggtttactaatttcatttttggtactctacgtttactgattattcctttgtagtattttt

SEQ ID NO: 684 - DNA, 842 bp, Arachis hypogaea
ccccccccctatccctgtgtgccttggcagctcagaagcagtggtatcaacgcagagtacgggggagagtgagaactgagaagtgagtacagattagggtttctgagtgcggctctcattctgcgactctgcaactttcgccgttaacccccttcacgcgtcacaatggctgaacaaaccgagaaggcttttctcaagcaacctaaagtgtttctatgctcgaagaaaagtgggaagggaaagaggcccggaaagggtggaaaccgtttctggaaatccattggccttggatttaagactcccagggatgccattgaaggaacctatattgacaagaaatgcccctttaccggaactgtttccatccgtggccgaatcttagctggaacttgtcacagtgctaagatgaataggactatcattgttaggaggaattatcttcattttatcaagaagtatcagagatacgagaaaagacattcgaatattcctgcacatatatcaccctgcttccgtgtgaaggaaggagatcatgttattattggccaatgcaggccactttcaaagacggtgaggttcaatgtgttgaaagtgatcccagctggatcttcaagtggtgcaaagaaggcatttgctggaatttgagatttgattcagttttttgttgaaggataatgttatcttattagttagtaaaactgattcctggaagattatcatataaagatatgatcaattttggatttcctttaagattgtgtttgtgaatgaccaagtgttatccttttaaatttatcaattctagcttggtatcaaaaaaaaagaaaaaaaacaaaagtact

SEQ ID NO: 685 - DNA, 875 bp, Cajanus cajan
gaaatctcaataaaagcagggtcttctccgaaatctgaaggagcgaattggctagggtttttgcgtgcggcgttcatacactctcttctgcaactttcgccgacaactcccttcaccatggctgagcagaccgagaaggcttttctgaagcaacccaaagtgtttttatgctcgaagaaaactggtaaggggaagaggcctggaaaaggtgggaaccgcttctggaaatcgattggtcttggatttaagactcccagggaagccatcgaaggtacctatatcgacaagaagtgtcccttcaccggcaatgtttccatccgtggccgtatcctggctggaacatgccacagtgctaaaatgaatcgcactatcatagttaggaggaattatctccattttattaagaagtaccaaagatatgagaagaggcactcaaatattccggctcatatatcacctgccttccgtgtgaaggaaggagatcacgttattattggtcaatgcaggccactctcaaagacggtgaggttcaatgtgttgaaggtgatcccagctggatcgtctagtggtgcgaagaaggcatttactggaatttgagctttgttttccagtttttgttgaagaaaaatgttattttattaattagtaaatctgatttctgtaaggtaacaaatataaagacctgatcaattttggatttgtggattttatgttctgcctttgtttaggattttgatatacgttatggtttttgaatactattagtctttgttcttgtgtgcttttttgtgaaaataattttaagttcggaatgtttgtattccacatttcgcttattatttttaaaaattgtattattatgaaacgtttttttg

SEQ ID NO: 686 - DNA, 821 bp, Cajanus cajan
atcaacgcagagtcagggggactactcattagggtttctgttttgaagttattctgctttgtggctgcaggttctgccgtttgaaacagagccccaaccatggccgaacagactgagaaggcttttctgaagcaaccaaaagtgtttctatgctctaagaaaggtgggaagggaaagaggccagggaaaggtggaaatcgcttttggaagtcaattgggcttggattcaagactcccagggatgccattgaaggaacttatattgataagaagtgccccttcactggcaatgtttccatccggggtcgtatcctggctggtacatgtcacagtgccaaaatgaataggaccataatagttcgaaggaactatcttcattttattaagaaataccagagatatgaaaagcggcattcaaatattcctgcacatatatccccttgtttccgtgttaaggaaggagatcatgtaattattggacaatgcaggccactctcgaagacagtgaggttcaatgtgttgaaggtgatcccagctggatcttcaagtggtgcaaagaaggcatttactggactgtgatatttgaatttttagttatcattggaggatagtattaccttttgagttagtaaaagcctctgttcaaattcttcaaggttgtcacttaaagattgaatcaaattttgatagcttttatgttttaaggctttgcatgttgagaattttaatatacattattgttcttcaatagcagttgctactatttctgttattctggtcgtgcctactcatatcttacttttttttattctcttcttttt

SEQ ID NO: 687 - DNA, 661 bp, Sorghum bicolor
ccgagtctcagctccgcagcccccaagcgccgccgccgcttcgccgctagacgcccaccgcgcagccatggcggaacagactgagaaggctttcctcaagcagcctaaggttttcctcagctcaaagaaatctggtaagggtaagaagcctggcaagggaggcaaccggttctggaagagcattggccttggcttcaagactcccagggaagcaattgaagggacctacattgacaagaaatgcccattcactggaaccgtttctatcagaggcagaattattgctggaacgtgccacagtgctaagatgaacagaaccatcattgttcgcaggaactacctccactttgttaagaaataccagaggtatgagaagaggcactccaacattccagctcacatctccccatgcttccgtgtgaaggaaggtgaccatgtcatcattggccagtgcaggccgctgtcaaaaactgtgaggttcaatgtcgttaaagtcattccagctggatctgctgccgcgggcaagaaggctttcaccgcagcctgagtttagactatgttccatgagtagtctatagaatgatgtcttttttgttaaaaaaaatccctgctaggctggtgccttccgattgtggtttggagattcctatctcaatgaagt

SEQ ID NO: 688 - DNA, 865 bp, Saccharum officinarum
ttcagctgtgctcctgccctgcctttccggatcgacccacgcgtccgctcaggtccgcagcccccgagcgacgacgccgccgccgccgccgccgcttcgccgctcgacgcccaccgcgcagccatggcggaacagactgagaaggctttcctcaagcagcctaaggttttcctcagctcaaagaaatctggcaagggtaagaagcccggcaagggaggcaaccggttctggaagagcattggccttggcttcaagactcccagggaagcaattgaagggacctacattgacaagaaatgcccattcactggaactgtttctatcagaggcagaattattgctggaacatgccacagtgctaagatgaacagaaccatcattgttcgcaggaactacctccactttgttaagaaataccagaggtatgagaagaggcactccaacattccagctcacatctccccatgcttccgtgtgaaggaaggtgaccatgtcatcattggccagtgcaggcccctgtcaaaaactgtgaggttcaatgttgttaaagtcattccagctggatctgctgctgccggcaagaaggctttcaccgcagcctgagtttagactatgttccatgagtagtctatagaatgatgtcttttttgttcaaaaaaaatccctgctaggctggtgcttttcgactatggtttggagattgttcccatctcaatgaagtcccatcatctgaacatgttactatttattgtaccttgtcgtgcaaagttttgctaagatctgtattgtttcatgtctgttgatgttgctgggctgtgttcctatgcttttgacctatgttgaccattgttatctagcaatgttt

SEQ ID NO: 689 - DNA, 1530 bp, Vicia sativa
cctcaagcttgtgttcaccgccgttgcctgaattctcaccaaactggagtaaaagagggttttggacgagtgcggctaaacaaactctcatctcctctcctctccaaatcccaaaatccaccatggctgaacaaactgagaaagcttatctgaagcaacctaaagtgtttctatgctcgaagaaatctgggaagggaaagaggcctggtaaaggtggaaatcggttttggaaatctgttggtcttggatttaagactcctaaagaagccactgaaggaacctatattgacaagaagtgcccattcactggcaatgtctcgatccgaggtcgtatcatagctggtacttgtcatagtgctaagatgaataggactattattgttaggaggaattatcttcactttattaagaagtatcaaagatatgagaagagacattcaaacatccctgctcatgtttcaccttgcttccgtgttaaggaaggagatcatgttattattggccaatgcaggcccctctccaagacagtgaggttcaacgtcttgaaagtgatcccagctggatcatctagtggtgcaaagaaggcatttggtggaatatgaaatgcgcgaaagaaaatttgatttctgtatgatgactaatatgaaaacctgttcaattttgttttgtttttgaagttaagttctgtcattggataaatattgaaggattttgattttgattttgattatcaaatactagtagcatttatattgagttttggcttcaaacaggaattgtctcacttctagaaggttataaaaagacatctcagtttttgataaaaaaaaaaaaaaaacaaacctccacatttataataatatgtgatatagattgatggcacaaacaataaataaacaaagttctaaagatagatcaatatagtaaacatgataataaattataaaaccccacgataacatactataatcctcgctgatcaggtatcagtctcagcctcagtctcgatcttgccggtttcaggagcatcctctgcctttggtgaagaagaaggacgatcctccgatggaggagcttcagcagcatcgttatcaaccgcattggaacctatggtaggtctagccttaacggtttcaagcatccgcttactgatttccttggagtaaacctggaggatctcgataccgtcgccgccgtctggagcaccggagtcactggcgacagagtaggcttcgtcctcgatctggcgggcggctgatgcggcctcgtcagaaggcaatgtgccgtagcgcttggaaaggacggagggagtggttagggtttcgatcaagcgagtgatgacggcgtcgcgagtgcgctgagtgggtggccatatgctgaagccggcggaggagagtttggtttggtcgccgttttgttcgggtgaggcggaggagtcttgctccgatgtggctgcagttgtgacttccgggtcggacattttggagatgagcgttttttcggtggtaccaaatttgagtagtaggaaat

SEQ ID NO: 690 - DNA, 752 bp, Oryza sativa
ctcgtctccactcccctgccctcccgcctctccggatcccccgcgcgccgccgccgccgcccgcccgccggtcgatacccctccgcggcagccatggctgagcagactgagaaggcattcctgaagcagccaaaggttttcctcagctcaaagaagtctggcaagggtaagaagccaggtaagggtggcaaccgtttctggaagagcattggccttggcttcaagactcccagggaagcaattgaagggacatacattgataagaagtgcccattcactggaactgtttctatcagaggcagaatcattgccggaacatgccatagtgctaagatgaacaggactatcattgttcgcaggaactacctccactttgtgaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcc

SEQ ID NO: 691 - DNA, 697 bp, Oryza sativa
cccgcctctccggatcccccgcgcgccgccgccgccgcccgcccgccggtcgatacccctccgcggcagccatggctgagcagactgagaaggcattcctgaagcagccaaaggttttcctcagctcaaagaagtctggcaagggtaagaagccaggtaagggtggcaaccgtttctggaagagcattggccttggcttcaagactcccagggaagcaattgaagggacatacattgataagaagtgcccattcactggaactgtttctatcagaggcagaatcattgctggaacatgccatagtgctaagatgaacaggactatcattgttcgcaggaactacctccactttgtgaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggtggcaagaaggcctttaccgcagcctgagcttgtactctcatattcatgggtagtttataggcagatccttttgcttgaagtcctggcagggcgtggtgttttgaccctttcgatttggatattgttctcaactaaacgaagtcttgtcatctgaacatgttttatgg

SEQ ID NO: 692 - DNA, 598 bp, Oryza sativa
catcctccttcgcaagcctcgcctccactccccgcgccgccgccgccgccgccgactcgccggtcgtcaccctcgccccgcagccatggctgagcagactgagaaggctttcctgaagcagccaaaggttttcctcagctcaaagaagtctggcaagggtaagaagccaggcaagggtggcaaccgcttctggaagagcattggccttggcttcaagacccccagggaagcaattgaagggacatacattgacaagaagtgcccattcactggaactgtttctatcagaggcagaatcattgctggaacatgccacagtgccaagatgaacagaactatcattgttcgcaggaactacctccattttgtcaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggcggcaagaaggccttcaccgcagcatgagcttgtactcgcattattcatgggtag

SEQ ID NO: 693 - DNA, 755 bp, Oryza sativa
gccgccgcatcctccttcgcaagcctcgcctccactccccgcgccgccgccgccgccgccgactcgccggtcgtcaccctcgccccgcagccatggctgagcagactgagaaggctttcctgaagcagccaaaggttttcctcagctcaaagaagtctggcaagggtaagaagccaggcaagggtggcaaccgcttctggaagagcattggccttggcttcaagacccccagggaagcaattgaagggacatacattgacaagaagtgcccattcactggaactgtttctatcagaggcagaatcattgctggaacatgccacagtgccaagatgaacagaactatcattgttcgcaggaactacctccattttgtcaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgtt

SEQ ID NO: 694 - DNA, 830 bp, Cenchrus ciliaris
gtccgccgccgcagcagcgccgctcgacgtccacttgcaaccatggcggagcagactgagaaggctttcctcaagcagcctaaggttttcctcagcacaaagaaagctgacaagagtaagaagccaggcaaggcaggcaaccgcttctggaagagcattggccttggtttcaagacccccagggaagcaattgaagggacctacattgacaagaagtgcccattcactggaactgtttctatcagaggcagaattattgctggaacatgccacagtgctaagatgaacaggaccatcattgttcgcaggaactacctccactttgttaagaaataccagaggtacgagaagaggcactccaacatcccagctcacatctccccgtgcttccgtgtcaaggagggtgaccatgtcatcatcggccagtgcaggcccctgtccaaaactgtgaggttcaacgtcgtgaaggtcatcccagctggatccactggcggtgcaggcgggaagaaggccttcaccgcggcctgagctctagactatgttccatgagtagtctatagaatgatgtctttttgctttaaaattcctgctaggctggtgttttcgactatggtttggagattgttccccgtctgaatggagtcccatcatctgaacatgttaccctttatggaatcctgtcgtccaaagttttgttatggtctgtatcgtttcccctctgatgcggcattgctgcagtacttttacctgcgtatggggataaacttgtgtccttgtcattgtgcaagaacagcactctcttggcgcatacagtctagcggtttggcccc

SEQ ID NO: 695 - DNA, 920 bp, Pennisetum glaucum
cacttccttccgagtctcagctccgcaccccccttgcgcgccgccgccgccgccgccgcatcgccgctcgacgtccaccgcgcaatcatggcggagcagactgagaaggctttcctcaagcagcctaaggttttcctcagcacaaagaaagcggacaagagtaagaagccaggcaaggcaggcaaccgcttctggaagagcattggccttggtttcaagacccccagggaagcaattgaagggacctacattgacaagaagtgcccattcactggaactgtttctatcagaggcagaattattgctggaacatgccacagtgctaagatgaacagaaccatcattgttcgcaggaactacctccactttgttaagaaataccagaggtacgagaagaggcactccaacatcccagctcacatctccccgtgcttccgtgtcaaggagggtgaccatgtcatcatcggccagtgcaggcccctgtccaaaactgtgaggttcaacgtcgtgaaggtcatcccagctggatctactggcggtgcaggcgggaagaaggccttcaccgcagcctgagcttgtagactatgttccatgagtagtctatagaacgatgtctttttgctttaaaattcctgctaggctggtgttttcgactatggtttggagattgttccctgtctgaatggagccccatcatctgaacatgttactctttatggaatcctgtcgtgcaaagttttgttatggtctgtatcgtttccccactgacgtggcattgctgcagtacttttacctgcgtacggggataaaacttgtgtccttgtaattgtgcaagaacaacactcccttggcgcatacagaccagctcaccagcatcacttttcttgattccagctgcacggcacagcagcgtatgatct

SEQ ID NO: 696 - DNA, 841 bp, Oryza sativa
gcctccgcgccgccacctccttcttagcaaagcctcgtctccactcccctgccctcccgcctctccggatcccccgcgcgccgccgccgccgcccgcccgccggtcgatacccctccgcggcagccatggctgagcagactgagaaggcattcctgaagcagccaaaggttttcctcagctcaaagaagtctggcaagggtaagaagccaggtaagggtggcaaccgtttctggaagagcattggccttggcttcaagactcccagggaagcaattgaagggacatacattgataagaagtgcccattcactggaactgtttctatcagaggcagaatcattgccggaacatgccatagtgctaagatgaacaggactatcattgttcgcaggaactacctccactttgtgaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctcgatatgctgtgatccttgattttcctggctggctatgtgttgacg

SEQ ID NO: 697 - DNA, 2363 bp, Oryza sativa
gcagactgagaaggctttcctgaagcagccaaaggttttcctcagctcaaagaagtctggcaagggtaagaagccaggcaagggtggcaaccgcttctggaagagcattggccttggcttcaagacccccagggaagcaattgaagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttttcatcagaacgtgtttatggaatctactctatgcaaagttttgttaagatgcctgttaatgctcgatatgctgtgatccttgattttcctggctggctatgtgttcgcttgtttgttgtgtttcttcgaaagagtattggtggatatcctgtgcctgtgcatgactgagattctgaataaggttttcccaaacccaaacctgacctaattcagtttttttgacaaggcttgaatcttataagtttatcaatggacctgacatcttcctatcgcacctaagctttgggaggatgctaatatctggtacaacgtttacatttcacaatcaaacacaactctgaaatgttcgaatatctgaaatgttagcctggtacaccatttacatttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatatttacggcccatatagagaggggtgtatctgcatcgctagggtttgcctccgcgccgctacctccttcttagcaaagcctcgtctccactcccctcccctcccgcctctccggatcccccgcgcgccgccgccgccgcccgcccgccggtcgatacccctccgcggcagccatggctgagcagactgagaaggcattcctgaagcagccaaaggttttcctcagctcaaagaagtctggcaagggtaagaagccaggtaagggtggcaaccgtttctggaagagcattggccttggcttcaagactcccagggaagcaattgaagggacatacattgataagaagtgcccattcactggaactgtttctatcagaggcagaatcattgctggaacatgccatagtgctaagatgaacaggactatcattgttcgcaggaactacctccactttgtgaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggtggcaagaaggcctttaccgcagcctgagcttgtactctcatattcatgggtagtttataggcagatccttttgcttgaagtcctggcagggcgtggtgttttgaccctttcgatttggatattgttctcaactaaacgaagtcttgtcatctgaacatgttttatggaatctactctatgcaaagttttgttaagatgcctgttttgctcgatatgctgtgatcccatggccgtgtgactcgagaatacttgcttgttcagcgtttgcatgactgagattctgaatagggttctctataacctgagcaaaatcaggtgttcaatgacaaggggaccagcttgagaagtttatcagtggac

SEQ ID NO: 698 - DNA, 1758 bp, Oryza sativa
gcgctataaagagtggctcactagggtttacctccgcgccgccgcatcctccttcgcaagcctcgcctccactccccgcgccgccgccgccgccgccgactcgccggtcgtcaccctcgccccgcagccatggctgagcagactgagaaggctttcctgaagcagccaaaggttttcctcagctcaaagaagtctggcaagggtaagaagccaggcaagggtggcaaccgcttctggaagagcattggccttggcttcaagacccccagggaagcaattgaagggacatacattgacaagaagtgcccattcactggaactgtttctatcagaggcagaatcattgctggaacatgccacagtgccaagatgaacagaactatcattgttcgcaggaactacctccattttgtcaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttttcatcagaacgtgtttatggaatctactctatgcaaagttttgttaagatgcctgttaatgctcgatatgctgtgatccttgattttcctggctggctatgtgttcgcttgtttgttgtgtttcttcgaaagagtattggtggatatcctgtgcctgtgcatgactgagattctgaataaggttttcccaaacccaaacctgacctaattcagtttttttgacaaggcttgaatcttataagtttatcaatggacctgacatcttcctatcgcacctaagctttgggaggatgctaatatctggtacaacgtttacatttcacaatcaaacacaactctgaaatgttcgaatatctgaaatgttagcctggtacaccatttacatttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatatttacggcccatatagagaggggtgtatctgcatcgctagggtttgcctccgcgccgctacctccttcttagcaaagcctcgtctccactcccctcccctcccgcctctccggatcccccgcgcgccgccgccgccgcccgcccgccggtcgatacccctccgcggcagccatggctgagcagactgagaaggcattcctgaagcagccaaaggttttcctcagctcaaagaagtctggcaagggtaagaagccaggtaagggtggcaaccgtttctggaagagcattggccttggcttcaagactcccagggaagcaattgaagggacaata

SEQ ID NO: 699 - DNA, 762 bp, Oryza sativa
gccgccgcatcctccttcgcaagcctcgcctccactccccgcgccgccgccgccgccgccgactcgccggtcgtcaccctcgccccgcagccatggctgagcagactgagaaggctttcctgaagcagccaaaggttttcctcagctcaaagaagtctggcaagggtaagaagccaggtaagggtggcaaccgtttctggaagagcattggccttggcttcaagactcccagggaagcaattgaagggacatacattgataagaagtgcccattcactggaactgtttctatcagaggcagaatcattgccggaacatgccatagtgctaagatgaacaggactatcattgttcgcaggaactacctccattttgtcaagaaatatcagaggtatgagaagaggcattccaacattccggctcacgtctccccatgcttccgtgtcaaggaaggtgaccatgtcatcattggccagtgcaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctc

SEQ ID NO: 700 - DNA, 728 bp, Glycine max
gcgaagaagatattagggtttttgagtgcggtgcggcgatcctagcactctcttctgcagctttcgccgacagcttcattcaccatggctgagcaaaccgagaaggcttttttgaaacaaccaaaagtgtttctcagctcgaagaaaactgggaagggaaagagacccggaaagggtgggaaccgcttttggaaatccattgggcttggatttaagactcccagggaagccatcgaaggaacctacattgacaagaagtgccccttcactggcaatgtttccatccgtggccgtatcttggctggaacatgtcacagtgctaagatgaacaggactattattgttaggaggaattatctccattttatcaagaagtaccagaggtacgagaaaaggcactccaacattcctgctcatatatcacctgctttccgtgtgaaggaaggagatcacgttattattggtcaatgcaggccactttctaagactgtgaggttcaatgtgttgaaagtgatcccagctggatcttctagcggtgcaaagaaggcttttactggaatgtgagctttgatttccagtttttattgaagataaatgttaccttattaattattatatctgatttcttttctggatgataacaaatatgaaaaccttgtcaattttggattttctttgaggtttcgttctggctttatgtttaggatcttgttataatacattatggt

SEQ ID NO: 701 - DNA, 653 bp, Ambrosia trifida
ttcttcttctgtttgtgcctccacaggtaaaataaccaaaccaaagcttggatcttttcaacaatggctgaacagactgagaaggcatttttgaagcaacccaaggtgtttttatgttcaaagaagagtgggaaaggcaagaggcctgggaaaggtgggaacagattctggaagagtattggtcttggatttaagacacctagagaggctattgatggaacttacattgacaagaaatgccctttcactggtgatgtatcgattagaggacgtattattgctggcacttgccacagtgcaaaaatggttaggactattattgttcgtcgggactacctccattatgtcaagaagtatcaaaggtacgagaagaggcactcaaacattccagcacacatttctccatgtttccgtgtgaaagaaggtgaccatgtcactattggacagtgcagaccattgtccaagactgtgaggttcaacgtgttgaaggtgatcccagctggatcttccagtgcaggcaagaaggcgtttacaggcatataagacgtttatcttgtccatctcgttaggttttgcaaaaacagtttaattcgctttgcagattttaaagtatgtttcagatttgtgtagacttcagtcttgttttacttgtg

SEQ ID NO: 702 - DNA, 1098 bp, Aristolochia fimbriata
cggcctcgcagggaggtaacatgagaggcaccgtagcagatgtgccgtatataaaccaaatttaggtttagggtttactcccgctatcagaccttcggcttctgaatctgtctttccgagctttgagttcctctctaccatggcggagcagacggagaaggcctttctgaagcagcccaaggttttccttagctcgaagaaatccggtaaaggaaagaggcctggaaagggtggaaaccgtttctggaagagtattggtctcgggttcaagactcccagagaagcgattgaaggtacttacattgataagaaatgcccatttactggaactgtctctgtaaggggccgcatccttgcgggtacctgccatagtgcaaagatgatgagaactattattgttcgccgcaattatctgcactgggtcaagaagtaccagagatacgagaagaggcactcaaatattccagctcacatttccccatgcttccgtgtgaaggaaggtgaccatgttattattgggcagtgcaggcctttgtcaaagacagtgagattcaatgtattgaaggtcattccagctggttcttccgcaggggctggtaagaaagctttcactggaatgtgaggctagcccgtaatgcccccttcaaatggcagattgagatgggggttgtttagatgtgttagctttaggctccagagattctagcatatttttgttgcatccctagtagttgagttgtcaacaccgatccttgaacagtaaccaacgttttaattttgtatgacatgttttcttattatcgaggaaatttgagatatatgtttcttgttctatgaactagcgctgcagcttgagttttgggatctgaagttcaagtatatattttgacaatttaagaatatcataaatagtttgggcaaagttggtttacgctacgattgttttgtggtactttggttactgggggctgttatatggctttaccgattctggttatcccatttctgctttcacttactagcgagtgaagctgcggctttctacgaggtcgaatcttgatatggattttgtagctttcccctggttttcgtgttata

SEQ ID NO: 703 - DNA, 600 bp, Arnica chamissonis
gctgcaaagctccaaatctctcaacaatggccgaacagacggaaaaggcttttctgaagcagccgaaggtgtttctctgctcgaagaaaagtggcaaaggaaagaggcctggaaaaggtggaaacaggttctggaagagcgttggtctcggatttaagacaccacgagaggctattgaaggaacttacattgacaagaaatgccctttcactggtgatgtatccattcgaggccgtattttagctggtacttgcaatagtgctaagatggtcaggactattatcgttcgaagggactatcttcattatgtcaagaagtatcagagatacgaaaaaaggcactcaaacattcctgctcacatctcaccatgcttccgtgtgaaggaaggtgaccatgtgaccattgggcagtgcagaccattatcaaagacagtgaggttcaatgtgcttaaggtgattcccgcgggatcttcaggcggtggcaagaaagcatttacaggcatataaacaatacatgccttggctcttttgcttgataatgtagaagtttttgagaacaaaacgtcgttctattgagattattatgctgtttttgacttat

SEQ ID NO: 704 - DNA, 769 bp, Artemisia annua
aagcagtggttatcaacgcagtactccgacggggaccaactagggtttcatatctcacttcatcttcctacatttatccgccgtcaaatcttcaaatcaaacaatggcagaacagactgagaaggcttttttgaagcaacccaaagtgttcctctgttcgaagaagagtggaaaggggaagaggccagggaaaggtggaaacaggttctggaagagtgttggtttgggcttcaagactccaagagaggctattgaaggtacttacattgacaagaagtgcccattcactggtgatgtttccatcagaggccgtattcttgctggtacatgccacagtgctaagatggtgaggactattatcgttcgaagggactatcttcattatgtcaagaagtaccaaagatacgagaagagacactccaacatccctgctcacatctcaccatgtttccgtgtgaaggagggtgaccatgtcactgttgggcagtgcagaccattatcaaagacagtgaggttcaatgtcttgaaggtgattccagctggatcttcagggggtgggaagaaagcctttactggcatttaaagtatactagtacttcgactctttttgcttaattatgtaaaagttttctagaaccaaatttgactgatatcgttccatctacattaaaatgctgttgtttctggtttttgccaacacttttcagagctattttaaggaattttgatattgggtatttgttctataactgcattggtgtacttgctg

SEQ ID NO: 705 - DNA, 774 bp, Musa acuminata
gttagggttggcgaccggactagccgaggcgatactgtcgttctgctgcggcgcttgatttgattgaagtcacattgctcctcgatcatggcggaacagactgaaaaggcattcctcaagcagccaaaggtgtttctttgctcgaagaaatctggaaaggggaagagacctggcaagggtggcaacagattttggaaaagcattggacttggattcaagaccccaagagaagccattgaagggacttatattgataagaaatgcccattcactggaaatgtgtcaattaggggccgcatattagctggtacatgccacagtgccaagatgaacagaaccattattgtacgcagaaactatcttcactatgtgaagaaatatcaaaggtatgagaagaggcactcaaatatacctgcacatatttctccctgcttccgtgtgaaggaaggtgaccatgttatcataggccagtgcaggcccctggcaaagactgtgacgttcaatgtgttgaaagtcattccagctggatcaacaagcggaggtgggaagaaggcttttgcagcagtttgaagtgtgagggtctcaggcattttggaggactaagaggctggatttataaagatttctacatgggatgcattaaaatgttttaagaatcctctattaggttatcttggttcagttctataactattttctttcaagctttttgctgttaccatggatgcatgattgtttatacttctttgaacaattcaaaattcttaattctga

SEQ ID NO: 706 - DNA, 729 bp, Musa acuminata
cggcgctagggtttggataggcgaccgagaagctccgtacctccgctccctctttgccgcgggcgccgcggtgtccattccttcgtcgcttgttcgatcatggcggaacagacagagaaggcgttcttgaagcagccgaaggtgtttctgtgttcaaagaaatctggaaagggaaagagacctggaaaaggtgggaatagattctggaagagtattggtcttggcttcaagactcccagggaagccatcgaaggaacctacatcgataagaagtgcccattcactggcaatgtatcgattcgaggtcgcatcctagcaggcacatgccacagtgccaaaatgaacagaaccatcattgtgcgccgcaactaccttcactatgtgaagaaatatcaaaggtatgaaaagagacactcgaacattcctgcacacatatcgccctgcttccgtgtgaaggaaggtgaccatgttatcattggtcagtgcaggccactggcaaagactgttggattcaatgtactaaaagtcatcccagctggatcaacaagtggaggtgggaagaaggcctttgctgcagtttgaatcttacttgaaatgctctaatttatctccaattttgtgttagactctgtttggaattcacgtggttttagttaattcatttttatctctgattgacgtgaactcgtgtataatttctctatattaagtttacttgcgaaattgtgc

SEQ ID NO: 707 - DNA, 767 bp, Theobroma cacao
agacaagcgtgtcttcctctgccattagggtttttcctgtgtaaacctctcgttgtctttgtgttattgggtagcctctctcactcctcaaccatggcggaacagacggagaaggcttttttgaagcagccaaaggtgttccttagctctaagaaatctgggaaaggaaagaggcctggaaagggcgggaatcgcttctggaaaagcattgggttgggctttaagacacccagagaggcaattgaaggaacatatattgataagaaatgcccatttactggcactgtttctatcagaggccgtatccttgctggcacttgccatagtgcaaaaatgatgaggaccattatcgttcgacggaactacctccactatatcaagaaataccaaagatatgaaaagaggcactctaacatcccagctcatatatccccctgcttccgtgtgaaagaaggagatcatgttattatcgggcaatgcaggcctttgtcgaagacagtgaggttcaacgtcttaaaggtcattccagctggatcttctggaggtgggaagaaggcttttgcaggcatgtgagagatttgcttttaaaatggcgaaactgtagtgtcagttttgagatgtattcaccatatgaactttggttgatttctttcttatgaagttctagattttgctttagctctttctgttgatgggaaacataaagttggtcgccggaagtctccattattacaattttgagaatctatttatatgttactttttcc

SEQ ID NO: 708 - DNA, 669 bp, Ricinus communis
cagctgcaccatcccagacacacgcacccacgcacgcacatttaacgggaaaccatggcggagcagactgagaaggcctttctgaaacaacccaaagtctttctcagttcaaaaaaaactggaaagggaaagaggcctggaaaaggtggcaatcgtttttggaaaagcgttggattgggtttcaagactccaagagaagccattgaaggaacttacattgataagaaatgccccttcactggaactgtgtctatcaggggacgtatcctagctggaacttgtcacagtgccaagatgatgaggagcatcattgttcgtcggaattaccttcacttcatcaagaaataccaaagatatgaaaagagacattcaaatatcccagcacacatatctccgtgtttccgtgtgaaagaaggggatcatgtcattattgggcaatgcaggcctctgtcaaagactgtaagattcaatgtccttaaggtgattcctgctggatcttctgggggtgggaaaaaggccttcactgggatgtgaagtttgacactcagatattgtttggctgctaaggttgcatgacaaggttttgaaagttttgaacagcatctaattggcgattatatgggccattagatgcttcctttttcttttggtttccttataagatcattt

SEQ ID NO: 709 - DNA, 587 bp, Ricinus communis
ctcgttttcttagagctagcatcggcgaatcgtagaccatggcagaacagacggaaaaggcatttttgaagcaaccaaaggttttcctaagctcaaagaaaactggaaaaggaaagaggcctggtaaaggtggaaatcgtttctggaaaagcattgggttgggtttcaagactcccagagaggcaattgaaggaacatatattgacaagaaatgcccattcactggcactgtttcaattagaggccgcatccttgctggtacatgccacagtgcaaaaatgaacaggaccattattgtacggaggaattatcttcactttatcaagaagtatcaaaggtatgagaaacggcactccaatatcccagcacacatatcaccttgcttccgtgtaaaagaaggagatcatgttatcattggccaatgcaggccattgtcgaagacagtgaggttcaatgtgctgaaggtcattcctgcagggtcttctggtggtgcaaagaaagctttcacagccatgtgagagtcttgattataagaatataatgctggaggatgctttgatacgggctgtttaatgggcatttagata

SEQ ID NO: 710 - DNA, 685 bp, Centaurea maculosa
tctctcgttgtctttgtgccgaatagctccatcggatttggatctcttcaacaatggcggaacagacggagaaggcgtttttgaagcaacccaaggtgtttctatgctcgaagaaaagtgggaaaggaaagaggcctgggaaaggtggaaatagattctggaagagtgttggtcttggattcaagacgccaagagaagctattgaaggaacttacatcgacaagaagtgcccttttaccggtgatgtctccatcagaggtcgtattcttgctggtacttgccacagtgccaagatggttaggaccatcatcgttcgtaggaactacctccattttgtcaagaaataccaaagatacgaaaagaggcattccaacattccagctcacatttctccctgcttccgtgtgaaagaaggcgatcacgtcactgttggacagtgcagaccgttgtcaaagacggtgaggttcaacgtgttgaaggttatcccggctggatcttctggtggtggcaagaaggcgtttaccggcatataagaagcttaccttcatcaatttggttgtttcgagtgaaatgtggtttcagtttaatgcttatgcagacatagtttttttgctatagttgtttattttttatgtttacggttatgagatgattgcaagtttaacaatcgtaagttttgatttga

SEQ ID NO: 711 - DNA, 808 bp, Centaurea maculosa
tgccttctcttcttctctctcgttgtctttgtgccgaatagctccatcggatttggatctcttcaacaatggcggaacagacggagaaggcttttttgaagcaacccaaggtgtttttatgctcgaagaaaagtgggaaaggaaagaggcctgggaagggtgggaacagattctggaagagtgttggtcttggatttaagacaccacgagaagctattgaaggaacttacatcgacaagaagtgccctttcaccggtgatgtctccatcagaggccgtattcttgctggtacatgccacagtgctaagatggtgaggaccatcattgttcgtaggaactacctccattttgtcaagaaataccaaagatatgaaaagaggcattccaacatcccagctcacatttctccctgcttccgtgtgaaagaaggcgatcacgtcactgttggacagtgcagaccgttgtcaaagactgtgaggttcaatgtgttgaaggttatcccggctggatcttctggtggtgggaagaaggcatttactggcatataaaaagcttagtttcatcttgttagattgtgggagaagaatttgctgagtttcgagtgaaatgtggtttggtttaaagggttcttaaagacgtaatttttcgctcttagtttcttttacttgaggttacgactatgagatattgtaagtttggcaatcgaagttttgatttgttacattattgttacttttgaatttgttaatccattcccatctaattttcatgttgaaaaacaacatgaaaaggctatcagaggtgggaa

SEQ ID NO: 712 - DNA, 675 bp, Centaurea maculosa
gggttttactttctgcctttttcttcttctctcgttgtctttgtgccgaatagctccatcggatttggatctcttcaacaatggcggaacagacggagaaggcgtttttgaagcaacccaaggtgtttctatgctcgaagaaaagtgggaaaggaaagaggcctgggaaaggtggaaacagattctggaagagtgttggtcttggattcaagacaccaagagaagctattgaaggaacttacatcgacaagaagtgccctttcaccggtgatgtctccatcagaggccgtattcttgctggtacttgccacagtgccaagatggttaggaccatcatcgttcgtaggaactacctccattttgtcaagaaataccaaagatacgaaaagaggcattccaacattccagctcacatttctccctgcttccgtgtgaaagaaggcgatcatgttactgttgggcagtgcagaccattgtcaaagacggtgaggttcaatgtgttgaaggttatcccggctggatcttctggtggtggcaagaaggcgtttaccggcatttaagaagcttaccttcatcaatttggttgttttgagtgaaatgtggttccgttaaatgcttctgcagacatagtttttttgctatagttgtcgtttattttttatgtttacggttatg

SEQ ID NO: 713 - DNA, 760 bp, Chrysanthemum coronarium
gatatttggtcactgattgccccaggggtgcctccatcgtcagttgcagcagctcggataaacaaacaacaacaagaaaaatggctgaacagactgagaaggcttttttgaagcaacccaaggtctttctttgttcaaagaagagtgggaaaggaaagaggcctggaaagggaggaaacagattctggaaaagtgttggtcttggcttcaagacccctagagaggctattgagggaacctacattgacaagaagtgcccattcactggtgatgtctccatcagaggacgtattcttgctggtacctgccacagtgccaagatggtgaggaccattattgttcgcagggactaccttcactatgtcaagaaatatcaaaggtacgagaagaggcattcaaacattccagctcacatttctccatgcttccgtgtgaaagaaggggaccatgttactgttggacagtgcagacctttgtccaagaccgtgaggttcaacgtgttgaaggtgattccagctggatcttctggtggtggaaagaaggctttcacaggcatataaagaaagacttgtgcttgtttagcatgctaggttatgcaaaaacaatttattttgatttgctgattttgaagtgaaatgtggttcgagtatgaccttgttggtttaatgtttatgtagacgattgtttgctctagtcttattatttatgttttgatggttacacatccgttatctacattttgatttgcaacgagtagtgt

SEQ ID NO: 714 - DNA, 732 bp, Chrysanthemum coronarium
gtgacaaattaagataactggaacaagagctccttcatcttcattcacacacattcatcagccgccacaccttcaaatcaagcaacaatggcagaacagactgagaaggctttcttgaagcaacccaaagtgttcctttgctcgaagaagagtggaaaggggaagaggccagggaaaggtgggaacaggttctggaagagtgttggtttgggcttcaagactccaagagaggctattgaagggacttacattgacaagaagtgcccattcactggtgatgtttctatcagaggccgtattcttgctggtacatgccacagtgctaagatggtgaggactattatcgttcgaagggactatcttcattatgtcaagaaataccaaagatatgagaagagacactccaacatccctgctcacatctcaccatgtttccgtgtgaaggagggtgatcatgtcactgttggccagtgcagaccattgtcaaagactgtaaggttcaacgtgttgaaggtgattccagcaggatcttcagggggtggaaagaaagcctttaccggcatttaagtatactagggcttcaactctttttgctgcttgattatgtaaaagttttctagaaccaaattcgactgatatcgttccattgacattaatatgctgttgtttctggtttctgccaacacttaagagctattttaaggaattttgatattgtgttttcattctcta

SEQ ID NO: 715 - DNA, 714 bp, Chrysanthemum coronarium
tctagggttttatttatagagttgcttcatcttcattcatcagccgccacaccttcaaatcacacaacaatggcagaacagactgagaaggctttcttgaagcaacccaaagtgttcctctgctcgaagaagagtggaaaggggaagaggccagggaaaggtgggaacaggttttggaagagtgttggtttgggcttcaagactccacgagaggcaattgaagggacttacattgacaagaagtgcccattcacgggtgatgtttccatcagaggccgtattcttgctggtacatgccacagtgctaagatggtgaggactattatcgttcgaagggactatcttcattatgtcaagaaataccaaagatatgagaagagacactccaacatccctgctcacatctcaccatgtttccgtgtgaaggagggtgatcatgtcactgttggccagtgcagaccattgtcaaagactgtaaggttcaacgtgttgaaggtgattccagcaggatcttcagggggtggaaagaaagcctttaccggcatttaagtatactagggcttcaactctttttgctgcttgattatgtaaaagttttctagaaccaaattcgactgatatcgttccattgacattaatatgctgttgtttctggtttctgccaacacttgagagctattttaaggaattttgatattgtgttttcattctcta

SEQ ID NO: 716 - DNA, 688 bp, Cirsium arvense
gcgtttctcttcttctctctttgtgcctccgcctctgaaaagctcggatcacttcaacaatggccgaacagacggagaaggcgtttttgaagcaacccaaggtgtttttatgctcgaagaaaagtggaaaagggaagaggcctgggaagggtggaaacagattctggaagtctgttggacttgggtttaagacaccaagagaagctattgaaggaacttacattgacaagaagtgccctttcactggtgatgtctccatcagaggccgtattcttgctggtacatgccacagtgctaagatggtgaggaccatcatcgttcgcaggaactacctccattttgtcaagaaataccaaagatacgaaaagaggcattccaacattccagctcacatttctccctgctttcgtgtgaaagaaggcgatcatgtcactgttggacagtgcagaccattgtcaaaaacggtgaggttcaatgtgttgaaggtgatcccagctggatcttctggtggtggaaagaaggcgtttaccggcatataagaaagaagcttatcttctttatcttagattctgcaaaattttcgagtgaaatgtacttgctttaatacttctgcagacactctagttttcttttgctttatgattatgatatggttaacaattgaaaaaagaaaaaagtaccgactgcg

SEQ ID NO: 717 - DNA, 1108 bp, Gossypium hirsutum
gtaccaaaaactctctcattttatcactgccgctttgccagcagccgcgccacactcgagagagagctcgtcaaccatggccgaacagactgagaaagcctttttgaagcaaccaaaagtgtttttaagctcaaagaaatcttcaaaagggaagagacctggaaagggagggaaccgcttctggaagagcattggtttgggcttcaagactcctcgtgaagctattgaaggaacctacatcgacaagaaatgcccgtttgccggcactgtttcgatcaggggtcgtatcttagctggtacttgccatagtgctaagatgattaggacaatcattgttcgacggaattaccttcattatatcaagaaataccaaaggtatgagaagaggcattcgaacatacctgcacatatttctccatgcttccgtgtgaaggaaggggatcatgtcattattgggcaatgcaggccattgtcaaaaaccgtgaggttcaatgttttgaaagtgattcccgccggatcttccggcggtgggaagaaagccttcactggaatgtaagctgcgagtgttattctgtgtttttgtctggggtcgtaggagcctatgtttcactgttagatttcttttgttattgtttttctttccatttactttttatgtttggatgctgacatctggaattttgaagatatcacttgaatatgcttgaatttttgcattactagtatattcccattttcagataataaatctattatttaattatgatattatggatgaaatatctggtttctttaagccaagtcatcacagttatctgctttgaaagctataatggcagtgatttgaagcagctactatttgcagtacataaggtttcttgcttgcaatatacatgaatacatgacttgacatgcaatgcaatgatctttcacctaatggctggccactttttgcatgttaactctctccctttccttatatttgggtttaaggtttagggttctatctttcttaagtaggactatgatgtatacattgcaggctaaactagatgcatctagctctagcattggataccaacaacgtctggaaatgatagtttttgta

SEQ ID NO: 718 - DNA, 753 bp, Gossypium hirsutum
aggacggttgcgttgcagcctcctgccattagggtttttgtgctgtgtctttgcagtgtatcgggtagtcctttcaatcctcagccatggcggaacagacggagaaagcatttctcaaacaacccaaggtgtttttaagctctaaaaaaactgggaaaggaaagagacctggaaagggcgggaatcgcttctggaaaagcattgggttaggctttaagacacccagagaggccattgaaggaacatatattgataagaaatgcccatttactggcactgtttctattagaggccgtatccttgccggtacttgccatagtgcaaaaatggtaaggaccattatcgtccgaaggaactaccttcactacatcaagaaataccaaagatacgaaaaaaggcacagcaatatcccagctcatatatccccctgctttcgtgttaaagaaggagatcatgttataatcgggcaatgcaggcctttgtcgaagacggtgaggttcaatgtgctaaaggtcattccggcggggtcttccggtggtgggaagaaagcttttacagccatgtgagaggttagcttttgaaatggcaaaaattgtagtgttgaggtgtgtgtttcactgtatgaactttggttggtttttggtttaactgttttattttgatggaaaccatagttttgttgtttttgaaatctcccattgttacaatttagaggatctatttatgttgctgggttttggattgttggtattc

SEQ ID NO: 719 - DNA, 963 bp, Gossypium hirsutum
tcccacagcaagcgaatctctttcatttgcccgcactagcagcagcagcgccacactcttcacagtgctgatcaaccatggcggagcagaccgagaaggcatttctaaagcaacccaaagtgtttttaagctccaagaaatctgggaaagggaagagaccaggaaagggaggaaaccgcttctggaagagcattggtttgggcttcaaaacccctcgtgaagctactgaaggaacctacatcgacaagaaatgcccattcaccggcactgtttccatcaggggtcgcattttagccggtacttgccatagtgccaagatgataaggacaatcattgttcgacggaattacctacattatatcaagaaataccaaaggtacgagaagagacattcaaatatccctgcacatatttctccatgcttccgtgtgaaggaaggagatcatgtcattatcgggcaatgcaggccgttgtcaaagactgtgaggttcaatgttttgaaagtgattcctgctggatcttctggtggagggaagaaagcttttactggaatgtaaggtgtaactgttttcaatcatagttcgggttgtaggaacataaggagaagacattaaaatccctgaactgcctctagatatgaagaacctgggactattagatgtttttatgtttttgtttttcctttcctattacttgttatgtttggatttgtcttgttatgacaactggaattttgaaggtatcccctattctagtatgatcctgttctctgaagaatcactctgatcacttacttagattatgtatgaaatttctggagacattctgtaaattggcgaggggcatccattgtgcaaatgtatggtgaaagtatcacaaaccccctgtactatactttggattgcattttagcctgtctactaaaaaattggcgaattagccttgttgatgagtgagcaaaac

SEQ ID NO: 720 - DNA, 734 bp, Vigna unguiculata
cgccaacactctcctctgtagcttctgccgtcaagtactttcgtcatggctgaacaaaccgagaaggcttttttgaagcaaccaaaagtgttcctcagctcgaagaaaactgggaaggggaagagaccagggaaaggtggaaaccgcttttggaaatccattggacttggattcaagactcccagggaagccgtcgaaggaacttatattgacaagaagtgccccttcactggcaatgtctccatccgtggccgtatcctggctggtacatgtcacagtgctaagatgaacaggacaatcattgttagaaggaattatctccatttcattaagaagtaccagaggtacgagaagaggcactcaaatattcctgctcatatttcaccttgtttccgtgtgaaggaaggagatcatgtcattattggtcaatgcaggcctctctctaaaacagtgaggttcaatgtattgaaagtgatccctgctggttcttctagcggtgctaagaaggcttttactgggatgtgagctttgttttccagttttatgagtttagattatgttgtacgccgtgaattttgaaatccattagtttttcttagacaatgcagactcatctcccgtttcccattatatttaattagttcttatttgggtttaaagttgtggcattgtttttaaacagagatctaaatgtttccctaaattaacatcatatattttcactactacgtttg

SEQ ID NO: 721 - DNA, 807 bp, Cucumis sativus
agggtttctgtaatcaagtctccttcggccgcctgagcaaaccacaaatcctcctctcttcacaatccctaatcatggcggaacagaccgagaaggcctttttgaagcaacctaaagtgtttctctgctctaaaaagactgcaaaagggaataaacctggaaagggcgggaaccgtttctggaagaatattggattaggattcaagaccccaagagatgccattgaaggaacatatattgataagaaatgccccttcgctggaaccgtttccatcaggggacgtattttagctggaacatgccatagcgctaagatggtcaggaccattattgtaaggaggaactacctacattatgttaagaagtatcagaggtatgagaaaaggcactcaaacattcctgcccacatatctccttgctttcgtgtgaaggaaggtgatcatgttattattggccaatgcaggccattgtcgaagacagtgaggttcaatgtgttgaaggtcattcctgctggatcctcaagtcgtgggaagaaggcttttgctggaatttaaattatgatgtaggggtttccgcttttgatacaaaaagaaaagaagcaagaaagaacttttgagagttgtagtaggggccaatatttgatgtaagaggggttttgaaagacttagcagtctggattttgatatgaatatggactgttttattatgttctatttgctgtgatttcttgtctaatttgggtttttggaagtaccaacatctccttcatctctattaggtcattctaatacatgtcagttttatatt

SEQ ID NO: 722 - DNA, 835 bp, Cucurbita pepo
ccgcctgagcaaaccagaactcgtgctctcttcagaagttctaatcatggcggaacagaccgagaaggcgtttttgaaacaacccaaagtttttctctgctccaaaaagattgggaagggaaagcgacctggaaagggcgggaaccgtttctacaagagtattggattaggattcaagacgcctagggaagccattgaaggaacgtacattgataagaaatgccccttcactggaactgtctctattaggggccgcattttagctggaacttgccatagtgctaagatggtcagaaccattattgtcaggaggaactacctacattatgtcaagaagtatcagaggtatgagaaaaggcactccaacattcctgcccatatttctccttgctttcgtgtaaaggagggagatcatgttattattggccaatgcaggccattgtcgaagacagtgaggttcaatgtgttgaaggttattcctgcaggatcctcaactgggaagaaagcgtttgctggaatttaaattatgtagacttctgcttttgatacaaaaacagcatgaaagaactatttagagttgttgtaggccatatttgattcaagagggttttgaagacttggcagtctggattttgatatcaatatggactgttttattctgttctttttgttttcatgtcccgtcttatttctagtaaatttcgggttttgaagtaccatattctcctggttgtcagatcatattaacaaacttgttctagcaggtttttggtcgaactctagtcttgtttttccatgtcgacgtattgcgaaatgctgatcttgctttgcattg

SEQ ID NO: 723 - DNA, 743 bp, Cyamopsis tetragonoloba
tctgccgcttgatctctctgctctgcttgcatttcaccctctaacaatggcggaacagaccgagaaggctttcttgaagcaacccaaggtgtttctcagttcgaagaaatccggtaaggggaagagacctggaaaaggagggaacaggttctggaaaagtattgggttgggattcaagactcccagagacgcaattgaagggacatacattgataagaaatgcccattcaccggcaacgtttccatccgtggtcgcattctcgctggcacttgccacagtgccaaaatgaacaggactatcattgttcgtcgtaactatcttcacttcatcaagaaataccaaaggtatgagaaaaggcactcaaatattccagcgcatatatctccatgtttccgtgtgaaggagggagaccacgttattattgggcagtgcaggccgttgtcaaagacagtgagatttaacgtattgaaagtgattcctgctggatcctctggaacggttaagaaagcttttacaggagcatgagcattttccatcctccccaccccccagaaaatttcctgtttgaggattttagatttagcaacttttgatatgtgactttctcctttaatgtgctttgaaggaatcaatatcaatatttgtgttattaatttttcgtattgcagtttctgtactgtcatcctttctgctgtacggatccttgtatttttaatttatgctgcgttatttatagccaaag

SEQ ID NO: 724 - DNA, 767 bp, Cynara scolymus
ggggaggttactcttgccttctgtcatttcctctttctctttgtgcctccgccactgaaaagctcggatctcctcaacaatggccgaacagacggagaaggcgtttttgaagcaacccaaggtgtttttatgctcgaagaaaaatgggaaagggaagaggcctgggaagggtggaaacagattctggaagagtgttggtcttggattcaagacaccaagagaagctattgaaggaacttacatcgacaagaagtgccctttcactggtgatgtctccatcagaggccgtattcttgctggcacatgccacagtgccaagatggtgaggaccatcattgttcgtaggaactacctccattttgtcaagaaataccaaagatacgaaaagaggcattccaacattccagctcacatttctccctgctttcgtgtgaaagaaggtgatcatgtcaccgttggacagtgcagaccattgtcaaagacggtgaggttcaatgtgttgaaggtgatcccagctggatcttctggtggtggaaagaaggcgtttaccggcatataagtagcttaccttctttatcttagattcgcaaaaacaatttgctgattcgagtgaaatgtacttgcttaaatactcctgcagacgtaatttttggctctagtcttcttttacttttgatgtttacgattatgagatgattgtaagtttaacaatcgaagttttgatttgttacattattggtactttatagaagttggcactccattca

SEQ ID NO: 725 - DNA, 766 bp, Cynara scolymus
gcgggacggttgagctttgggtaggttagtgcaacatttgattcatctgccaccgccgctgcaaagctcgtctcttttcaaccatggctgaacagacggaaaaagcgtttttgaagcaacccaaagtatttctatgctcaaagaaaagtggaaaagggaaaaggcctggaaaaggtggaaacagattctggaagagcgtcggtcttggctttaagacgccacgagaagctatcgaaggaacttatattgacaagaagtgccctttcaccggtgatgtctccattagaggccgtattctagctggtacgtgccacagtgctaagatggtgaggaccatcattgttcgtaggaactatctccactttgtcaagaaataccaaagatatgagaagaggcactcaaacattcctgcccatatatcaccgtgttttcgtgtgaaagaaggtgatcatgtcacagttggacagtgcagacctttgtccaagacagtgaggttcaatgtgttgaaagtgataccagctggttcttctggtggtgggaagaaggcatttacaggcatatagtcttgtagctcgacgcccttgttagaagcactttcaggttaaggttagcatgtcaattttgaatttagcttaaatgacaatagtcattgttttgttcccagtttatgcatcaaatgtcgttcatgcttgagagatattaaagaattttgcatcttgtatttttttgtttatgtttttagtattttcattgacgcgttgttgcg

SEQ ID NO: 726 - DNA, 773 bp, Cynara scolymus
ggggaggttactcttgccttctgtatttcctctctctttgtgcctccgccactgagaagctcggatctcttcaacgatggccgaacagacggagaaggcgtttttgaagcaacccaaggtgtttttatgctcgaagaaaagtgggaaaggaaagaggcctgggaagggtggaaacagattctggaagagtgttggtcttggattcaagacgccaagagaagctattgaaggaacttacatcgacaagaagtgccctttcactggtgatgtctccatcagaggccgtattcttgctggcacatgccacagtgccaagatggtgaggaccatcatcgttcgcaggaactacctccattttgtcaagaaataccaaagatacgaaaagaggcattccaacattccagcgcacatttctccctgctttcgtgtgaaagaaggcgatcatgtcactgttggacagtgcagaccattgtcgaagacggtgaggttcaatgtgttgaaggtgatcccggctggatcttctggtggtgggaagaaggcgtttaccggcatataagaacaagcttactttctttatctcgttagattctacgaaaacaatttgatgatttttgagtgaaatgtggtgttccgttatcaacttgttttaatgattctgcagacgtaattttttggctcttgttttcttttactttcgatgtttacgataatgtgatgattgtaattttaaacatcgaaagttttgatttgtaaactaaaaaatgcaaaatgtt

SEQ ID NO: 727 - DNA, 657 bp, Euphorbia peplus
tgcatcggactctgcggcttaggtttctatcggatcttcgaaaccctaacaatggcggaacagacggagaaggcttttctgaagcagcccaaggtgtttctttgctcgaagaaatcggggaaaggaaagaggccaggaaaaggaggaaatcggttttggaagagcattggtttgggattcaaaactccgagagatgcaattgaaggaacctatattgacaagaagtgtccattcaccggcactgtttctattagggggcgtatacttgctggtacctgccacagcgccaagatggtgagaaccatcattgtaagacgtaattatcttcattatgtgaagaaatatcaaaggtatgaaaagagacactctaacattccagcacatatagctccttgctttagggttaaagagggagaccatgttatcattggccagtgcaggccgttgtctaagactgtgaggtttaatgtattgaaagtgattcctgctggatcatccacaggtggcaagaaggctttcacagggatttaagtccagaattttcaggtgtcccatatttgtctatgtcaaggggatgataccccagcatgagcttttcttcagctagatgatcttttcacttttttattaaccgaatatttcattattgtgatacta

SEQ ID NO: 728 - DNA, 923 bp, Fagopyrum esculentum
agtactagggttttagtgtgcggaggatcgtggtttcatttgctcaaacaccaaaccctaataatggcggaacagaccgagaaggcgtttctcaagcagccaaaggttttcctcagctcgaagaagagtgggaagggaaagagacctggaaagggaggtaacaggttttggaagagcattggtcttggtttcaagacacctagagaggccattgaaggtacatacattgacaagaaatgtcccttcaccggcacagtttcaatcagaggccgtatcctaaccggaacatgccacagtgccaagatgaacagaacaatcattgtgcgccgtaactatcttcactttgtgaagaagtatcaaaggtacgagaagaggcattccaacattccagctcatgtctccccgtgcttccgtgtgaaggagggagaccacactatcataggccaatgcaggccgttgtcaaaaacagtgagattcaatgtgttgaaagttatccctgctggctcatcatctggtgcaggaaagaaggcttttaccgggatgtgaagccctttcaaaaggcttttgcctttctacaacctaaattgtttggatggcactgaagagggacaatcaagagaccaagacattttcaaatattgcatttttaataccttgaaaatcttacccagcatttttactattgagatttatcagtatgatctagccttgcccaatgttttgctggatgaatgttttaagtttatatatgatccagcatcaaagaattgtatctttctccctgcctagcttaactattctgatccgtagtctgtgggcctgtaggagcctggatagttggatgagcatgcttgttgatgcattcagaatttcgacattggagaagtttaagagatgataactgcatcttaaatcaaaatgat

SEQ ID NO: 729 - DNA, 599 bp, Flaveria ramosissima
attggggacttctcccttgtgttccatcgttcttctttccgtgtgcctccaccggtgacgaccaagggtatctgcaacaatggctgaacagacggagaaggcgtttttgaagcaacccaaggtgtttttatgttcgaagaagagtgggaaagggaagaggcctgggaagggtggaaacaggttctggaagagtattggtcttggcttcaagacaccaagagaggctattgaaggaacttacattgacaagaaatgccctttcactggtgatgtatctattagaggacgtattcttgctggcacatgccacagtgcaaaaatggtgaggactattattgttcgtcgggactacctccattatgtcaaaaagtatcagcggtatgagaagaggcactcgaacattccagctcacatttctccatgctttcgtgtgaaagaaggtgatcatgtcaccattggacagtgcagaccattgtccaagacggtgaggttcaatgtgttgaaggttattccagctggatcttccagtggggggaagaaggcttttacaggcatttaaaaagcttatatctttttcttgttaggttttgcaaaaacac

SEQ ID NO: 730 - DNA, 655 bp, Flaveria ramosissima
tgcctccgccactgaaaagctcggatctcttcaacaatggctgaacagactgagaaggcgtttttgaagcaacccaaggtgttcttatgttcaaagaaaagtggaaaggggaagaggcctgggaaggctggaaacagattctggaagagtattggacttgggtttaagacaccaagagaagccattgaaggaacttacatcgacaaaaaatgccctttcactggtgatgtctccattagaggccgtattcttgctggtacgtgccacagtgctaaaatggttaggaccattattgttcgccgggattaccttcactatgtgaagaagtatcagcgttatgagaagcgccattcgaacatcccggcacacatttcaccatgtttccgtgttaaggaaggtgatcatgtcaccattggccagtgcagaccattatccaagacggtgaggttcaacgtgttgaaggtgattccagctggatcttcaagtgctgggaaaaaagcatttacaggcatataagaagcattatcttcttgatcttgttaggctttgcaaaaaacagttcaatttgctctaatttgaagtaaaatgtgttttgattatgtaccttgttaaatgttttcttaagtcaaattatgtgctctaaaatcaaattttg

SEQ ID NO: 731 - DNA, 584 bp, Flaveria ramosissima
attgctgcttattctgcaccttcatccgccgcttcaaagctaataatctctcatcaacaatggcggaacagacggagaaggcttttctgaagcagccgaaggtgtttctctgctcgaagaaaagcggcaaaggaaagaggcccgggaaaggtggaaacaggttctggaagagtattggactcggatttaagacaccgagagaggcgattgaaggaacttacatcgacaagaaatgccctttcactggtgatgtatccattagaggtcgtattttagctggtacatgccatagtgccaagatggtgaggactattatcgttcgaagggactatcttcattatgtgaagaagtatcagagatacgagaagaggcactcaaacattccggctcacatctcgccatgtttccgtgtgaaagaaggcgaccatgtcaccattgggcagtgcagaccattatcaaagacagtgagattcaatgtgttgaaggtgattccagcaggatcttcaagtggtgggaagaaagcattcacaggcatataaaaatatgagctttcgattctttttgtttgatcatgtagaagattt

SEQ ID NO: 732 - DNA, 545 bp, Flaveria ramosissima
gggttattgctgcttcttctgcaccttcgaacgccgctgcaaagctaataatatctcatcaacaatggctgaacagacggagaaggcttttctgaagcagccgaaggtgtttctctgctcgaagaaaagcggcaaaggaaagaggccggggaaaggtggaaacaggttctggaagagtattggactcggatttaagacaccgagagaggcgattgaaggaacttacatcgacaagaaatgccctttcaccggtgatgtatccattagaggtcgtattttagctggtacatgccatagtgctaagatggtgaggactatcattgttcgaagggactatcttcattatgtgaagaagtatcagagatatgagaagagacactcaaacattccggctcacatctcgccatgtttccgtgtgaaagaaggcgaccatgtcaccattgggcagtgcagaccattatcgaaaacagtgaggttcaatgtgttgaaggtgattccagcaggatcctcaagtggtgggaagaaagcatttacaggcatataag

SEQ ID NO: 733 - DNA, 819 bp, Linum usitatissimum
tgctgctcatctcggccgtctcggcgtctttgctccctcgcctctcagtcagttgccactcctcacaatctcgcaaccatggcagagcagacggagaaggcttttctgaagcagcccaaggtgttccttagttctaagaagtcttcgaaggggaagaggcccggaaaaggaggcaaccgtttctggaagagcatcggcttgggtttcaagactcctagagaagcaattgaagggacgtacattgataagaaatgtccgttcactggaactgtttctatcagaggccgtatcattgcgggtacttgtcacagtgccaagatgatgagaaccattgttgtgaggcgcaattaccttcattacataaagaagtaccaaaggtatgagaagaggcattctaatatcccagcacatgtatctccatgcttccgtgtgaaggagggtgaccatgttattattgggcaatgcaggcctctatcgaagactgtaaggttcaacgtgctgaaagtgattcctgctggttcttctggcggagggaagaaagcattcaccggcatgtgaaaaggctgaaattgaagaatatccaggggtttgtagaatagggcttgttagaagaggaatccatccaaattgaggttaaacttctgctcatgttcttgtatgccgattttgttacttcttagttgttgatgaagttattgagaacttgcattgttgacgacagatctgtttcgtgctcaagctattatagtccccgaagtattacctttttctatgtcaactggatcgtgtgtttgctaattgatctttgagtttgaggag

SEQ ID NO: 734 - DNA, 786 bp, Panax ginseng
cccaaatctccagaacctgcaataatggcggaacagaccgaaaaggcgtttttgaagcagcccaaggtgtttctttgctcaaagaagacaggaaagggaaagaggccaggaaaaggaggcaatcgtttccacaagagcgttggattaggattcaagacacccagagaggctattgaaggtacttacattgacaagaaatgcccatttactggagatgtttctattaggggccgtattcttgctggtacttgccacagcgccaagatgattagaactatcattgttcgccgtaactacctgcattatgttaagaaataccagaggtatgagaaaagacattcaaatattccagctcacgtatctccttgcttccgtgtgaaagagggagaccatgtaattgttggccagtgcaggccattgtcaaagacagttagattcaatgtgttgaaagtgatcccagctgggtcttctggtggtggaaagaaggctttcaccggtatttgagtttggtgtctggtcagtgttacattatatgggcgggaatgatgttagagtttactattttggctaggtggaaccttttcccattgacttgcccttgaagtgaaggcttaaatttttgtatgggaccaattaatgttttgcgtcaaacctggttttcggatttgtcatttccagtcttattaatcaagtacatggttattagttggctcttgctagtgaattttcctgattagtgtagaaatatttggtgttcactttatctattacaacgtttgcatacta

SEQ ID NO: 735 - DNA, 937 bp, Panax ginseng
gagtttctgcccagcctccattttgcaccttcttccccaaatctccagaacctgcaataatggcggaacagaccgaaaaggcgtttttgaagcagcccaaggtgtttctttgctcaaagaagacaggaaagggaaagaggccaggaaaaggaggcaatcgtttccacaagagcgttggattaggattcaagacacccagagaggctattgaaggtacttacattgacaagaaatgcccatttactggagatgtttctattaggggccgtattcttgctggtacttgccacagcgccaagatgattagaactatcattgttcgccgtaactacctgcattatgttaagaaataccagaggtatgagaaaagacattcaaatattccagctcacgtatctccttgcttccgtgtgaaagagggagaccatgtaattgttggccagtgcaggccattgtcaaagacagttagattcaatgtgttgaaagtgatcccagctgggtcttctggtggtggaaagaaggctttcaccggtatttgagtttggtgtctggttagtgttgcattatatgggcgggaatgatgttagagtttactattttggctaggtgggaccttttcccattgacttgcccttgaagtgaaggcttaaatttttgtatgggaccaattaatgttttgcgtcaaacctggttttcggatttgtcatttccagtcttattaatcaagtacatgattattagttggatgttttttctcttgctagtgaattttcctgattagtgtagaaatatttggtgttcattttatctattacaacgtttgcatactatagtttacttggaaaactttgtaatcatttgatggaaaattggatttgctagttcattatcttgatcaggcacacatcctaaattgaacaatgtgagctagtttaac

SEQ ID NO: 736 - DNA, 822 bp, Panax ginseng
agagtacgcgggggctgcacaatagagtttctgcccagcctccatttttacaccttcttccccaaatctccagaacctgcaataatggccgaacagaccgaaaaggcgtttttgaagcagcccaaggtgtttctttgctcaaagaagacaggaaagggaaagaggccaggaaaaggaggcaatcgtttccacaagagcgttggattaggattcaagacacccagagaggctattgaagggacttacattgacaagaaatgcccatttactggagatgtttctattaggggccgtattcttgctggtacttgccacagcgccaagatgatgagaactatcattgttcgccgtaactacctgcattatgttaagaaataccagaggtatgagaaaagacattcaaatattccagctcacgtatctccttgcttccgtgtgaaagagggagaccatgtaattgttggccagtgcaggccattgtcaaagacagttagattcaatgtgttgaaagtgatcccagctgggtcttctggtggtggaaagaaggctttcactggtatttgagtttggtgtctggttagtgttgcattatatgggcgggaatgatgttagagtttactattttggctaggtgggaccttttcccattgacttgcccttgaagtgaaggcttaaatttttgtatgggaccaattaatgttttgcgtcaaacctggttttcggatttgtcatttccagtcttattaatcaagtacatgattattagttggatgttttttctcttgctagtgaattttcctgattagtgtagaaatatttggt

SEQ ID NO: 737 - DNA, 642 bp, Panax ginseng
tttgcaccttcttccccaaatctccagaacctgcaataatggcggaacagaccgaaaaggcgtttttgaagcagcccaaggtgtttctttgctcaaagaagacaggaaagggaaagaggccaggaaaaggaggcaatcgtttccacaagagcgttggattaggattcaagacacccagagaggctattgaaggtacttacattgacaagaaatgcccatttactggagatgtttctattaggggccgtattcttgctggtacttgccacagcgccaagatgattagaactatcattgttcgccgtaactacctgcattatgttaagaaataccagaggtatgagaaaagacattcaaatattccagctcacgtatctccttgcttccgtgtgaaagagggagaccatgtaattgttggccagtgcaggccattgtcaaagacagttagattcaatgtgttgaaagtgatcccagctgggtcttctggtggtggaaagaaggctttcaccggtatttgagtttggtgtctggtcagtgttacattatatgggcgggaatgatgttagagtttactattttggctaggtggaaccttttcccattgacttgcccttgaagtgaaggcttaaatttttgtatggg

SEQ ID NO: 738 - DNA, 757 bp, Gossypium raimondii
caaaaactctctcattttatcactgccgctttgccagcagccgcgccacactcgagagagagctcgtcaaccatggccgaacagactgagaaagcctttttgaagcaaccaaaagtgtttttaagctcaaagaaatcctcaaaagggaagagacctggaaagggagggaaccgcttctggaagagcattggtttgggcttcaagactcctcgtgaagctattgaaggaacctacatcgacaagaaatgcccgtttgctggcacggtttcgatcaggggtcgtatcttagctggtacttgccatagtgctaagatgattaggacaatcattgttcgacggaattaccttcattatatcaagaaataccaaaggtatgagaagaggcattcgaacatacctgcacatatttctccatgcttccgtgtgaaggaaggggatcatgtcattattgggcaatgcaggccattgtcaaaaaccgtgaggttcaatgttttgaaagtgattcccgccggatcttccggcggtgggaagaaagccttcactggaatgtaagctgcgagtgttattctgtgtttttgtctggggtcgtaggagcctatgtttcactgttagatttcttttgttattgtttttctttccatttactttttatgtttggatgctgacatctggaattttgaagatatcacttgaatatgcttgaatttttgcattactagtatattcccattttcagataataaatctattatttaat

SEQ ID NO: 739 - DNA, 750 bp, Gossypium raimondii
gggtttttgtgctgtgtcttagcagtgtatcgggtagtcctttcaatcctcagccatggcggaacagacggagaaagcatttctcaaacaacccaaggtgtttttaagctctaaaaaaactgggaaaggaaagagacctggaaagggcgggaatcgcttctggaaaagcattgggttaggctttaagacacccagagaggccattgaaggaacatatattgataagaaatgcccatttactggcactgtttctattagaggccgtatccttgccggtacttgccatagtgcaaaaatggtaaggaccattatcgtccgaaggaactaccttcactacatcaagaaataccaaagatacgaaaaaaggcacagcaatatcccagctcatatatccccctgctttcgtgttaaagaaggagatcatgttataatcgggcaatgcaggcctttgtcgaagacggtgaggttcaatgtcctaaaggtcaatccagcggggtcttccggtggtgggaagaaagcttttacagccatgtgagaggttagcttttgaaaggcaaaaattgtagtgttgaggtgtgtgtttcgctgtatgaactttggttggtttttggtttaactgttttattttgatggaaaccataattttgttgttttcgaaatctcccattattacaatttagaggatctatttatgttgctgggttttggattgttggtattccatatgatgcctgtcttctccttttgttg

SEQ ID NO: 740 - DNA, 799 bp, Heritiera littoralis
gatgtgcgctgtcgccctgcaattagggttttggtaaagtgtaaacctcttttgtctttgcattatcgggtagacggtagctcctcattcttcaaccatggcggaacagacggagaaggcatttttgaagcagccaaaggtatttctaagctctaagaaatctggaaaaggaaagaggcctggaaagggtgggaatcgcttctggaaaagcattgggttgggctttaagacacccagagaggcaattgaaggaacatatattgataagaaatgcccatttactggcactgtttctatcagaggccgtatccttgctggcacctgccatagtgcaaaaatgatgaggaccattattgttcgaaggaactaccttcactacattaagaaataccaaagatacgaaaagaggcattctaacatcccagctcatatttccccctgctttcgtgttaaagaaggagatcatgtcataatcgggcaatgcaggcctttgtcaaagacagtgaggttcaatgtcctaaaggtcattccagctgggtcttctggcggtgggaagaaggcttttacagccatgtgagacatttgccttttgaaatggcaaaattgtagggtcggtgttgaggtgtattcactatatgaactttggttgattttgatttggttccttgtgttaatggaaacttaatttgttggctggaaatctcgattattataattttgaggatctatttacatgttgcttttttctaattctgtttcaacgttcaattctttcgagtagaaaacatcaaatcttatg

SEQ ID NO: 741 - DNA, 807 bp, Momordica charantia
ctgctccttcggccgcctgagcaaaccagaactcgtgctctcttcagaaggaagccctagccatggcggaacagaccgagaaggcgtttttgaagcaacccaaagtttttctctgctccaaaaaaaccggaaaggggaagagacctggaaagggtgggaatcgtttctggaagagcattggattaggattcaagacgccaagggaagccactgaaggaacatacattgataagaaatgccccttcactggaactgtttctattaggggccgtattttagctggaacttgtcatagtgctaagatggtcaggaccattattgtcaggaggaactatctacactatgttaagaagtatcagaggtatgagaaaaggcactccaatattcctgctcacatatctccttgcttccgtgtcaaggagggcgatcatgttattattggccaatgcaggccattgtcaaagacagtgaggttcaatgtgttaaaggtcattcctgctggatcctcaagtcgtgggaagaaggcttttgctggaatttaaatcatgtagggtttcgcttttgataaaaaaactgcatgaaagaactttcgagttttaggccatatttgtgatgcaagagggttttgaagacttacagcctggattttgatatgaatatggactgttttattctgttctatttgttttaatttcttggtcttaattttagcagatttggggttttgaagggtaccaaattctcttgttgtcttataggtattctaatacatgtcagttttataatatgagattttctttgcactgt

SEQ ID NO: 742 - DNA, 862 bp, Elaeis guineensis
cctctctttcgctacagccgccgttgctgcttgcgtctggttccctcgctcaaaggccctgccctcctcctcttttgattcaatcatggccgagcagaccgagagagcgtttcttaagcagccaaaggtgtttctctgctcgaagaaggctgcgaagggaaagaagcctggtaagggggggaacagattttggaagagcattgggcttggattcaaaactcccagagaagccattgaaggaacctatattgataagaaatgcccattcactggtactgtgtcaattaggggtcgcatcttggcaggcacatgccacagtgcgaagatgaacagaaccataattgtgcgccgaaactaccttcactatgtgaggaagtatcaaaggtatgaaaagaggcactcaaatatagcagcgcacgtatcaccctgtttccgtgtgaaggaaggggaccatgtaatcattgggcagtgcaggccattggcgaagactgtaaggttcaatgtgttgaaagtcattccagctggctcaaaaagtggcggcggcaagaaggcttttgctgcaatctgaagtgttctcgaggttcagagaccattgagatgtgtccagttagaacttcttattgtaagactgatgttagagcagaaatgttaggcttttaaatttcattgtgggtacatgcgtttactgaaatactcatgtaaggttttgattggattattgaagtttgaaagggttaaacttatggcatcgcgtccagaattctgaacccctatttgcaaggccttatgatacgcatattttggaaaaaaaaaaactaaaactaagaagactacgaccgaacgacgaacaacggaagggaag

SEQ ID NO: 743 - DNA, 827 bp, Carica papaya
gtcgtcaaccgcgtctgcttggattagctctccctccctccctctgtgactttgctccagtgccgccttgcattctcccgggagctaacaaccatggctgagcagaccgagaaggcctttctgaagcaacccaaagtgtttctaagttctaagaaacctgggaaggggaagaggcccggaaagggtgggaaccgcttctggaagagcatcgggttaggtttcaagactccccgtgaagccatcgaaggaacttacattgataagaaatgcccctttactggaactgtgtcaatcaggggtcgtattttggctggtacctgccacagtgccaagatggggaggaccatcactgttagaagaaactaccttcattttgtgaaaaaatatcaaaggtacgagaaaagacattcgaacattccagcgcatatttcaccatgcttccgtgtcaaggaaggagatcatgttattattggtcaatgcaggccattgtcaaagactgtaaggttcaatgtcttgaaggtgatccctgctggatcttctagtggtgggaagaaagcttttaccggaatgtgaggagctcgctcctgttttttgcggtagcatggtgcaataggttatgggttagagttgtttgctaaagtaagaagagaccctccaagttttgaactgcatttagatttttttggaaaacgcggaccatgagttcttatctttttctctttctcgtctttccaagtttaaatattgatttcgagtacggccaagcacattattttatgaatagaattgcaattcactcaatcaattagagttatttattccattgc

SEQ ID NO: 744 - DNA, 734 bp, Carthamus tinctorius
cggggacactgtttatttttagggttttagggtttccttctctctgatttgtgccgaatagctaacctacctctgcctcctcttcaacaatggcggaacagacggagaaggcgtttttgaagcaacccaaggtgtttttatgctccaaaaagagtgggaaaggaaagaggcctgggaagggtggcaacagattctggaagagtgttggtcttggtttcaagacaccaagagaagctattgaaggaacttacatcgacaagaagtgccctttcactggtgatgtctcgatcaggggccgtattcttgctggtacatgccacagtgccaagatggtcaggaccatcattgtccgtaggaactacctccattttgtcaagaaatatcaaagatacgaaaagaggcattccaacattccagctcacatttctccatgcttccgtgtgaaagaaggcgatcatgtgactgttggacagtgcagaccattgtcaaagacggtgaggttcaatgtgttgaaggttatcccggctggatcttctggtggtggaaagaaggcctttaccggcatataaactacttttttcttgagtgagtgaaatgtggttgggtttaatgcttctagtttttgtttatttttgattatgagatgattgacgacaatccaagtctttatttgatacattattgttattattgctttagaaatcagtaactccgatgaaagccttccttcatcc

SEQ ID NO: 745 - DNA, 645 bp, Scabiosa columbaria
ttagcttcatagtcttcaacaatggcggagcagactgaaaaggcttttctcaagcaaccaaaggttttcctctgctcgaagaaatctggaaaggggaagaggccaggaaagggagggaatcggttctacaagagcgttggattagggtttaagactccacgagaggcgattgaaggtacatatattgataagaaatgtccatttactggagatgtttccataaggggtcgtatcattgctggtacttgtcacagcgccaagatggttaggaccatcattgttcgtcgtaactacctacattatgttaagaaataccagaggtatgagaagaggcattccaacattcctgctcatgtatccccgtgctttcgtgtgaaagaaggcgaccatgtgattattggtcaatgcaggcctttgtcgaaaacggtgagattcaatgtgttgaaagtgatcccagctggttcttccggtggtggaggcaagaagggatttactgggatgtaagctggtgcccttcttctagattttatcgttggcaatcaaagtattagtttaaacaaaacttgttttggatctgtttctgttggaatgttttactcttgaatttttgtattccgtggattaaagatttttgtttctactgag

SEQ ID NO: 746 - DNA, 620 bp, Scabiosa columbaria
gtagcttcatagtcttcaacaatggcggagcagactgaaaaggcttttctcaagcaaccaaaggttttcctctgctcgaagaaatctggtaaggggaagaggcctggaaagggaggaaatcggttctacaagagcgttggattagggtttaagactccacgagaggcgattgaaggtacatacattgataagaaatgcccattcactggagatgtttccataaggggtcgtatcattgctggtacttgtcacagcgccaagatggttaggaccatcattgttcgtcgtaactaccttcattatgttaagaaataccagaggtatgagaagaggcattccaacattcctgctcatgtatccccatgcttccgtgtgaaagagggtgaccatgtcattatcggtcaatgcaggcctttgtcgaaaacggttagattcaacgtgttgaaagtgatcccagctggttcttcaggtggtggaggcaagaagggatttactgggatgtaagttggtgactttcttctagttttttctgtcagcaatcatagtattagtttgaacaaaatttgtttgggttctgttcctgttggaatgttttgctgttgaatttttgtattccctgg

SEQ ID NO: 747 - DNA, 760 bp, Glycine max
gagcgaagaagatattagggtttttgagtgcggtgcggcgatcctagcactctcttctgcagctttcgccgacagcttcattcaccatggctgagcaaaccgagaaggcttttttgaaacaaccaaaagtgtttctcagctcgaagaaaactgggaagggaaagagacccggaaagggtgggaaccgcttttggaaatccattgggcttggatttaagactcccagggaagccatcgaaggaacctacattgacaagaagtgccccttcactggcaatgtttccatccgtggccgtatcttggctggaacatgtcacagtgctaagatgaacaggactattattgttaggaggaattatctccattttatcaagaagtaccagaggtacgagaaaaggcactccaacattcctgctcatatatcacctgctttccgtgtgaaggaaggagatcacgttattattggtcaatgcaggccactttctaagactgtgaggttcaatgtgttgaaagtgatcccagctggatcttctagcggtgcaaagaaggcttttactggaatgtgagctttgatttccagtttttattgaagataaatgttaccttattaattattatatctgatttcttttctggatgataacaaatatgaaaaccttgtcaattttggattttctttgaggtttcgttctggctttatgtttaggatcttgttataatacattatggttttcgaatcttattagcctttcaatttttt

SEQ ID NO: 748 - DNA, 557 bp, Euphorbia esula
tgcatcggactctgcggcttaggtttctatcggatcttcgaaaccctaacaatggcggaacagacggagaaggcttttctgaagcagcccaaggtgtttctttgctcgaagaaatcggggaaaggaaagaggccaggaaaaggaggaaatcggttttggaagagcattggtttgggattcaaaactccgagagatgcaattgaaggaacctatattgacaagaagtgtccattcaccggcactgtttctattagggggcgtatacttgctggtacctgccacagcgccaagatggtgagaaccatcattgtaagacgtaattatcttcattatgtgaagaaatatcaaaggtatgaaaagagacactctaacattccagcacatatagctccttgctttagggttaaagagggagaccatgttatcattggccagtgcaggccgttgtctaagactgtgaggtttaatgtattgaaagtgattcctgctggatcatccacaggtggcaagaaggctttcacagggatttaagtccagaattttcaggtgtcccatat

SEQ ID NO: 749 - DNA, 598 bp, Ambrosia trifida
ttccttctcctcctatcatctgatctgtgcctccgtcacttaaaacctcggatcttttcaacaatggcggaacagacggagaaggcgtttttgaagcaacccaaggtctttttatgttcgaagaagagtggaaaggaaagaggcctggaaagggtggcaacagattctggaagagtattggtcttggcttcaagactcctagagaagctattgatggaacttacatcgacaagaaatgccctttcactggtgatgtctccattagaggtcgtattattgctggtacatgccacagtgctaaaatggttaggaccattattgttcgtcgtgactatctccattatgtgaagaagtatcagcgttatgagaagcgccattcgaacatcccagcacacatttctccatgtttccgtgtgaaagaaggggaccatgtcaccattggacagtgcagaccattatccaagacagtaaggttcaacgtgttgaaggtgattccagctggatcttcaagcgctgggaagaaagcgtttacaggcatctaataagcttgatcctcttatttagcttcttgttaggctttgcaaaaacaattaaattt

SEQ ID NO: 750 - DNA, 597 bp, Flaveria ramosissima
ctacctaatttctgatcaacaatggctgaacaaaccgagaaggcgttttgaagcaaccgaaagtgttcctctgctcgaagaaaagcgggaaagggaagaggcctgggaagggtggaaacagattctggaagagcattggtctcggatttaagacgcctagagaggctattgaaggaacatacattgacaagaaatgcccttttaccggagatgtatcaattagaggccgtattttagctggtacttgccatagtgctaagatggtgaggaccattattgtacgaagggactatcttcattatgtgaagaagtaccaaaggtatgaaaagagacactcaaacatacctgctcatatctcgccatgtttccgtgtgaaagaaggtgaccatgttatcatcgggcaatgcagaccgttatcaaagacggtgagattcaacgtgttgaaggttattccagcaggatccgcaagtggtggtaagaaagcatttacaggcatatagagtaacattagcgttggaactctttttgcttgatcatgtaaaagtttttgagaacaaatcggagttgtgccgtttcattgacagttattattctgtt

SEQ ID NO: 751 - DNA, 923 bp, Panax ginseng
tacgcgggggctgcacaatagagtttctgcccagcctccatttttacaccttcttccccaaatctccagaacctgcaataatggccgaacagaccgaaaaggcgtttttgaagcagcccaaggtgtttctttgctcaaagaagacaggaaagggaaagaggccaggaaaaggaggcaatcgtttccacaagagcgttggattaggattcaagacacccagagaggctattgaagggacttacattgacaagaaatgcccatttactggagatgtttctattaggggccgtattcttgctggtacttgccacagcgccaagatgatgagaactatcattgttcgccgtaactacctgcattatgttaagaaataccagaggtatgagaaaagacattcaaatattccagctcacgtatctccttgcttccgtgtgaaaagagggagaccatgtaattgttggccagtgcaggccattgtcaaagacagttagattcaatgtgttgaaagtgatcccagctgggtcttctggtggtggaaagaaggctttcactggtatttgagtttggtgtctggttagtgttgcattatatgggcgggaatgatgttagagtttactattttggctaggtggaacctttcccattgacttgcccttgaagtgaaggcttaaatttttgtatgggaccaattaatgttttgcgtcaaacctggttttcggatttgtcatttccagtcttattaatcaagtacatggttattagttggatgttttttctcttgctagtgaattttcctgattagtgtagaaatatttggtgttcactttatctattacaacgtttgcatactatagtttacttggaaaactttgtaatcatttgatggaaaattggatttgctagttcattatcttgatcaggca

SEQ ID NO: 752 - DNA, 670 bp, Panax ginseng
aagcagtggtatcaacgcagagtacgcgggggctgcacaatagagtttctgcccagcctccattttgcaccttcttccccaaatctccagaacctgcaataatggcggaacagaccgaaaaggcgtttttgaagcagcccaaggtgtttctttgctcaaagaagacaggaaagggaaagaggccaggaaaaggaggcaatcgtttccacaagagcgttggattaggattcaagacacccagagaggctattgaaggtacttacattgacaagaaatgcccatttactggagatgtttctattaggggccgtattcttgctggtacttgccacagcgccaagatgattagaactatcattgttcgccgtaactacctgcattatgttaagaaataccagaggtatgagaaaagacattcaaatattccagctcacgtatctccttgcttccgtgtgaaaagagggagaccatgtaattgttggccagtgcaggccattgtcaaagacagttagattcaatgtgttgaaagtgatcccagctgggtcttctggtggtggaaagaaggctttcaccggtatttgagtttggtgtctggtcagtgttacattatatgggcgggaatgatgttagagtttactattttggctaggtggaaccttttcccattgac

SEQ ID NO: 753 - DNA, 866 bp, Podocarpus macrophillus
gttagggttctagccttttaggagaggaaggaggattaggtcttttttcttgcattcctggtagccatggcagagcagacggagaaagcgtttctgaagcaacccaaagtcttcctttgttcaaagaagtcagggaaaggaaaagccaggaaagggaggaaacaggttctggaaaaacgtaggtcttggcttcaagactcctaaagaagctattcaagggacttacattgacaagaaatgcccattcactggaaatgtgtcaattagaggtcgtatattaactggaacatgttacagtgcaaaaatgaaccgaacaatcattgtacgtcgcaattatctccattttgtcaagaaatatcagaggtatgagaagaggcattccaacattcctgcgcatatttcaccttgtttccgtgtcaaggaaggtgatcatgttataattgggcagtgcaggcccttgtcaaagactgtaagatttaatgtattaaaggtgattccagcaggttctagcagtggtgcggctaagaaaggcttcacggccatttgaagattacctccaggaaattagggcatactttataattttatttaggagcacagattaggcttctgtagagatcaaacttgattcataatttgctctaaatttcctaagttaattattttgtttggttattgccccctaatgtgttatgtcctgtcacatcttgactatctgctatcattttaattttacttagaaattttggaattgtaagcttcttgtagctttcctattccttcggtgaatatactgggaggaagtcttcctctgccttctgctttgaaatttgagtattcttactgttattttacttggcgtcact

SEQ ID NO: 754 - DNA, 693 bp, Scabiosa columbaria
cagggttttgcagtagtgctaaaagttagtttcttccattgcctcctccgctcatcttctatccttacagtaatccatcgccatggctgaacagacggagaaggcatttctcaagcaacctaaagtctttctgagttcgaagaaatctggcaagggaaaaagacctggtaaaggtggaaaccggttctttaagagtgttggtctcggttttaagactcctagagaagccattgaaggaacttatattgataagaaatgccccttcactggtaatgtttcaataagaggccgtatcattgctggtactttgccacagtgcgaagatggtgaggacaatcattgtccgaaggaactatcttcactatgtcaagaagtatcaaagatatgagaagaggcactcgaacattcctgcacatgtatcaccctgcttccgtgttagggaaggtgaccatattatcgttggccaatgcaggccgttatcgaagacggtgaggtttaatgttttgaaagtggtaccggctggatcttcgggcggtggaggaaagaaggcttttactggcatttgagttttccttgtttctcttagtgtttcagcgtgattagcttattggtttttttgttctaaagctactattacagttatttgcaatttttgcaccagcgttatgcaatttgaattaaattttgatcaac

SEQ ID NO: 755 - DNA, 673 bp, Echinochloa colona
gccgccgccgccgcatcgccgctcgacgcccaccgcgcagccatggcggaacagactgagaaggctttcctcaagcagcctaaggttttcctcagcacaaagaaatctggcaagggtaagaagccaggcaagggaggcaaccgcttctggaagagcattggtcttggctttaagaccccaagggaagcaattgaaggtacctacattgacaagaagtgcccattcactggaactgtgtctatcagaggcagaatcattgcaggaacatgccacagtgccaagatgaacaggaccattattgttcgtaggaactacctccactttgttaagaaataccagaggtacgagaagaggcactccaacattccagctcacatttccccatgcttccgtgtcaaggaaggtgaccatgtcatcatcggccagtgcaggcccctgtcaaaaactgtgaggttcaatgttgtgaaggtcattccagctggatccaccggtggtagcggcgggaagaaggccttcactgcggcctaagctttagactatgtcttatcagcagtctatagaatgatgtctttttgcttaaaatccctgctaggctggtgttttcgactatggtttggatattgttctccatctgcaacgagccccatcatctgaacatgttactctttatgga

SEQ ID NO: 756 - DNA, 592 bp, Setaria italica
cacttccttccgagtctcagctccgcacccccttgcgcgccgccgccgccgcatcgcagctcgacgcccaccgcgcagccatggcggaacagactgagaaggcattcctcaagcagcctaaggttttcctcagcacaaagaaatctggcaagggtaagaagcctggcaagggaggtaaccgcttctggaagagcattggccttggtttcaagacccccagggaagcaattgaagggacctacattgacaagaagtgcccattcaccggaactgtttctatcagaggaagaattattgctggaacatgccacagcgctaagatgaacagaaccatcattgttcgcaggaattacctccactttgttaagaaataccagaggtacgagaagaggcactccaacatcccagctcacatctccccgtgcttccgtgtcaaggagggtgaccatgtcatcattggccagtgcaggcctctgtccaaaactgtgaggttcaacgtcgtcaaggtcatcccagctggaaccactggcggtgccggcgggaagaaggccttcaccgcggcctgagctttagactatgttccatgagtagt

SEQ ID NO: 757 - DNA, 1440 bp, Conyza canadensis
taaagtttcactctctcattgcctttgtgcctccgccatccacctgcatctctcttcaactatggctgaacagactgagaaggcttttttgaagcaacctaagggggggggggctagggttgtataaagtttcactctctcattctttttgtgcctccgccatccactgaatctctcttcaacaacaatggctgaacagactgagaaggcttttttgaagcaacctaaggtgtttctatgctcaaagaaaagtgggaagggtaagaggcccggaaaaggcggcaacagattctggaagagtattggccttggttttaagacccctagagaggctattgaaggaacttacattgacaagaagtgccctttcactggtgatgtctccatccgtgggcgtattcttgctggtacatgccacagtgccaagatggtaaggaccattattgttcgcagggattacctccattacgtcaaaaagtatcaacgttatgagaagaggcactccaacattccagctcacatttctccgtgcttccgtgtgaaagaaggggatcatgtcaccgttggacaatgcagacctttgtccaagactgtgaggttcaatgtgttgaaggtgattccagctggatcttcaggtggtggcaagaaggcatttacaggcatttaagaagcttagtagcccctttatcttgttacattctgcaaaatgattctgtttgattagccgattttgaagtgaaacgtggtttgatttagatctgggtttgatgtttctatggacgtaattggttgctactagtcttattctacatttgatgtactaaaaagattgtatgactttaatattagaatcaatttttgatttggcatgatcagtcatagcttttcctttctttttgattgctacattagcattttaactctacaatcaatggatgtcatgatataaactgtactggcgtcatgaactgaatgaagagttagtatttgtagtttggaagtatataaattcaaattgtcttctctctgtaatctaaagaagctgtcttgaacatacaactatacaataaaggtggcttagctgccgacggcttcttgagacagaatcacatttgtacagttatgagtgaaattttctacttctgtatgatgatttttgtatttaaaaaggtgcaaaaatcgctctgatcattacatattggtactacacacttttgagtgatattaaaatttaaacatacactttgagtacattacgtgcatcaaagcataagtgaagctaggaatatagaagctttgaagcaatgaagcattatgctcaaaacattctaggtcctaaatatagattgaagttagtacctttgttgagtgtcaatactgatttcattactcctgaacccagagaaaaactacctcggatgactcttcactcaatgaaag

SEQ ID NO: 758 - DNA, 1041 bp, Rosmarinus officinalis
caatattgggggtagtagagttgaggagtggcaaaatagagtttgaactatgaactgccatatataaagagacattacatctgatgtctgagctctatcgtccctagggttttattgccgccgccgccgcttcccgcattttcagctaaatatcggagagagctacaatggctgagcagactgaaaaggcttttcttaagcagcccaaggtgttcctatgctcgaagaagacggggaagggtaagcggccagggaaagggggcaaccgtttttggaagagcatcgggttaggtttcaagacgccccgcgaggctactgaaggcacctacattgacaagaaatgccctttcactggtgatgtctctattagaggccgtattttggctggaacttgtcacagtgctaagatgatgagaacaatcattgttcgaaggaattaccttcactgggtgaagaaataccaaagatacgagaagaggcattcgaatattccagcccacatttctccatgctttcgtgtgaaagaaggagaccatgtcaccattggccagtgcagacccttgtccaaaactgtgaggtttaatgtgcttaaggtgattcctgctggttcttcgggtcttgggaagaaggcctttacagggatgtgagctaagaaattgcacatctttctctatgttagtgcttttagaaacatgagtttagtttttgtttttcgggattgaaatgtaagttgaggatttgcctggaggctttaaaatttccagcctgcccatattttattctataccagtcctgctttctaatttcctggattcagtgtgcaattctattgtggaaatctgatatgatttgtttctctgcccctttctgtggtccaattttatcagtctcgtgatatctgttatgtagtcatttgattgtctttctggttaggggtgcatgtactttgtaaactcaaataataacaatgtgactcttttatgggagagaaattcttgtcttgtaaatttgaaatggtaaaaggtacttctgttcgtatcc

SEQ ID NO: 759 - DNA, 930 bp, Rosmarinus officinalis
ttaacatctgacgtctgcgctctctcgtcgctagggttttattgccgccgcctcccgcattttcagctaaacaccagagagagctacaatggctgagcagactgaaaaggctttccttaagcagcccaaggtgttcctatgctcgaagaagacggggaagggtaagcggccagggaaagggggcaaccgtttttggaagagcatcgggttaggtttcaagacgccccgcgaggctactgaaggcacctacattgacaagaaatgccctttcactggtgatgtctctattagaggccgtattttggctggaacttgtcacagtgctaagatgatgagaacaatcattgttcgaaggaattaccttcactgggtgaagaaataccaaagatacgagaagaggcattcgaatattccagcccacatttctccatgctttcgtgtgaaagaaggagaccatgtcaccattggccagtgcagacccttgtccaaaactgtgaggtttaatgtgcttaaggtgataccagctggttcttcgggtcttgggaagaaggcctttacagggatgtgagctaagaaattgcagatctttctctatgttagtgcttttagaaacatgagtttagtttttcttttgccggattgaaatgcaagttgtggatttgcctggtggctttaaattttccgacatgagtttagttttttgtttttcgggattgaaatgtaagttgaggatttgcctggaggctttaaaatttccagcctgcccatattttattctattgtggaaatctgatatgatttgtttctctgcccctttctgtggtccaattttatcaggcgcgtgatatctgttatgtagtcatttgattgtctttctggttagggttgcatgtactttgtaaactcaaataataacaatatgactgtttt

SEQ ID NO: 760 - DNA, 750 bp, Glycine max
gagagaagttattagggtttttgagtgcggcggtccaaacactcttctctgcagcttttgcctacaactcccttcaccatggctgaacaaaccgagaaagcttttctgaagcaaccaaaagtgtttctcagcacaaagaagactgggaagggaaagagacctggaaaaggtgggaaccgcttttggaagtccattgggcttggatttaagactcccagggaagccatcgaaggaacctatattgacaagaagtgccccttcactggcaatgtttccatccgtggccgtatcttggctggaacatgtcacagtgctaagatgaacaggactattattgttagaaggaattatctccattttatcaagaagtaccagaggtacgagaagaggcactcaaatattcctgctcatatatcacctgccttccgtgtgaaggaaggggatcacgttattattggtcaatgcaggcctctctctaagacagtgaggttcaatgtcttgaaagtgatcccagctggatcttctagtggtgcaaagaaggcttttactggaatgtgagcttcgatttccagtttttattgaagaaaaatgttaccttgttatttagtagatctgatttcttttctggaaggtgacatattaaaaccttatcaattttggattttctttgaggtttcgttcgggctttatgtttaggattttgttatacattatgtttttcgaatactatttgccttttaatttttgaaa

SEQ ID NO: 761 - DNA, 1371 bp, Ambrosia trifida
ttatctatcttacacattacgcctgtgttccgccgcttctaactctcatcaacaatggctgaacagacggaaaaggcttttctcaagcagcccaaagtgttcctctgctcgaagaagagtgggaaaggaaagaggcctggaaaaggtgggaacagattctggaagaatattggtctcggattcaagaccccaagagaggctattgaaggaacttacattgacaagaagtgccctttcactggtgatgtatccattagaggtcgtatcatagctggtacatgccatagtgctaagatggtgaggactatcattgttcgaagagactatcttcattatgtgaagaagtatcagagatacgaaaagaggcactcaaacattcctgctcacatctcaccgtgcttccgtgtgaaagaaggtgaccatgtcactgttgggcaatgcagaccattatcaaagacagtaaggttcaatgtcttgaaggtgattccagcaggatcttcaagtgctgggaagaaagcatttacgggcatataaacaatatgagcgttcagctcttttgcttgataatgtagaagtttttgagaacaaaacgtcgttttattgagattataattctgttttttacaaaacgtactatcaaactaatttatttataacaattgttcatttgtttatataatctaacacgacttctataaaatttgcagaaaccattgataacacgtataaatcccataatcatataggattttcatcattgtattaactcaacttctttcaccatctcatcttcatctcttgaatttcctaggcccttctttcttctcacttgatggagtttcagtaccgacggtggcagtggtggtggcggcgggttttctagggacacttccaaagccagcaacctcatccatactctggccttggcggcgatatcgaccaccagtggcgacaaaaccaggacaaggtctgtaagctttgatgggccaccagccaaagcctggtacggttgcaataccaccttgaatccttccttcaccgttacatcccctctccatctctgctttcccacatgcctgacaacccccaatgggaattgaattgattggttgagattggtcaggaaggctgtcagaagaggtggtggtggtgttgtcttgttcagagtcttcttgtttgtctactgtgggggttgaggaagaagctctgaggataaagagtggagatttggtctgccatgatttggtggagataaaagattggtggtgattgggtgatattgggaggagaagagggtggttgccgcatttcaggtgtgtctcactccgacctcagtttttggagttgaggtggagaagaagaggaaccata

SEQ ID NO: 762 - DNA, 761 bp, Arnica chamissonis
ctatacctgtgtccgccgctgcaaagctgctaatttctcgttaacaatggccgaacaaaccgagaaggcgtttttgaagcaaccgaaagtgtttctctgctcgaagaaaagcgggaaaggaaagaggcctgggaagggtggaaacagattctggaagagtgttggtctcggatttaagacaccaagagaggctattgacggaacatacatcgacaagaaatgcccttttactggtgatgtatccattagaggccgtattttagctggtacttgcaacagtgctaagatggtgaggactattattgtacgacgggactatctacattatgtgaagaagtatcagaggtatgaaaagaggcactcaaacatccctgcacacatctcaccatgctttcgtgtaaaagaaggcgaccatgttaccattgggcaatgcagaccgttatcgaagacagtgaggttcaatgtcttgaaggtgattccagcaggatcttctggtggtggaaagaaagcatttacaggcatttaaactacatgagtgttgaacttatctagcttgatcatgtaaaagtttttgagaacaaaattggagttatgttgttttatggacttttctgttgttttcagttaatctctatgctttctgttattatttttttagaaatttttatatggtgccgtttttaagcatctgctgttttgcttgctgattatatgactgtttatgtcaatttgatttgtttctcattatatttacactcgct

SEQ ID NO: 763 - DNA, 782 bp, Musa acuminata
ggcgctagggtttggatttagcgtacgaggagctccacagcctctctctctctctctctttggccgacgcttccgttccttcgttcctcgttcttctcccctgatcggtcatggcagaacagacagaaaaggcattcttgaagcagccaaaggtgtttctatgctcaaaaaaatctggaaagggaaagaggcctggaaaaggtggtaatagattttggaagagtattggtcttggcttcaagacccccagagaggctattgaagggacctacattgataagaaatgcccattcactgggaatgtttcaattcgaggtcgcatcttagcaggcacatgccacagtgccaaaatgaacagaaccatcatcgtacgccgtaactaccttcactatgtgaagaaatatcaaagatacgagaagaggcactccaatattgctgcacatatatctccttgtttccgtgtgaaggaaggtgaccatgttattattggtcagtgcaggccgctggcgaagactgttagctttaatgtactaaaagtcatcccagctggatcaacaagcggtggtgggaagaaggcctttgcagcagtttgaattttgctagaaatgcctgaaagttttgcattttgtggtggactatgttcagatttctgatagtttggttatggttagttcattttattttgcaaagtgtggtaaacaccagaaagttatttcggattttgttgaaatgatagagaatggagtaaaacttgtactcaatgcccatggaattgattgaga

SEQ ID NO: 764 - DNA, 680 bp, Musa acuminata
ggctactcctttcgttccgccgtcgcgcttgatctccttgtccaaggaacccacgttgcttatcgatcatggcggaacagacggagaaggcattccttaagcagtcaaaagtgtttctttgctcgaagaaaactggaaaggggaagaggcctggcaagggtggaaacagattttggaaaagtatcgggcttgggttcaagaccccaaaagaagctattgaagggacttatattgataagaaatgtccattcactggaaatgtatcaattaggggccggattttagctggtacatgccatagtgccaagatgaacagaaccatcatagtacgcagaaactatcttcactatgtgaagaaatatcaaaggtatgagaagcggcactcaaatattgctgcgcatatttctccttgcttccgagtgaaggaaggtgatcacgttatcataggccagtgcaggccattggccaagactgtgacattcaatgtgttaaaagttattccagctggatcaacaagcggaggcggaaagaaggcttttgctgcagtttgaagaatctcatgcatttttggttgccaacaaacaggccggagctagatagaaggaactttaatctggatgaacactgttgggttcttttagtttagaactacttatcgttctctttttgctggaaccgtg

(The sequence listing continues in the following parts.)

What is claimed is:

1. A method of increasing at least one trait selected from the group consisting of biomass, plot coverage, rosette area, rosette diameter photosynthetic capacity, nitrogen use efficiency, and tolerance to nitrogen deficiency stress of a plant as compared to a control plant, comprising over-expressing within the plant a polypeptide at least 95% identical to an amino acid sequence set forth by SEQ ID NO: 15889 as compared to a control plant of the same species which is grown under the same growth conditions, wherein said amino acid sequence comprises the domains depicted by InterPro numbers IPR032675 and IPR001810, thereby increasing the at least one trait selected from biomass, plot coverage, rosette area, rosette diameter, photosynthetic capacity, nitrogen use efficiency, and tolerance to nitrogen deficiency of the plant as compared to the control plant.

2. A method of increasing at least one trait selected from the group consisting of biomass, plot coverage, rosette area, rosette diameter photosynthetic capacity, nitrogen use efficiency, and tolerance to nitrogen deficiency stress of a plant as compared to a control plant, comprising over-expressing within the plant a polypeptide comprising an amino acid sequence selected from the group consisting of SEQ ID NOs: 15889, 17881 and 17882 as compared to a control plant of the same species which is grown under the same growth conditions, thereby increasing the at least one trait selected from biomass, plot coverage, rosette area, rosette diameter, photosynthetic capacity, nitrogen use efficiency, and tolerance to nitrogen deficiency of the plant as compared to the control plant.

3. A method of producing a crop, comprising growing a crop plant over-expressing a polypeptide comprising an amino acid sequence at least 95% identical to the amino acid sequence set forth by SEQ ID NO: 15889 as compared to a control plant of the same species which is grown under the same growth conditions, wherein said amino acid sequence comprises the domains depicted by InterPro numbers IPR032675 and IPR001810, wherein the crop plant is derived from plants which have been subjected to genome editing for over-expressing said polypeptide and/or which have been transformed with an exogenous polynucleotide encoding said polypeptide and which have been selected for at least one trait selected from the group consisting of increased biomass, increased plot coverage, increased rosette area, increased rosette diameter, increased photosynthetic capacity, increased nitrogen use efficiency, and/or increased tolerance to nitrogen deficiency stress as compared to a control plant of the same species which is grown under the same growth conditions, and the crop plant has the at least one trait selected from increased biomass, increased plot coverage, increased rosette area, increased rosette diameter, increased photosynthetic capacity, increased nitrogen use efficiency, and/or increased tolerance to nitrogen deficiency-stress, thereby producing the crop.

4. The method of claim 2, wherein said polypeptide is expressed from an exogenous polynucleotide comprising the nucleic acid sequence selected from the group consisting of SEQ ID NOs: 407, 105, 2975 and 2976.

5. A nucleic acid construct comprising an isolated polynucleotide comprising a nucleic acid sequence encoding a polypeptide which comprises an amino acid sequence at least 95% identical to the amino acid sequence set forth by SEQ ID NO: 15889, and a heterologous promoter for directing transcription of said nucleic acid sequence in a host cell, wherein said amino acid sequence comprises the domains depicted by InterPro numbers IPR032675 and IPR001810, and wherein said amino acid sequence is capable of increasing at least one trait selected from the group consisting of biomass, plot coverage, rosette area, rosette diameter, photosynthetic capacity, nitrogen use efficiency, and/or tolerance to nitrogen deficiency stress of a plant.

6. A nucleic acid construct comprising an isolated polynucleotide comprising a nucleic acid sequence encoding a polypeptide which comprises an amino acid sequence selected from the group consisting of SEQ ID NOs: 15889, 17881 and 17882, and a heterologous promoter for directing transcription of said nucleic acid sequence in a host cell.

7. The nucleic acid construct of claim 6, wherein said nucleic acid sequence is selected from the group consisting of SEQ ID NOs: 407, 105, and 2975-2976.

8. A plant cell transformed with the nucleic acid construct of claim 5.

9. The plant cell of claim 8, wherein said plant cell forms part of a plant.

10. A transgenic plant comprising the nucleic acid construct of claim 5.

11. The method of claim 1, further comprising growing the plant over-expressing said polypeptide under nitrogen-limiting conditions.

12. A method of growing a crop, the method comprising seeding seeds and/or planting plantlets of a plant transformed with the nucleic acid construct of claim 5, wherein the plant is derived from plants which over-express said polypeptide and which have been selected for at least one trait selected from the group consisting of: increased nitrogen use efficiency, increased tolerance to nitrogen deficiency stress, increased biomass, increased plot coverage, increased rosette area, increased rosette diameter, and increased photosynthetic capacity, as compared to a control plant, thereby growing the crop.

13. The method of claim 1, further comprising selecting a plant having at least one trait selected from the group consisting of increased biomass, plot coverage, rosette area, rosette diameter, photosynthetic capacity, nitrogen use efficiency, and/or tolerance to nitrogen deficiency stress as compared to a control wild type plant of the same species which is grown under the same growth conditions.

14. A method of selecting a plant having at least one trait selected from the group consisting of increased biomass, plot coverage, rosette area, rosette diameter, photosynthetic capacity, nitrogen use efficiency, and/or tolerance to nitrogen deficiency stress as compared to a wild type plant of the same species which is grown under the same growth conditions, the method comprising:
(a) providing plants over-expressing a polypeptide comprising an amino acid sequence at least 95% identical to the amino acid sequence set forth by -SEQ ID NO: 15889, wherein said amino acid sequence comprises the domains depicted by InterPro numbers IPR032675 and IPR001810,
(b) selecting from said plants of step (a) a plant having at least one trait selected from increased biomass, plot coverage, rosette area, rosette diameter, photosynthetic capacity, nitrogen use efficiency, and/or tolerance to nitrogen deficiency stress as compared to a wild type plant of the same species which is grown under the same growth conditions,
thereby selecting the plant having the at least one trait selected from increased biomass, plot coverage, rosette area, rosette diameter, photosynthetic capacity, nitrogen use efficiency, and/or tolerance to nitrogen deficiency stress as compared to the wild type plant of the same species which is grown under the same growth conditions.

15. The method of claim 13, wherein said selecting is performed under non-stress conditions.

16. The method of claim 13, wherein said selecting is performed under nitrogen deficiency stress conditions.

17. The method of claim 1, wherein said polypeptide is set forth by SEQ ID NO: 15889.

18. The method of claim 3, wherein said polypeptide is set forth by SEQ ID NO: 15889.

19. The nucleic acid construct of claim 5, wherein said polypeptide is set forth by SEQ ID NO: 15889.

20. A plant cell transformed with the nucleic acid construct of claim 6.

21. The plant cell of claim 8, wherein said polypeptide is set forth by SEQ ID NO: 15889.

22. The transgenic plant of claim 10, wherein said polypeptide is set forth by SEQ ID NO: 15889.

23. The method of claim 12, wherein said polypeptide is set forth by SEQ ID NO: 15889.

24. The method of claim 14, wherein said polypeptide is set forth by SEQ ID NO: 15889.

\* \* \* \* \*